United States Patent 6,812,339 (POLYMORPHISMS IN KNOWN GENES ASSOCIATED WITH HUMAN DISEASE, METHODS OF DETECTION AND USES THEREOF) - sequence listing, part 66

SEQ ID NO: 16271 - DNA, 9042 bp, Human
ccatgcccggctaatttttgtatttttgatagagatggggttttgccatattggccaggctggtcttgaactcctgacctcaggcgatcctcccgactcggccttccaaagtcctgggattacaggcgtgagccaccgcacctgcccaggtacactttttatccagatatctatgcacattgattcttgactccacactcctgcctctctccgcaaggccttccctgacccccttgttttgaattgcaatctgccctcacataatccgtacgccttttctgtttaatttttttcaaccgcactttttaccctctcacattctctagatttggggcatattacttgtctccttccatcagaatgtaaactccacgagattaggagtgctgtcagctgtgttcccttctctgtcaatcgccagcgcctccgaacagctcctggcacatagtagttgcttggtaaatatttgtgcaatgcacgaggccgcatatgaccggaatgggaggtgaggggattattttctggcctggaccagcgacggatggtggtgccaccgggttggggagcacgtcggggatggcgcgtaacgatgttagctggggccaggttgagctaggcacgcaaatacaactttttttttcctggaaaccctgtaacaggaaggttccggagggcgggacagcgtcggaggcaggcagctaggccatgccaaatggcactggggcttcgtgtcgtgccacaggcgtggaccgaaaatgcggacacatgcaggctgcctctcctcgcaggcagaagccacacgcagacctagaccctttgcaccgcatccccttattcaatcgcgcacccgccacccttcgacagttcctctccctccaccccaaccccacgccgcgcgcgaggctggccctttaagagccccgccccgactccctcccccctcgcgtgactgcgagcccccgcgccgggccggggaatgggtcggctgggtggctgcgcgggcctccggtccttctcacgcaacgcctgggcaccgcgcctccgggccaggtggggcggggacgggccgcctgacctctgccccctagagggatgtcgccggcgcacgcaagctagccgggggtagggtgggggctccgcgccaggtgccccctccgtggtccctgggcccgagtctttccgtggccccccgccgccggatttctgtgctctgccaatcaaagcactagccaccccgggagccaagagggaccctcaagggccggtgggtcctggctggagggaccgcgcgttgcaatcagcactaaggcgatcctagaggctgcgaggagccgctagtgagcgctcagcgagcctgccccttcgccatccattccgatccttcaatcaagaggcgcgaacctcagctagtcgcccgggctctgggggacaggtccagccccgcggcgcctctggccttccggcccccgtgacctcagggctggggtcgcagcgcttctcacgcgagccgggactcagtaaccccgggaaggaggtcaccacggggcagccccgcccccgcctgccgagtcctggtaggctgtagcgctggggaggcatctgcacgcccagcgttccagtgggtgcaaaaatgacgaagaggagtccccgcgccccaggatggagcttcccgtaccctctcttcgggctgtcctgggacttctccctcaagccccctcctcggctgggttctgcactgcccttgggacgccttggaattgggacttccaggtgttcccagccctcacccctctatgtacaggcaccgagatgtgtcccatagtgggttcttgcccacccgaccccccacccccgccgccctccgccacctttctctccaatcccagagagaccagcccggttcaggctgcttctccctccatctcagctcgctccagggaaggaggcgtggccacacgtacaagcccgcctataaaggtggcagtgccttcaccctcaccctgaaggtgacagttccttggaaccttccctgatccttgtgatcccaggctccaagagtccacccttcccagctcagctcagtacctcaggtgagttgctgggggacttctggcttgccctttctctcccaataaaaggaacattttggtgcctccaggacttcttaggtagctacctgtctagcacctccaaaaagggaggctcagagtgtttttagtgaccaggcagtctagccccctagtggggaaactgaggccaggggaagaggaggacttgcccatggtcccacagctggtaccagacctctagatacagatggcatctcattcaggacttcaggacccaggctccagctccatcccctagtgagtgtctccctgcctaccctggggcttccccatcaaggccacctggcaggctggaatatgtgcagcccctccctcaggctttctgatgacaggggcttctccttgggtggacagggtggatggagggggtgggctgggttcttaccagctgtaccctgccctagcctaagaagctacccctggcagattttaccctcctaagggtggcttgtcagtgctgagatgtcctagacagctgggacaatagaggcagatctgtgcaggagtcccaggcctttcctatctcattgaccatcttctttgtcctttgctgggagacaatcaggttgacagattgccaactgcagggagctggaaataccagtccctaaaaactcaccagtcacatctcccttggcctcctaccatcttacaaaggctgcaggtccttgggatacccactgtgcagaaggggacaccatagcacaccaaagcctggcactgtcccctgttgactcagggatctagtgtgctttgatatttagcccctccaggaagcctccctccactataatacttgtggtaggaaccatccatctccctgtcttgtgaggttctcctgtggggagcctaactggtaagactgtcaggttccccacagcagatctgggttttctcttccctctggatccagctgggtactctgaactgagagatcttgtcttaccctctctcagatgttgaaattggaccccagaaaagtaaaatgtgcagtccaagatcactttgactagaatgttgggtctactgacctctagtccagggtaacaggcagagatgcctgatatgttggagagagtggtttatgaatttaaacaccctttttaggtcaagcttacagagaaagtattgcctcagtttcctttcagtttagatccattcctgatttccctgattccagtctggggttttcttacagcctagtgggaaccttccatttattctctgctctctggtaacctgcaaaagggggaggtccaaactgttcattcattgagaattgagccaaaaaaaaaccctggcctggatttctctgactaaagagctcaatctagctggtctccagctgcctttaaactgtggatcagttgaactcagagagctggggctgaaagcaatgtggtttgggaagtggccatcctgtcccctatctcttcctcagtctgtcctggggtctggtgggatttcctgcatcctgggattgagcagcagagaactgagggttctgggaaaattccttcattgatctgaccactcttcaaaaggaggtacatgtgacagcagctggaaatttccagggaagtgtccctaaggagtctgagtcctggctctgtcactgattgctgggggactttggacaagtcagcgctgcttcccccaaatgttaaatgaggctaaaggatcagatgatccctaattcccctgagaacatgattttcctaagtgtggtgggtaggactcggggtgatacaccttgattatgtgtttattttaatgtgttaggggaaaaatcaaacttgtactttcacatagatattgtttatgatgatatgtaggtagatttaaagttgattttaggaaaatgtgaagtaaataacagtactggtactatgtggaaatcacagattgacattggaagatgtcagtttagattggtacagcagttaagagaaagcgttctggaattaggcaacttggcttgggagtctgcatccaacactttctggctgtgtgaccttgggcaagttacttaccttctctgagcctcattgcaggctacttcatagatttgtggccagggctgaatgaagaaggactgtgaaattcttagcccacagtggtagttcaacaacttctccccacctcaccctcttcttcatgcccagtaagcagttctggtggaaaggtttcccctttccctgacactctagatattggcttttctcatcccccaatctgacggcttgactttttttcttcctgcaccttctctcagcagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaaggtacagtctggggaaaggcaggtgggtggtgggaagcagatggcatcagggcctgggaggtcaaaggtaagaggaactgcatggggcttggcaagttctcaggaaggcttcaacctgggatcttgaagccagttgtggaatagtcttcttccttggcagggaaatagaactttatcttgactaacccttccatgcttccacagacagcaatagccactgaagagtcattacatgcaggaccctggggcagttgctgagggagccaggaagagttaaagagttcatctcctggcctcataatagaaagaagataaagagcacatccagatgataacagtacaagacgctgtgtgtcaaatgtcccatgagttggggctagcagcattctaaggtagtaggagagagccttgcagaggcagagagaagctgggacaacagcctcagggggcatcacctccagaacaaatgtgctaggaatagtgaaggaccagacctggatggagaggtagctctgggtttgagatcttgctcacctgtggactttccctacctaagggccacatccgggacatcacagacagcctgattgagcactgtcaggagaagcagctggatgagaacgccaatgtccagctgtcagatgagaagatcattaacatcgtcttggacctctttggagctggtatggttaccccattgtgtccttcctgtgctcaagtgccctgacctgctgctgcctgcctaacttcttctgttctaccctgtccagggtttgacacagtcacaactgctatctcctggagcctcatgtatttggtgatgaaccccagggtacagagaaagatccaagaggagctaggtaggtagtggctcccttcaaaggggtcagtgccaggggtctggccaggtctaggcagcccctgcatccatcttgtccctgtgttctgcagacacagtgattggcaggtcacggcggccccggctctctgacagatcccatctgccctatatggaggccttcatcctggagaccttccgacactcttccttcgtccccttcaccatcccccacaggtaaggccccatggagccactgctgtctgttactgatcttactccggaccacatacctgattagggttagtgggagggacacggcatgggagacagggagatttgcctgttgccctgagcctgactgagcttcctttctccctagcacaacaagagacacaagtttgaaaggcttttacatccccaaggggcgttgtgtctttgtaaaccagtggcagatcaaccatgaccagtaagttcagagatgcagaggaaaggctgggtccaccctcttaagctcttatatatgattaatacaatcattgcattgatcctcctgtccatgggctgcttgcctgtcctctatcctttggggctggagctccactcacttgacacttctgagccctgaactgccacttcagctgtctccctctggttacaggaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagaccagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtaaaacagggccacatagatgctgatggagccttcccaagttgtgcttgagccaggaggcctgctagggttaggaggtccttaggcctctgagaagctctgaagaactctctggaagcccctgggcccagtacctagctggctctgtgagggtgctgactggcttcagcaagttagaactagccaaaccaggaccctgtccaatctttgacaattgggagctgccaagagtgaagggaagagacagcccaggatactggcacagaggtagtctcactgcttgaactaggctgagcaatctgaccctatgggtctaggacacagttcctgggaacatcacattcctctgcccttcctgcaggcaggaacaaacagggctgccttctggccttgtaagacccttattgctgtcctggaggggctggggacttgtgtctgcggggatcagagcgcacagggagtgcacatatccaggcaccaggactagggctggagtgaggggggggtatttcaattaccttctattggtctcccttctctacactcttgtaataaaatgtctatttttaatgtttgtacacaacaatccttctattctagcctgcattgagcttgcatgcttgcataagagcttaagaaccattgatttaatgtaatagggaaaattctaacccaggtatccaaaaatgtgtaagaacaactacctgagctaaataaagatattgttcagaaatcctataggtggagattttttgaatcataaatgattcatcactcgtctaaatactcaccctgaaccccattctgtgttgggttttactgtagggaggaagaagaggaggtagcagtgaagaggtgtagccgctgcacttaagcagtctgtttgagggacaagactctattttttgagacagggtccccaggtcatccaggctggagtgcactggtaccattttgtttcactgtaacctccacctcctgggctcacacgattctcccacctcagcctctgagtagttggggccgcaggcacacgccaccacagcttttttttttttttttttttttttttgtagagatggggtttcaccatgttgcccaggctggtctcaaactcctgagctcaagtgatccacctgcctcagcctcccaaagtgctgggattacaggcatgagacaagactcctaatcactgtgctgacttacgccctctctaacttatcacaaattgatgaagcgtattctccgaattaggcaataagggtatcaagtgaatatagtacagtccctgctttcaagaacctcccaaaatggttgagggaactgacacataaacacatcattcaattcattgtggtcagaactctaccagacagatgcatacgggaggtggggtccagaggctgggttggggagtgggcaccgcgagatttccaggtcttttttttttgagacggagtctcactgtgtcgcccaggctggagtgcagtggcgcgatctcggctcactgcaagctctgcctccggcgttcacaccattctcctgcctcagcctcccaagtagccgggactacaggcgcctgccaccacacccggctaatttttttgtatttttagtagagatggggtttcaccatgttagccaggatggtctcgatctcctgacctcctgatccgcccacctcggcctcccaaagtgctgggattacaggcgtgagccaccacgcccggctccaggtcttgagactatctgagccaagccttccttgaaggatgagagacagtctttcat

SEQ ID NO: 16272 - DNA, 13058 bp, Human
ccccattttcccgtgaaaagcatgcccctttcattgcatccatatcatgactaccaaatacctcctctatttcttcctcttttagcatgttaaatgcagcttcctaagctctctatctggatatcaacagtattctctccaaataattctaagactttaaaaattggtttaatcttcttacccctaaaatcaccccccttaccaactgcctcatgacaatcattggtactgtcactgagcttgcaacccatgttcttaaacatagagtaatctttgactccacatctaatcattcataaagctgtattgtctatcaaattaaatctgacatttatgtgagagcacttcatagtctgtaaagcactacacaggtgataacatgaagctacactcataatggatttgcaggctctgcttctcatttggcttctacagcctcatccctcaccaacttcttgccctacctctctctttcttccccatcacccaatttcccagtcagtcaggccaacagaatgcattctatatacgcgacttgctttccccaacatctttgcctgtatgcatgccacttatttgcctcagttgatctttatttcaacaagtgtttgcagaggagaaacctcgctggctccttctcctttctattttttttcagaggctacccgtcaggtcaacattgcctttttcagggaagctctgcaagcctgacctcccttggaagtgccttaggactggcttcttgcacagtacacaacctttacttatagagggtttggagattattctttattcatgtcttatttctcctgctcctggaggagatgactctgacttccactgactcttttggggggcttaagtcagggttgagtaccagaggccctaaatagctggacgtggattctggtaatatcaaatccatctttggcttaactgagaggttctgaaagctgggacctgaccttgtccatttccctctttctccagtttcctattatttcccactgttttttttaaaagttttttgttttcttaagttttcacaagaataaacattgaaaataaaatttgcacaaagatcgaactaggaaaggccacacaaccaacacatattacatcattataggtaagttagcagggagatttcagacctgggctagctctggaaccacattttacactgttgaaaataaaagctggagtacagatgactttcccaggttcacagagttggtaagctggagagctgcacctggagccaagcaacctgccctgtcctttccactgcaccctctaagaaatctaattagaaggaacaggtggtatctcattttgtacggtgctttagcaatgtactatttgctttctagtgtgtctattgtctcgtttgacatcttctctcaaaaagtgatgaaacgaaacgctctttttgacaagttcagagtgctcttggttcctgtgtgggattcttccaagtctgaatttggtagtgggaagagaaggaatccggaggaaggaggatgagaagtttaaaggagaggaaagggaagcagagaaggccgcaaggtgcctgcaagatgtctggggagttggaggaatggaagagtgccccgctcttccttctgggagagctccagctaggcagaacctttcaccaaggctctgatatcgtgctggtttccgaaagccccagccgaaggtgtgcagccaaagggtgacagaaggtgaggcacgtgcgggggcgcgggtgctgaccgccgcggtgcgccctccctccgacgtgcggtgtgcggggcgcagacaaccagcggccggcccagggctttcggggagcgaagcagggctcccgaggcaccgagcgagaatgggaatgggagggacccggtgctcccggacacgcccccggcaggtcccacgcccgggtcttctgagacctcgcgcggcccagcccgggagcggcccagctatataagtcccagcggaagaccggaacgcagagggtcctgctggcgcgagggtgggtaggaggggacgcggggactcggcccccaacaccgcgctccgtctgcagccgccgcctctgcaccgccgctgcccggcggtcggttcaaaaaacagaaatcgggtttgctgcccggcggacaggcgtgaagagcaagggaaaggaacttcctccaccttcggggctggagcccttttcctctgcatctccagtctctgagtgaagatggggggcctgacagcctcggacgtacacccgaccctgggggtccagctcttctcagctggaatagcggcgtgcttggcggacgtgatcaccttcccgctggacacggccaaagtccggctccaggtagctaggcagaggggtaagacaaggggtctcaggacagaggggacgctgttgcgtgcattccatttattctctgctttggtgtaaccactgtttctaggtagggtaggtgaccttccaaagcagtctggccttgtcccagggctggtgctttaggatgggaaactggaactttttctgggattagctgaagaaccaccagggccacagagaatgggttgaccatgactactaccaaattctcccaaaatttagggtgcacttagtattttaagagctgagaatattggcctctcctgagtttactagtcaggtgctttttcctttctttgattcttcgggggttctgtcctatcctactgccctaggggttctggagagttcctggggagggggatattcaaaatgtgcattgtagccagcctccctccatctgcgcgtgagcgaacacacacacacacacacacacacacacacacacacacacacggtagagggaggtggatggaagaggaatgttgctgagaaaagaaacggaaaataggaacacagggggaaatcttggcttaagagtgaactcaatttcgctcccttctgttctgcacctttcttatttccaggtccaaggtgaatgcccgacgtccagtgttattaggtataaaggtgtcctgggaacaatcaccgctgtggtaaaaacagaagggcggatgaaactctacagcgggctgcctgcggggcttcagcggcaaatcagctccgcctctctcaggatcggcctctacgacacggtccaggagttcctcaccgcagggaaagaaagtaagccgtgagcgttcctgggaggggcagaaaagccttgggctccgctctgttccaaaaagtgtaacacacagaggagtggttttcataacaaattggcgagaaaacattcatatttgaactctcccttccccaaacattagctcattgttcatagaaaaaagtatgcaaaatcgattttttagatgcagatatatacttgtaaaggtcacccagtcatggaagttttgtgcccagtttggatctccatctggagaatatgggtgggctacagaaaaatgtttaacttaaagttctccaaagagggaagtatatcagaaacatctatggagcttgtcagaaatccaaacgaggactaccatggtcctctgagtctgaatcctcaggctagagaccagagtgtctttccacaagcttccctcatcatttgtgtatgcaacaaagttcaaagccttctgtttgaagcaaagaaagccagactttgtgaagagagttgaaaggacaggaaaagacatatttcctcttaagaggttcctcatcaggtccaggaaagaccagagcagaaaaagtggacgaatgctgcagggagtttgtttaggggaaaaagaaaaggaaacatatttcctgagtgccagtgcactctaagaattcctgtcactttaggtagcatttatttgagggcttaactatgaaccagacattgttctaagtgcttcagatacattataactggaagggtattagtaccattatcccttggcagatgggaaaactgaacacagagcagattcatcacttgcccaaggtcacacagctgggagggggcagagccagggttcaaacccaggcagtctggcctcggactccaggctcctaaccctgttctctactgccttctgcacttctcatatgattctgcccatcattcaaaccgcacaacactgctgtgagtaaaaagtgttagccgaatatcagggtagttaagtaacatgcacaaaatcacacagctaatcaacatcagaggcactttcatgtggagtagacaagccagagagaagatgtgctgatggcacaatgaatacattaagtgaaatccaccttgtagatttcatcatttctgctgtgagtaaccttcaatactataattttatgggataatttataaatgttgtctatacaaatatataagttatacttatccacacaagtactttcaaagtgaagataaagtctggatgttactagatcaaaactgcatttttttatttatagatgtagcaagagaggaaacacaaaggaggtaaagctgcccgttcaggtggttttcttcacagattgactgttctaccaattgttgtggactttgggcaccaaattaataggatatatgttggcagtgttctatgttatatagattcagtttatttagtaggctttattgaactgccatgtgccagtaactatgttagatgtttagatggcagatgtgtctctagacagagcttacagttgagagtatgggttgtgtggggggaagtgaatagatgactatattccatgatacatgctgtattacaatacagtcctacttcacttaacgatggggatacattctcagaaatgagttaggaggcaaattggttgttgaatgaacatcacagagagcacttacacaaacctagatggcatagccacacctaggctatatggtataatctattgctcctaggctacaaacctgtgcagcatgttggtattgaatactacaggcaattgttacataaagttaagtgtttgtgtacctaaaaatagaaaaggtaatgcattacactacagtcttatggggctgggatgtcactaggtgataggaatttttcagctctgttctaatcttacgggaccaccatcatgtatgcagcacatgactaactgtaattacaagatggtggctatattaaacagaactacttaagctagccatggaggtatggtccgtgagattttcctgaagaattaacgtctggatcaattctggaagggccagcaggagtactccaggcaaaggggtgagaaaggagcttccaagtagagtgaaggtcatgtgcaaagactcagtgaggagtcgagtgaacatagcacagggaggacatgttggtgaggaaggaggggtgaagccacagagacaggagggagccagatgacagaaggccttgcaggcggtgctaaggagtttggattttatccttacagtggtgggaagtcattgtaaaaatattaagcaagggagtggcataaacaatttacattttcaaaagatcactttggcagcagatagagtatatatgtaaaaggagtaagaaagaggtaagttagaaagcaagaaatgatcagggtatgccctaaaacactggcaatagggaaaaagagatgtcaatcagaaagattgagaaagtataattgaattgacttggtgaacaaatagaagtaaggcataagggacaggtagaaatatgagatgacttccaagtttctgtttaaagataccctttattgagagaggatgtatagaagctgtcttagggggaagacaagaaatttggtttaggccatgtcaacaggtaatggccagtaggcacatgattcagtttatttagtgggctccttttaggagaaaatctgagccagattccaggaagtcacagcagggactaccaatagggtcaaacagcagagagtgtggaaaggactgaaaagtgatcattgtacataacaaatagaagctcactgattttctagcaaaaacatcttcagcagagtagcgtggtataagctatattgtaggggactgaggaagaaatgggctctgagaagtaaagacaaacaatatgttttgtaaataaatttcttttagttcttaaaaaaaaagcctcttttccagcttgattgggaagtgaagagagggatttgaaagttggagattggaggataggatgagtacatcaagatacactacgttgtagtgcagtgcattacaaatgtgagctaaaagtgaaggcatttgtaatcatatgatattgctaattaaaagacagctgtcagtcatatgcccagctcctggtaaagcatgatgagaagagtacaatcatggtagtgatttaaaaattgctgccagttttgtggattttctttatgctagacagtgtaagctctttatcaatattatttaactcacacaactctaagaggtagatattattatccctttttgacaaattaggaaacagaattataatgactgagaaagtctctgctgagtaaatgttactgaaccttaattttatgtttacttaatgatagaaatgaatattgggcttcaagactatttgtacttaatgaaatctgtcttgagcaacataagctatttttttcaaaattttaagacaaaaatcactttcttctctcctgtcttcttatttttgttcccttcacatgttgtagcctaacactacttgatggcccattttggtgcagtttgtccactgggcttcatctaaggccaccaagtcccataattaacatgatcattcgtgggagaaagatcaagcctcattggtgatgggtgcctcctcacagtcggataatactgaaaagagagctaaatgtgggaaagaaccaagttgaacacaggaaagaatcaggccactgtgaaaataagcattgtgttttcttgttccttgaaagtcttcatttttaaaaaatttcagacacctgaagttttctagccttactctgagttgacgcacatttagtacatgatcaacacataaacaagcattagagaaatagaaaagctgtaagaatacaaaaatatgggccaggtgggtggctcatacctgtaatcctagcactttgggaggccgaggcagacggatcacctgaggtcaggagttcaagactagcctggccaatatagtgaaaccctgtctctactaaaaatacaaaacttagcaggctgtggtggcacgtgcctataatcccagctacttgggaggctgaggcaggagaatctcttgaacccgggaggcggagattgcagtgagccaagatcacaccactgcactctagcctagataacagagcaagactccatctcaaaaaaaaaaaaaatacaaaaatatgaaccactgaaaattaaaaagacatgcatgcattctaggtctttaattttttttcttaataattttttttctctctggatagcagcacctagtttaggaagcaagattttagctggtctaacgactggaggagtggcagtattcattgggcaacccacagaggtcgtgaaagtcagacttcaagcacagagccatctccacggaatcaaacctcgctacacggggacttataatgcgtacagaataatagcaacaaccgaaggcttgacgggtctttggaaaggtaactaacttcaaaatgggttttataaccaccaaagcacatacatacaactagcaacttattgtaaagtagagttaataaacattttctttttttttttccccagggactactcccaatctgatgagaagtgtcatcatcaattgtacagagctagtaacatatgatctaatgaaggaggcctttgtgaaaaacaacatattagcaggtaacttcccatttcatataacaaacaggtctgcacctttagaagttcatcttggagcttctgcagccaccttatactcaatctcttaactccaatagttttctctttttaaaaattaagtaattttgaaccatatataactttgtgagaagcaggaaaagaccaaaatattaagtttaagaagttttgccacaacaaaaatattttgcaacaaaaataacaggcaatttcatgtcagcattattctcatttaatactaatatatgggacttttgttagaatcttattctttatacagcagaattcaggaggtaagtccatcctgcatactatatccaaaagatctagttataaaaggagcttatcagtggtctcatccaaaaagtaataccataagataggttcttaaaaataatattctaacaacttctagagacattgaaatttcccttatttcaataaaaaagtattagatgctcatatattaggcattattacaggccttaaaggcacagaggaaactaacagtttactttcctaaagtgttaacaatctattaagccatttactctttaccttctttttctagtgcaatacctttcttattttattttatttatttataagacatcttcattgacctactgttatcaataggtttataaagatatgacagataactaaattgcaagcccccaaaagtctgatgttgacctgtttcatcgatccattttagatgacgtcccctgccacttggtgtcggctcttatcgctggattttgcgcaacagctatgtcctccccggtggatgtagtaaaaaccagatttattaattctccaccaggacagtacaaaagtgtgcccaactgtgcaatgaaagtgttcactaacgaaggaccaacggctttcttcaaggggtaagatatgatcttgtgtatctgtaatgtgttctggctgtctgtgtgctttgggacactctcatgtcaagcaaccgacatttagcttacaagccttagtatattcatatacttagtattgacttttccttgccacagatttctccaatccaccaattccactgtgccagaaagtaaaaagccatgatattcaaattttctcaactttgatcaaaggctcattcaagaccagtgccttttccactggtcccaatctactggaaatgcagacagtattttgccttctctgggcaagaaagttataaagtagagggaaatcataatagagagctatgagagaacaagatttgatttgatttaatttgatggactcaagttttaacattgtaaaactagagataagacatcaccaccaatctagaaaagtgatgcagaaaagtatttgatttgggtaattattacactcacctagaaacaagtgttgtgtaatagattacatatttccataatgcaatgttgtatcagaaactaccttcctaagaaaatatagtatgggctcggcgtggtggctcgcacctgtaatcccagcactttgggagatggaggcaggaggatcacttgagcccagactgggcaacaaagcgagaccctgtctcaacaaaaaatttaaaaattagctgagtgtggtggcacgcactgatggtcccctctacttgggaagctgaggcaagaggatctcctgagcccaggagttcaaggtttcagcgagctatgattgtgccactgcactccagcctgggagacagagcaagtccctgtctcaaaaaagaagaaggagaaggaggagaaaatacagtattaagtaatctgtcaatatattccacaaggattacactagtggtttaataataaaattatattacctttttaaattgtaaggccattcctcaagctttataaattaagcatgaatgcatcatacacattttataaaaagttccaactcatcataatctgtacttatgatacattaatacaaatgaagttcattataaaattaacttaaaatggatataccagttattaaaccattaaccatttaataattttatttttttcaaatttaaaaaccttttggggaagaaatactacaacatggatgaaccttgaaaacgttatgctaagtgaaataagccagacacaaaaggacaaatactgtatgattacacttaaatgaggtacctagagtagtcaaattcatagagacagaaagaatagaagttaccaggggctggaggtaggaaaaaatggagagctgtttaatgggtagagagtttctttttggggtgacaaaaaggttctagagatggatagtggtgatggttacacacaatgtgtgtgtacttaatgctactgaaatgtaattttatgattttttttttttgcagcaaaataccccacattgggaagtgaagagaaacatgttaagagacttgaaggaaaaaaattggggcagaggggtgttttttataggttaaacaataaaagccatttaaacagtaacaatttctctaaggacaagaatcgtcaagattgagacagcactgatttcttgactctactcaatacttctttggtttctcttcttccttcccccttctaatagtttcctacctcccattcagaaagcaaagcaaaacaagcaaaaattcccccttccctcaaaaaaggaaagagtttttgaaaaagttcatgtcagtgaagaaaagacatgttttgggagtgaaggatatttgtggatttgtatagatgtgatcatcagggctgtgttgttttgaagtaatataggacatctagaggaaaatttattttcagcagaggagggaaagatgaagagtaggtacttttaagcatcttcacttgaggagtggcaaaatgagaagcataacctgctataatcactttaagaatttcaggctgagtgtggtggtgcagtctctagtcccagttactccaggaggctcaggtgggaggatcacttaagcccaggagctcgaggttgcagtgagctatgattacactactgcattccagcctgggcggcagggtgaagcctcatctcaaaaattaaaaaaaaaaaaaatcaaacaaattaatcgaacgatgacatgcacttttctaggttggtaccttccttcttgcgacttggatcctggaacgtcattatgtttgtgtgctttgaacaactgaaacgagaactgtcaaagtcaaggcagactatggactgtgccacataatcagcttcaagaaaatgatgtaacataccagtgggaatcttgctgactggatcataaaaacaaacaaaacttattcacttattttaacctaaaaagataaaggaattttggcagagaattttggacttttttatataaaaaagaggaaaattaatgcctatttcatataactttttttttttctcagtgtcttaagaaggggaaagcaaaacattcagcatataccctggcaaatgtaatgcagataagctactgcatttgaccatttctggagtgcaattgtgtgaatgaatgtgaagaactttaacatgttttaattacaattccaactggtggaaaagaaactgagtgaaatgcagtttatatttataaatacttaaaaatgaagttattaaaaatattagtttttattaaccacagttgtcagttaatatattcaataaagtattgctaataccttttaaagtttgtcttttgagatctatacctgggtgtaagagtcaagttcactagaatacaagactgcccaatagcaaatgcaggtctttagaatcataggcatgaacctactctgaatgttattagtatagatttttaatgtttagagtccagatttgatgacatctctaacaacttctaatctaagacactatattcattttggcaggattgctactagagtcttggtatctgtgctagcatcacataattttagagctggagggtacttctgggaagacagaggaacagtttgagattcctactgagatgaaaacgaatcttcatggaatctttcagcaaagccaaattcaaattcatcattagcacctgtagtaaccttttcaatgcctacaaactgcatgcagaagagatagggaaacagtaaaacagatattaaaagaagtttttaagacaaagcccagcctgattttaagctaaatccaaggattggcagcttggatgagcaggaaggttacaggctgccagacatcattctagttctgttttaatcaactccatgttacatttactatcagggattctcacctcaccctcatgcatgtcttccccattcattacccgcaaaagtgtcttgtagcagatgtcttctgtgtcccatacataccattttgctctttagtgcttgctggcctgacttcctattgtcatgtcagcatctgccctttttagggtctctggccaccagagccagctttactcacctgtgcatggcattctagaagagcagcagggaaaataacacagccccagtgcagcccttaaccaccaataactggtagtagttggtgtacaaatatctcagttccctcaactgtcaggtggaataccgctgagggatcaaactctagtaacacacagtagtgttttgcttactatggttaactaaaaaatcacagggtcttcatgcatttggaaaggatactttatttcttacaaagggttacagcctacaaggtggtcattctgcaggctagaaagcgtaacctccagcaaagaccggaggcaggcacttctagggaaggaagagtaagacagaaatttaaattgaatgggttggccaagtatacatattcaacaggctacaggtggattcatgaatattcatgaaggcagtcctgatgcatgcatgttacaccttggggtggaggcttaacatttaaatgtattacagttaggccctatacatgaaaaggtgaagcagtaacacgaaggcacacaatgcaccatttctgtaaacaggccagagccagttcacagtggttggtctcttatcatgagaaagctactaaaatcctcttgtccagttaaaactgtagttatggctggtggaaaatgggctggagtcagtcaacacttggtgaagctgcagttgcttcagacactcaaggccagtgtttgtttagctgctcgagaaaaagaaaaatcttgtggcagttagaacatagtttattctttaagtgtaggagtgtgtgacttaa

SEQ ID NO: 16273 - DNA, 25175 bp, Human; identical to SEQ ID NO: 16247

SEQ ID NO: 16274 - DNA, 238815 bp, Human
actgtctgggcccctttacaaacggttacaaataaggaaaatccctttcaacaagatacattcccagggtacctgtttgtgctgagcttttattattggcttgacagcaggctggtggctgcttgcaggggatcttctgggggtctccagttacagcagccaggacccagtgtgcgacttcaggccttcctaaactgttacagggtgcaggcatcattgggcattatccatataaggatgccacaaatactatacctttcaaagccactaaattcactgtgccgcgcatatcctggggagaggcagctgtgtgtgggggagggcgaggggaccgggagggtgtaagtagagtcctccagatgaaccccagtcttaatctgggctgggcaagaggaccatcccttcaccgctcccatcctacatcctaggttccaacatttacaggcccctgggttggacaccgacttagagagagcaccctggattcaggcctgggtggcttgaattgagcctcagaagagccgcgtctggagtgggctctcgacacccagggcaagtgggggcggcagagccctctcctcggtcggcacagcagcctctgccgcggtcccggcctgcgacgcgcccagtcttagcctcccggcctccggcgtctgctgagtgtccggcgggagaggcgcagggagcgcgctaccgggaggcgcgggcagcggggactggttttctctcgggccagggcctccggggcaaccgtctccagcgcgcattcttggtgcaggtggaacagctttctgctccggtagggcttcacctatcgcgggagaggttaatctcggatctaaacctcgcagccgcagagcgggctaaaaccgctactccacctcttcccatttctcccctccccacctcaagacaaaaagtcccaggccgggcaggacctgatcacctctgcctcctcccactgcgctaatcctgcgagcgagaggccccgcaccgaggcggaggctggcaaaggggagtggaaagggaggatggatggggccggggggtggggtggtgatgagggcgacgaaggagggggtgtcattttctttttctttctttttttaaaaaaagtatttctctcgcgagaaaccgctgcgcggacgatacttgaagaggtggggaaaggagggggctgcgggagccgcggcagagactgtgggtgccacaagcggacaggagccacagctgggacagctgcgagcggagccgagcagtggctgtagcggccacgactgggagcagccgccgccgcctcctcgggagtcggagccgccgcttctccagtgggtgcagccggggtcccgacgggggtcgggcggccaccggggctggagctgcggccacggaggcttttgcgtttgcgccgcgccgagggcagggacagggactggggtgaggggctgtcccggaacgtccacagctggcgctggccctcccctgcctgacagcttcctggcccggggctcttggtgccgggctccgcgtcagatgttcggggggcggtggcatcgcccggagtcggcggggacggcgcggctggcttccagcctggcggagagggcaggctgaggagtggggcgttcagagcgcgcatcgcgcgcaattcgtgccgctaaaaaaaataaacccagagagctcgcccggggcttaggaccgctggggatatgggtactttgcgccgcgctcttctggcggggcccgggaggccgagggatcggccggggctgctgccgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaagggtaaaggaaccggttccctcctttggtgtgggtctcccaagtttcaagatccagaacaacgggcaggatgactctccctgtggaagactccttggcaagacctcctgggggcaccttagaggtgctagggttgtttagtccccaccccgttcgtggttaaactaccttgcccctactcccagagatttctgccccaaaggagaggacgtggttaaatggaatcttgggccattgttgaggcagattttgggaggcgagaagagttccttggggaagaaggggaggagttgcgagtgggataagaggagaagcccgttcctttccctgcaatatcaattctggttgtttctagaggaaagtactttccttggggtcatcttggtagatgctgtatttgaaagggggcaaggaaaggaagggattcccatgacagtcagaggagaaatcacacagtagttgactcttccgtaaattatgcttattaaaattacggattgggttttctgggcaatgcttcctttagatgtctacattggaagcagaacagggcaagtggttctgagaactggttttttgagttgtgtggggctctccgtttcactgcagcagtaaggctgctgtggccggccttaagggagtatttttaactagtggtgtttgtgttgtgtacatgcaactgaccatttcactggcttcccatgccgctgttacagatgtttcagccggaaaaattttaattagacttgactaagggttgtcattttcctgtattgaaggacagtgggaatacatttcctttaagagaaatttgtctgcagttgtttaagttaaagcctccatggaaacaacaggatggactgtcagtgaccccttttatcttcttggaggagcctgttaaataaattcagacagtatatatagggagattttgtattaaattcttaccattctcgctgatgctcttttcctgagtggttctgtagctttattatatagctctgggtcaccaagtgatggtatccacttggatatgtggctgttcatttcacttactctttttttgttatgaggtgttatagtcatgtatatgtagtaaaatttgtgtttgtatggcccagatatgagaagaaaaagtaaactcaccagaccagtttttgactcctagtctggagtaaggacaagatgattgtatgagccaagcacttaggctgtgataaaatagcacagaaaatagttatgattaattcggttccatcttggccttcgtggaaaataaacccagaattccgataatgttggaaggaagtttgcttatcatggtaaacctgaccttgatcagacagcagatgtttattgccctgtgtgcaaggcacatggcaagttcaataagtagactgaggctctgattttcatatgttctcaagaggacctcatttagtccagtatttttccttcaaaaatacatttctcctacataataatatcttaatatctattctgataggattgctcctgtatataaaggacgtggggatttaattctgtggctgaagatctgcagagaggtgtgaggcctggtcagacatttgtctcatttctctgggctgtcaccaactagtgtgttcccttgggaatgtgaaaaaagaaactaagctttactttgttgcttaacaggatgccacacttttactcacacttgtgctttttctctctggttttaaatttgtttgtgattatagagagatacctctctgtgctcctcacagtatttgatcattaacacagaccttatcctattgtaaactatttataaagccttcctaaaaacagggtattaatagaattgtaattatgtgtgttcctaattctcatgttaattataagattttataataagtgatatatatatatacacacacacacacacacacacatacacggggggtgaaaataataatttaaaaatatatacaattaaaagtatttccctgccacctttcagagaccattttcttgtgtatttttctataaatcttttaggcatatgtatacatgtacaaataaacacaaatatatatgtatacatacacatgtgtgtgtgtatcctttttaatacatggaatgtattgtacatgcaatattctgaactttacttactttttatgtatctttaatgcatccatctattaactcatatggatctacctcattcattttctttctttttttttgagacacagtcttgctctgttgcccaggctggagtgtagtggtgcaatcttggcttactgcctccaccttcccggctcaagcgattctcctgcctcagcctccagagtagctgggattacaggtgggtgccaccaagcccggctaattttttgtatttttagtagagatggggtttcgccatgttggccaggatggtctcaaactcttggcctcaagcgatccacccacctctgcctctccaaattacaggcttgagccactgcgccctaccccattttcttgttgtatagaacctcattatgtcactggaacagttccctagtgatggctctttagattacattgagtcttttgctattaccaactttcttctgcatacctgtgtttacatacacgtgtttatatgtggtataaattagtaaaaatagaattgctggatcaaagtctttcccatagattttaagcaaaccccaattcttatgttaaatttgaataacattttaaatttattccctctgcttattgccgttacagtctcatatgaataaatcctttaacggtgccctgctgtataaatcatcagaaaaagcagttatgtactacatttttccagttattgcttaaaatttctgtttttgtctgttaaaatattaccggcttcaaaactcacctctttgactacagtgaaacctgtttaccattctgattggagatgcacagtttatgaagtgaaagtgatttgtaacccccgagtctgcctgatgcccagttggtggcagcaactttcagcacctcactaatctttcctctagttaaaaggtaccttaaactcatcagtatctgctgtgcactggttccttctccccagcaaatactgccttcttgtttttctctgatgtggcaggtgactacaaaatccgccttggtattcttcaaatgcatatatattcctttcttgtcagctccctctcttcctagattagaaaactgcctcattttctgctcactggatgtgcagtcccagcttgtcttcctctcctccccccctgttgcaggtgttcttttttttttttattctctccccactgggcagcaaaagttgttccacagtggaaatttaggcatcctcaagtttcttcccagcttctgctgtgttttcttagagtaaattgccaatttctgtttttacaggaaatccttttttaaaaatggaatcagtgtggtccccatctactctgcaaaaattgcatttttctctattttcaaatgagatttgttcaagtttcaaaaccacgtgaaataataaatgtatagtagttttcttttccttgggcattgcttgatatgtgaaatgggtttatgaaaaataataaaatcataacgctatttgtttgactttcaattcatgggaatttttctcagctaaactctaaatggtgattaggcaaaaagtgtgggagacagtccaaaaaaaaaaaactcaactgtacttgaatagcaatagttatgcaccatttatttatgattgccttattgctttagctcccaagtaaggaaatattactgtttcctgtcaaagggggaaaagttcttcacagtgagatctcctttcccaaaccttggagaagatggattgagacttctgcccttgttgtgtggtttataggtacatgagaccagttgtatttgacacaatttgtccccttgtgtgtgattccttttggtctttgtttatttgtttatttttttccagaggtcttgttgccagaaaaatacacatggaacagttcatacccatggtagattatgtgatggcaaactccaagggattagttatgtagaagtctgttattaaaataaagaactgtaatagggaatacagaaaaagttctgtagactttataaagtccattttactttataaaggggactttaagacttcacctgaagtcagatgggctaataattaaatatggggaaagactcctgcaggggtatggtttacatttattgaaaagattaagctaaaatattgggacacaatttttttttaaaaaaggatatagtgttcttaaatagaagatttcagcaattccacacatgaaacaagaaggtagagacaaaatatttatttatgtgactcattttgtaacattgaagacatagaggttgtttataaaaatgtgtaagttggtaatacaaattaattaaaacatacatcagcctatggtgaaatgagatgagagctgatggaaatggagtacagacttcccttcaaccttatttggaattttaaagaatattaaaatgttcctttatcgtcttgtgtagcatatactttaaaaattatagtattatactgatgactctaatcaagcaaaatactaaaaaattattagagtattcatgtaccagtttgttggctttttcttccagtaagccaatcagcctaaccactttgggagttttagctttattttcaatgtgaaaataagattttacaaatgttttcttgaaagagaaatacattcttttaacaatttctttgtttttaaacatgaacccagcaaatgggcctgcttaagcaacttagaattttttcccatgagattctttgaagaaaccgacatcaataatatatcaggcctgagttatgtggcctaactcaggcacatgatagtttagcgtttcatgattgttcaagtcgattttctcattagatagttaaatcattgaagacaagaatcctattataagcattttaccactaactcatcattaagtggggtttcagaaagttcattaattcaggaagtcttgattgaatgctagcttgagtttagttctgtggaaggccagagacatataccccataaccctgggggtacttcaggaaccgtgagtgcacagaaggacagcgtccctggaaagggggtctggtattaagtctaaacaaatacataataacaattgcagccatggtaggtaacatttaggtaacatctatatgttactaagcactatatgttgctaagcactgttcttactgttttgcatatgataattcattgaatcctcatagccactctacaagctgggtgctttcataagcttcccttcgcagatgtgagagccgaggtatgcagaggttaagttctaaagacaaaacttaacgttaacttttctttctccattaattttagttatggttttggtttttcattccaccagacaaaaatgcaggcccaagacattggtaaaattccacttaaaattcctaatattctttcatgctagttcacaaatcctaagtatggttaatcacacagtattatttagtccaacaagaaactttctgcaaagacattaataaaacagaaagaatcataggatgttagagccagtgggactttggacagcgtattatattttaatattagaccttgacttgtgtgagggtggtaggtaaccattgcaggcagcctgctgggcgttgtgtgggcttctgagctggaggcattgctgtttatgttgttcagaaccctcttgctgtcatgtcccctgtgagaaatctctctgaatagggttgcaagaagtatttctctttccagtggaaattggtatgtgtcttaaatcacgaccagtcatatgagttatttaattatttctttttcattttttaaccttggttgcctgtaaactcagcccaattttttacattaaattgcagccataatggtaaaaaaaaaaaaaaaaagctctgatgtatcacttatgattgtactttgcaaatactaattcctttaaaacataaatcctttatgaggaaaattaagcttatttattcatttaacaaatgaagaaacaagggatgcagagtttcagtaattactccagggacataaactagtaagtggtagagttggaaaatctagcttcatagctggagctcttaatcttaatattttactgctttacagttataataaatcttgtagctggtaaatttttttctttcataccttttataccttcgtttcccaagaatcttctcccaccattgctatgtggaaagactcaacatttattgatggcagatgctgttacaagccaagggaagcatcattgtgggaatgggattgatcagaagtgactttacagtgaaagtctattagggctgggcatggtggctcattcctgtaatcccagtgctttgggaggctgaggcaggaggatcacttgagcccagagggttgaggctgcagtgagctatgatcatgccactgcactctagcctgggcgacagaacaagatcctgtcttaaaaaaaaaaaaaaaagtttatcagtggtcaacaaactgaagaccaagctcactttttttgaaaatagagttttattgaaacaaatccatgcctgtttatttacttattatgtatggctgctttctccctacagcagcagagtggagtagttgcaacagagacagtatggcccataaaactgaaacatttgctctttggtcctttacagaaaaagtttaacaacctctgatctacgtgataaaaagtgactgtctactaggagtgagaactccttgaaggcagagatcttgcttgttttatttatctctaggaacatctaggaactgggtatgcggcacatgttcaatagaatagtttttgatagttgaactctgagcaattttgatgagctgattaactgggtatggttaattatatagactagagcttggagtaagtatagctgagaaataaaggaaagatgagtgaaaaatacatcaagggaaagggatatgaagtgtctgaggtcttaggacattgactgcagttgggcagggttggcacggcatggttccaagtgacatggtttgtagtgcagtctatgaaacgagtgccctctggagctgtgcagtttgcaaccttgagcaatcttgtgagcccgtacataggtggcaatgttgttagggaaaggagagggactagtggaaatataaatgtcactgatgttgtgaaaggcaaggacggggagctagtaaaggattctaagataggaacatgatcagatctttgccactgggtagaggtgtgaagggtagatgattagagagaagagagactaaagacagggagatttggatttaggaggctaatataggagtcacagtgagagtccacgatggtctgagcaaattcagtgaaaggggtgaagaaagaagagactcaggtggttccagagttaatgcagacagtacttgactagttggttgtgaaagacaaaggcgaggaggacctagaatgctcccacctccatatatattcaaacttaccatacacgaagtcattgtagcaccataaagagaaaataaagggaaacgagatcaggcctaggccctctactaccatgaaacaaagtattttcatttgtgagtgtttgagttattttattgctacgtaacaaattgccccagacttcgtggcttaaaacaacaattttattctttctcatgattctgtggctcaggaatttagacaggacacagtggggaatcttgtctctgcgccccacaatgtcagttgggctggaacaggcagtatgacttcttcacatatgcatctggttctgtgaccaggcactggcgcctgcagccctgtttacttgggtgtggtttatctaaatggacccactgaggaggggaataaaggaagcaaagagccacttgtctggctctgctgggggccttccaagttttaaagctgtctctcatgcagtctcctgcctgaacctgcccccgggatggagccattgaatgtgttttttttcaaatggggagactgagccccagatgcagcgactaggccttgctcagagtgagtgtctgttggggctggatcttgaacaacagcctcctgaccctggtcacatgtgttaatcccacatattgaccgtaggctaactcgaagggctgggggctggctggctggggtcacatggactcatatgtcctcgacattgcctggcttccttgattctcctttatatagtctcaggttgtcccctttctatacgtggcctctctacatggtctttagagcagcatagccagactttttccatggcagttcaggatctctcaagagcacaaaagtgggaactaccagactttcttcaaacttagcctggaatcgcatgacctggaattccatccaagtcataggcctcatccagattgaagggcatggactattaagacctacctttggatgtgaggagcatcatgtgtctgctgggaggggagaaagtggagccatctttggagaccagctaccactgtgaggcaatagatctttgagaaggctaatcagatactttaagttttaattctaacttgatcaagttcagttggcttagttctctactgaggatgcctcattgtattttgctgctgtaacttcagaatgaaaaagctccataaatattgtgtttgcatgttctgttagattcatgttagggcattgatcttagtttgtccacagttctgcatttaaagaactcacaactgtcaggaataaaatgaaagttcctaatgaagcagtatgttttgttttattcaaatatgagaatttcaaaacatctaaccattttccatttgcttttaagaaaatcagcttttaagattatacatgaaataaatttaatgggcaatcactctaatttattaactttggtatgttttaactttcttctgtatggaattttattttcaatttctatttatagcctcaaatgtatgtatctgttggtgtaatccacctcaattttttaaattaggggttatactaataagtaaaaataggttgcagttgctaatagaattggtgttgtaatgagctgaactgtactatttttcttataaatggagtagccacattatcaatagaataaaattggattaggaatatagtcaagtttgcattgtgggtgtcttatactatatcaaatcctagatttaaatttcttgtgactaccactttttcaacttaagtgacttttttttggttgaagttatcactgactctatttattcagctccctcagagcggaagagagaaagcaaaaatccctatctccaccattcccagccggagatgtattccagacagcaagcaggctcagagtgggagaactgctccattaaacaagtggtttagttcaacattttgaaggattatgaattcctagaccatcagtcatacttacattcaaatataagtatccaaacacatctaagtccaaatatagtacaaccattttatgatgttggtgttgggagacaggatttatgtctgccctaaagacacattgtctgctgtcaagtttcatggttttgaactgaagtatggtaatatctttattaataaagacaatgtattccagaggcagggtttcattttgtgtgtgtgtgtgtgtgtgtgtgtgtgtgtgtgtgtgtgtgtgtggtttttttttttttttttggtttcttcttcttccttttccggttctgtttctccttctttgttgccatcttttccttttcttctttttcttcatcatcattgtttcatcttctttttgtaagtaatttcataagctgtgctgcaaataaaatagggaggataggaatatcaaatgagagttaaaaccttaagaaaagtaaacaaggtctaagtaaaatacaaaatttttacctgggaacattggggtgttcaaaaagcaaaacagggttaaggtttttgttaggggaaggaaggagaaagcctgagggaagcaggaggagagagctgggagaaggttctggagtgaaagtcttgccagccagtggacctaggctggacagagcagatgctgggttttgaaagagattgatgacaaccccttcactcccggcagcattgggaccaggcgacctgtggccttaatcagcctcttttaggggacagagagcttatggaggagagtcaggacataaaagaaagacacttggatgccagaaaagattcgtatgaaaacatttagaggaatgcagtggaaaagcaggttaatccattgtctggtatgcacctgtgtatatggtactatgtaaagtttgatgcatcctgcttcttgtaactaatggtttattgtgtatcatttcccctgttcattcagtgctaatttgtaagattgtgtaatcagaccctaataggtttgggcctttgatgaataacttttaaaggaccttcttatttttaaatgcttttatttttgccattgaaattatggcttatatcttcttccatagccagaccatccatctttagaaaaattcgtattataaattagttatagtaggacagattttagaaatgtataaatactgaaactgaggcccagagaaggtccaggaacaagtgctcaaggtgcttattttcctctccggttcgtaggtgtggaagctgagtcacgtggtagcgagagctgacctaagaggcgcgttgttgggtaatagattgggcctctttgtgttcataccctcaagaggtggactggtatctgcaagttctctgctatacttgaaataaccaaaccttatcaatcctgtgggcatgggtgttttctttctctcatttatttgatcttaggcagtgtgattactctctcagcggtcagccctgaaggggtgatactgtagcagagttttagatcctcagtactaccctgctctcagtgggaacctccacattagaaaggattgggtgggatgggactttttgagggaggtagttgtcaatgagggtatcagtcaggtggttggaaaaagagaaatagtcttctccgggaatcggaagcatgactcctccccgcaaccctccaccacacacatactcacacttctaattggcagtcaaagagtcaaatgacctgggatcaactaaggcagttctgggtctgtgattaagcttggtttcttgttgtgtaacttgctggctcagttatccaaactatacattaagagtttatgtaataaacatgctaaagaaagaaaaaaattcttaaattcttgtgttttcctccatatcatctcacctagtaatactgtaaaacatctgcctactccaagtgacaactatgttatgagcattagctgcgtttgaataggacccaatgcttcattttcagaatgaacaccctgtcttgggcttgttgatattattatctttttttccaatgattctaggcagaactgccatttggaatatctttctctccctttctgatggggttaatgtctgaggagatgtaggcaaatgcttttcagtgaaggacttgatgtgcagcctttaagtagacaaatagttttttaatctttcatggactgctggtgcttcacaccccagagttgaggccactgacctcaagtttgcaaattttatatcccattaccaccctgtgagctctgtgctccccagggtcacatagtcggtgttttagctggaatctgagaaagtgcctgaacatttcctgaagagttggctaggaatgtttggcagtttggtcataaaaacccagagctagtggctggggtatatgttataattacctcacactatttcctatttgagcctggctgtgggtagtggggtatactggtattgattgtgggaccatattttaaaggaccaaggagtcattttcaatgatcactaataacctttggccacactttcagggaggtttggaagtgtggaaatagacatgctttgggtcaaaccctggctccaccaccttctaggaggaaacctcagacgagtgatttgacctctctgggcctcagtttcttcacttgtaaatgcgattaaattactcatctttctgtgttgtcctaagatttaatgggatggtacatttcaagttcttagtactatgcctgacatgtttagctatgatgatgagaatgattataatgctgttacagataaggaaaatgaggcagagagtcatccaaagaggctgttttttatggctaaagcaaaaatctagataatcatacctatctggataccacagtctccactttctcatcatagaaatgattatattaagaaacaggaggcaaacctgaattttaaaatgttcaaaagtgtaattttaatggacttactatatctgtggagatctggttatacttaaaggcagtttggggataagtttttatttttaaattttctctttccctaaattgtgttgtcttcattgggaaacaaacttactaaatattattccttattaatatgcaccccctcaactcttccaaaaaagtttgcattttttaactggcagatctgtcaaataggccttgcctctttcctgattagcacattttttaaaaagatactttgtgaaaagaatttaaattttagtaaatggaaagactgggttgaaaaccattctctttggcagcagtgcagagataccctgggagttagaattgtttcatggcaaggtggtgcgctattcttgaaatgtgctttaattgcctctgttggagtaaggatttggttataattgggtagcccagatgaccacctacaattcttagccacactgcctttcaacacataatctcagaggtaaagagataagccctcttttccagattgctcatgtcagatctcgcggagaactccagcactgccccagtcacacgcccttcactgtcgccaaagaaataggacactccagctggtcaggactgagccatgtgttagtcctgcctgaaccatgtggaatgggcttaggaaacgaagagtttggttagcagagaaggggaagggatactggatgggcaaacacaacacatctgcactcacagggagaaagctcccttttccatagcgtcagtattccctccacccactctgttatcactgtcctctctaggtgctttgtgggcaggccttgcttgcgtgattggggacaggctgactcagattggcagcccctgagaagagccactttctagttgagcgttcccttcctttggcttcatgccatgcagcaacataatgctcatttactacaaagagattcttatttgttcttcttcttctgtgtcctctttctcttgagaaattgaaaatctttttatttttaaattttctcttaatgatttccattttgattttaatgagagttgactttcggagaggtcttaaactattgaacatccgtgagagtggaacaaaacatacattatcttaatttaggcatagctttcgtagagttcctatacgctgcaccctacatgccagctctggttaactgattggcagtaaactctaagaagttgcggttgcttcatattcattcacagcctataaaaataagagtagagtgttttaaataaggaacgatttgaacagataatagttacttttctatttgccattgaaaatgttcaaattacttaatgtctctcatccccgtggggtaaatcacaccatcaccaacagaaagtttgtaaaaaagtaagaatataaaatcaaacaaatgaataccaggtactttcttttcttttcttttctttttttttttttttttttgagatggagtctcactctgtcatccaggctggagtgcagtggcacaatctcggctcactgcaaataccgggtattttctgtgctctaccgacttcctgggaaaaaaataaacctcaaataaaataaacttttccttttaaagttttgaaaacctttcaggtattttacaaagataggcaaaccactttttctccttttgcttgtaagcagttctaacttaatccagacattattgaactttgacagaagacagcagggtctaatttgactgcagactgactcatctgctcatttgcatttgggaccttccttgaaaataggttgtttgacacacattctcacacattgaaaggtcagaagacataccaggattctttgctaaatgatttcctccctccatttcatatttcccatgtccataagaattcttccacttatgcacagaaaaacccaaatttaacctttttatggacctgatacacaaaaaccccttcccccaaaacacatcttttgttaactgatgggtttatgtttgtcataaagaaagataaaatgtctttatgaaaataaatcatgtcaaaaaggacctgtgatgcccaaggggatccatcccctggaccgacatgttaattgtttgcacaggtgtagtgaagtcatttgttcttggattcttcatctagtgaactgtaaccttatttagtagctggatacttagtaggaacactttggttagttcttgccactgatttaacatggtacacatgttgggattggactgttgtctcttaatgggggtcccctccctctcaggaatgttgagctgcgtaacagataaaggtggttcttcaagtgaacgaaaacagaaaacaaaagtgtggcatgatggcatgtaggagactgtggatatcaggatggactaggccaggtgctgctgcaaatttgtgttttttaaaaagaattttatttaacacagatgtggataatttcaaaactagcaagaaggatacaatgatgatccagcttcagcatttatcaattaatggtcaatcttgttttatctacttcttctctccctcattgcatttattttgaagtaaatccttgaaaaatcattttacttttaaatatttcaatgtgtgtcctaaaagataagggccctttaagaaacataaacacaataacattattctgtttaccattaacactaattttctaatattatcaaatattcagtgaatatttaaaatttcctaattgagtcataaattttatttgtttttttgcagtttattcaaatcaggatccaaaaaagtccatattttgcaattggttgatctgtcttaaatatttttgaatatgtagattgtccccctgtcagtttttccttgtaatttatgtattgaagaaattggttcctgtcctctacaccagtgcttcttaagatgccagtccacaaactcctgttactggtccatgatgagatgagaagccagggtgtaaatccaaaatatgtcactaagcacactatttagttcagctgatattttatttctagggagactttctcgatgaaggaagcagtgagatggtttagattctagcttaaactccttatctcaatatagactagtaacgtctagtttgtagaacagcactggccagtccttggaccacacatggctttcaccactggagagtttcttgcagtccagtgatgactgcattccagtggtatggtcctaccatgtttctcagtcccctgtatttgttgtgaattgctagttagagctagatgcttgattcaactcaattaacttttttttcaagaagactttataagtggtatgtgtccttccattaggagggacatcattactactagtctctctttttgtgttattagcattcattgataatcgttttctagatctattagggtggcagaatggggatattcaaattctgtcatttcctattgacttactaatgctgtaaagttttactcctagttttgaacttaggctcaatgcttcacagccagtaatgtttgcaatatgctgggtctgatttttcttatctgcgactttgttgtagaaaaattatttaatatctaacagtaaggataggctattatgagctatgaaattgtggaaaattcacacagaaggagcctggcatttgaaagggaagaaaataattctgcaaaggtccatttatcccatgatcttttgtgagtgtcaaggtggaagcactcaatgtgtttttattttaaagtaagggatttcaggcaagaaccttatgaaaagttggtaagattttggactatgagggtaataaagaagatatctgcagagattttaatattcagaagtgaatttttgtaccttcatttcggcattgctctctcaggaatgctcttttttttttttttcttcaagaaattggaacaagtacaaccttagtgattcaaatgaaagattctgaaaattactggtacacccagtcccctttggggaaaggaaggtagggacaagagctgccccaggagcacctccccgactgtttgtaggggatgatacgtgcgcatgtgcatgtgtgccaggcacatcacccgtgtgtttcatgtcagtgaaacatgtccgtcattctctaaggcctcatgtattcttacttgatagaaaactcctgggtgaaatgacaggcttttggaactgctttttcgtcagtgggtgctgctacagagatttggaagccctttaggtatgcgaggtggatgtatttctgtctgttttgacatcatcatcaccacttcagaagttgtcatgttgaaactttgtgctggcatttagcacctgctctgcttaattatagcttgaaacacaaatactgtgacatcttccctggagctggaagggtgctgagaggacagtgctggcatcactcacactgagagggaaatctttcgggttggatttcagggaagagctgtgctggccattggaatgaggacagtcaccactttctctgtgtaatggacaatatcccagcagcctctgaattaagtcacagagacgtgaaattggagggttttttttagaagatcatctggatcacccaggccttcgagcagctcattgtcttcctaagccgggtcagacagttgcctgcgtgtcctgatggttttgctttgagctacttttcaaaagacaagccacacccatgttgaagtgtgtgtactaacacattccaatgccagctctgagtaggttttgaattatccacatgttgaatctttcttgtgctctctacacatccactccctcaaacgttgagcatgttaagagctgactaatgtttttaccggagggtgcaggacagaatactcattctctgttgggaaatgcagaaactatttcagaaacagaagtgccaatctataggagtgaatgttcctaaaatgtgttctctttacattgttttcctttgctaatacacttccaaaacactgtcttatttatttattttgcaaacctagtaaaaaaatcagagcacaaaaaatgatgtacaaattagtttatacaaaaaagagaatacattctctttggagtatttatggaaacatctttctaatctctaatctaaaaatctttaacactaaccttggaatgttattaataaagtcttttggtttttaattagggatttatgacgtttccattgtgtagcctttgaaaaattacttcacttctcacattttcagtttcctcatctgagaatgagcacaccaatacattttcttgatagggtttgggggaagagtaaattttataaattaaagctctctaatagttgctaattattatttttattccactgaatgacttcatgtggactaaagtactgatttggttaaattcccttaaatttaaattagactatttttattaaaagttttccacatatctaaatgtttaaaaaataaatgcttacaactttgtttcaatttcaaaattaaaaaaaaaacttaagtttttgactgctaatattgtgaagtgttaatttcaatgaaataatctcagcaaactgcatgcttttacctaacttcctctgactttatagaaacttaaaatctgttagtgatttatttatttatttttgttcctgagcaacaatattgtccctgttttgatgggagggctagatagagaaatgttttaaagatccatggcctgttgactgctatgaaatatggtttgagctacaagatctctgaagcttttgtagctataaatgtttctaaatgatgcaactgaaacatggaagaatttcactctcgtactccatgtattccacttatgggtaattgttgttatgtgttagattttttccttttaattttctaaaatttaaaaaagtagatgaaatgatactgatttcttactagtaattatacttttcattttttttttttttttgagacagggtcttgctctgtcacccaggctggagtgcagtggcgtgattgcggctcactctagcctcaacctcctgggctcaagtgatcctcccactcagccttccaagtagctgggaagctacaggtgcatgccaccatcttggctaatttaaaaatttttttgaagatatagattctcgctatgttgcccaggctggatctttttttaaaagtttcttataaacatatccacctttttaaataaattaaatactcactactctgatagacttctcattaacttatgttgtcttagtggtaaatgaaactctaaactctcatttaccacttaagattcaagtattgtgttaggtgctgggattgtaaagataaatctgaacttgctatatttaaggaacttgcatacacacacaaaaaaaacgctggtaatttccagttttaggagaggtgaaattcttgaataattttggtatgagactaaagtcaccaaataggattcaaaacggacttgcttccttgcttcacgtgtaagccactcgtgctagaaatagctcactgaagtctatctgtgagccagtccaggatactgattttatgttatagttgctaatggggcgggatcttctggcctttaaaataaatcaggtgcatcgaggatgagaactctccaggttttaagtctctgattcatggacctgtggatgtcctgtattggccctgatggtctcatgcagggggtccagaagggtgtcaagcctgggctgggacggctctgactctggctgccctctcaggactgtgtggagttgcctgagtttaaggtgttcatttctcacagatcactgggcagcttactaagctgagacatggtgggtttgagtggccaagttttcctctggttgcctgccgtggaatgtgttttcccatagaaacaacattttaagttgtggtcaggttcccagaccagcccacaatagcctattcagctgataatgcagctgagagactgctatttgactggtctggagaccaaaccaccacctattaacattgtttctattggacaggccattccaagttctaaatactaatatagaaatgaaattttggagctctacctgtttgtcaattgggggctgacagcattcggaactcaagtatcaaatcaccctgcactctaggttcctgaaagacctcattctttctttctcctaagtctgaccccattggctgattttcctgtctcttcctggggctgccagtacattcagaagatattatctccctggacagagctcttggtttgagaatttctgggaagtggcaagaatcatggttttagtccccagttccttctgtgggtggtaaaggaattccacaagctccacccccggctccgcctctggccggcctctctctgtgcaggctcagaatcccctcaccacttgttttgtgttttcaatcatttctatgatttcgttcaccctttggaaaagtacagtgtggcttcaacttgaataaatggaatgaatatcccagtcaaagaaaagctcttgatagaccctgagctcactggtgaagtccaggggtttcagagtgctgggaagcagttctttacacaggcaacatgttctcatcgtgtcattggccatatcctctcagatgctccagaagcaaacatttgagataagctggattttctgtttggaagcaatgcttcctcatccttagatggtcaaatagttgaaacttcatgaagaaattcacctcttcccatgtatgggagcaacttttacccaaccaaccagacatgtgacgccagtaggccagatacagatgccctcccttggagaagtgatccagtacacactaggacagcaagttattcaaatcattgccttcagaactttgaggagtccattctggtggtgtaattttctaagcagacaagcagacttagtgttcttagtgctgcttaatccagagttccagaagcatgaagtgaagagtgctgacttgctgcacacatgatgtactttaaacatctgtgcctctggtcttcatggttcaattgtctagtttcctgtagagtgcatcccatggctttttgagcttcaaattctttttttttaaatatatacactccacctataaaagattccaataggatttaaattggctgtcagtctaaaaatgatgtcccagatccgaggaactgccttttcagctttctatttcctaattttcttaggctgtgcgtgtgtgtgtgtgtgtgtgtgtgtgtgtgttgtgtttgtgtctttgtgtgtgtgtatgtgagagagagaatgtgtgtgttggggaggagggtgcatgtgtacatgcccttgaagggggacgacatttttggaccataagttcttgggctattgcttttgatcaacacaaaatctccatgaaaagttgagggtacacagtgaatgaaactgttgatgcaacacctttgtgctgcttgtgctgtgagttactccactcagcagtgggaaaagccttcatccaagcagcacatccaaagagacctatcaaggtcactctgtgaattttgtcatgattgtctgtaggaattggccgcatgaggctggctccatctatggccttgatcagttgcagcaatctgccataataaaatgcatgccaacttgtgagctgaaaaccttcacttagttgcttgtgggattttttttcttcttttgccaaagaaataaatagaatcaaatgtttacatatgtgtgttatttgtctacattgattttgtattttctcaaaggaaaatattgatttctgagttataaacatgggtaacttcactgatcagaataagttaatgacaggcatgtcagtgaaataatcaaggcacaaaaccaccatacatttctgtttaactgcctatgtagcctttcaaagacgtgttaaatagtcttcttttaaatagataaatttataagaaataattctatcgcacagattttaatgtcggtggcatattccatctggcttacttttggcactgaggagatgatattaatctttgctaattgtacttcgtactcactattgcctttagtcaatattatcttgtgtgcttctaaatagactccaggatagtctaggcataatagacattgtttctgtgcctgaagaacaatttattactctgggagtaaagggggtggtgggttgggcttcagggatgagatctagacatataattgttttaaatatataactacagtatagcctatgtaggtttttgaagatatgtctggaattgtgtttgtagtgtgaaagatggatggattcatcagggaacactaagggagatggaactacatattgaaatggaaagatggaagagctgatataaaaatggaggaagtgtctggttttagtgtgtgtcagagatagcagtgcgtgcatgagtgagggctgagacggtgaagaagaggagctgagtaggagggtggaagttgaaggtataggtaaagataagagttgacaggtagattaggcctacctggtagatatctgaacctaataatgagatgtttaacattatagagagtgaaggtccatctttgggctgtaggggaatagaaataagcacggtgaatatgaaaagatacttacccatattgtcctaatggggtagagagaaactaggaagccaggaaaaaagaacatgatattggtccaacaatgaaatcaccaggatttggacaagggatttgctaatggagttggagaatttaaggggaatttcatcagtgggatgaaataaaactagtgactccccttagcaaccgggaaacatcaagtcatagctcagatagtcctcttctgagcttaccatgcatgctgtggctaaaggcctttgttctggcctccctgagttccccaggcagaccttgatgttagtgctttgtctgttgtgtagataatctttgtgtatgtgcctgtgttcctagactgtaagatcctcaagagcaaagactgtgtgtcttagtcactttttaaatatagctgttttatttataattgcattgggacaggattattattattttaccttaaaataaacttttcactttagaacggttttagagtcacagaaaaattgagagagttgccatatactctggacactttactctgttgttagcatctcatactagcgtggtatattttttgtaattaatgaaccaatttttttcttttttttttttttgagacggagtctcgctctgtcacccaggctgaagtgcagtggcacaatctcggctcactgcaagctccgcctcccaggttcacaccattctcctgcctcagcctcccgagtagctgggactacaggcgcccgccaccacgcccggctaattttttttttttttttgtatttttagtagagacggggtttcactgtgttaggcaggatggtctcgatctcctgaccttgtgatccgcctgcctcagcctccgaaagtactgggattacaggcgtgagccatcgtgcccaaccaatgaaccaatattgatatgtagttagtgattaaagtctattccttattcaaatgttctgagtttttacttaatgtcctttttatgttcagaatcccatctaggataccacactgcatttagtagtcatgttttcttagacttgacttagctgtcacagttctcagactttccttgttttaatgaccttgacagtttttagaagggctggtcagatattttgtagaatggcccttagtggaattatttgatgtttttgtcatgattacattgaaattatgggtttttgggaaaaagaccacagaggtaaagttccatttttatcacataatattaagggtttatagtatcaacatgattttccattgttgctgtaacccttcattgcctggctgagataggatttgtcaggattttccacttcctccccctccctttatactgtactctttggaagacagtcagtatgtgtagctcacatgtaaggagtggggagttatgcttcatctttttgaaggcagagcatctacaaaattatttgaaagtcggaagcacaagagatttgtcttttctctcccatttatttcttcaatcatttatttatcagtatggacttatggatatttattttttacttggtattgtaatccaatgctgcttttgttattttgttgctccaaaagggttctagctttggccatttacacttccttcatttggcttctgtgtcccttgccatgctcccctcagtgtggatgtttgtttagcacttccttatactttctgtcactgcaagatgctacagattcagcttgtctatttcctgcccagccctagaatcatctcccaggagccctgattccttttattgaataatagtattagcaaccaagatctaggcattaggtgtgctcttcttggtcagttttatttcttatctaacacagtgcctagcacataataggctctcattaaatattgctgaacagccagcagtaatggaatgttgagtaactgatggtacaaatgactcaataaaatattatgtatctatcaaaaatgatcattagatttatacaataacataagtgaaaaagtaacaaaaaatgaagattgtaataacactcatgcaaaacaagcagagactcgtgcaaaaaatgctaacatggggagctagatttgaattttggctccccagtttattaacatatgaatttagatggattaatctctatggcccagcttcctcacattaattataatgcaacagtaatgataaaagtaataacttatttcatagaagtattgtggggaggtaaatgagtgctgtgactgaaataggataagcactcaatagatatgattaatatagtgattattgtgaggctgatggaactatggtgttttgtctttgtttcccaaaccctcaatgatgtgtaacattacatacatcgtcatctcttcatctctcttcccagtcttctgtaaggaatatctggagctggatcattccagccatgatagtctcactctcccttcctaagaattcccatagtgcttcctatttgaaatgattgctcagcaatgtttttatgttgtctggggttcatcactaccctttgtacatacatgctcctccagtcccccgaccatggctctcaggaaaggggcagcttgagtccctctcatgagcccttcagcgcacaaccaaatgtatctcaataggttaatttaatttttaaaacatgttgatttggcattcatataggtcgaagcatgtagagtatccagacttcaataaatgttagttcttctcctgtttttttttttttaacttttattttaggttcaggggtacatgtgcaggtttgttatacaggtaaactcgtgtcatgattgtttgaggtacaaattatttcagtttgtttcttaatcatattttatttccatagtcacaaaaaaacaagaaacttaaaaaaaacctttgggttggtaaaaaaaaaaaattgttgaacagctttgtgcttgtgggcaaggtgaatagtcctgatgtatccggttgtggacctggcagtgaacttactggctacacaggaagaggagctattgatcttggataaattgagtttgagatggtaacaaaacatttaattctaaatgccctgaaaacaggaactgaagagagaagaaaagagacagagtggaagaaaggcagataggaaaggggagatgaggaagggagggagagaaggagggagagagaaacagatggaccatggcttgggaggaaaacgtaatagagtcaccaatctactggtgatggagaaggcaagaaggggataaagctcttgaaaaccagaataaatctattattcattctgttccttttcagattactttcatctaaaaaataaaaaaaaatcccaaactgcacaaagtaagttagagtggttggctggcttgcatcctcaaaggaggaagccagaattgcccgtgtcccaagcagtgtcaactcagacaatccagaaaagagtctttgggtctacagcagtggtctccaaccttttcggtatcagggactggtttcgtggaacataacttttccacggaccaagggtgctgggggatggggggatggtttcaggatgattcaagctcattacatttattgtgcactttatttctattattattacattgtaatatattatgagataattatacaactcaccgtaatgtagaatcagtgggagccttgagcttgttttcctgcgactagaggatcccatctggtggtgataggagacagtgacagatcatcagtcattagattctcataaggagtgggcaacctagatccctcccacacgcagttcacaatcaggtttgtgcttctatgagaatctaatgctgtccctgatctgacaggaggtggagttcaggtggtaatgagagtgatgggagcagctgtaaatacagaggaagcttcacttgcttgcctgccacttaccccctgctgtgtggcccagttcctaacaggacatggaccgttactggtctgtggcccaggggttggggaccccagtctagagagtcaagctgaagcttagggaggtcatggaagctgttctcattaccagggtttgaagttttgttacccaggttgcattgtgactggcagatggactgtaacagtcacatgaggtattcacatcactactgggagacttgacctctgacttcagtgaagagggccagaataaaggcactaaaataaagagggggaatatttgaaaggttcgttagaatagtatgggccccttcatcagacagtactcatgatgttttttctttttttatcttgataagaaaattgtcaaagagcaaataaaatcatgatgtgtagttcacaatacaggcagctcatttatgtattgtaattgtttcatgatctatcacattttttatagtggaagttattttaaccttggaacagtaggatgttaagatattaacatgggacacattacatgggaagttgggtgtcctttgttgtgtgagggcatgtaccttttgatcccctccagatttatacttaaggggctaaatcatagtttttttccttaaaggttaaaaaaaaaagcagttaatggagcagggtcagcctcattagcccttacctagtacttgttctccttgcccaagagtttaatcactaacaaatatgttgagaaactaacatatatgaaataagagcctcctgaccttgtttttattaccttaaccttttctgaaaaggagtttgcactttgcataggaaacagaaaggctatcttgctgtaagaggccaaattgcagaagtgggctttggctaaggaatgtggacacactgcagacatcttgcacagaggccaagtcttgcaatgatgtggtcagacgtggtagaggccagctgtttgctccgttgagagaggcttttgccagtccacaggctctctgagggctatgtttaactgaatccaagtatcaaacctgctgagactcactcatcccccagggtgtttggagttgggttcttacagagcacaatattgaaagtaactggtaagagaagttacagataaagacttagctattttaaaaaaatgtaacatacagtggtgaagtggaatataaatgtattttccctctttcccctataaactattggaatacaggtaaaaacagtttatgctggctgggcacggtggctcacacctttaatcccagcactttgggaggcagaggcgggcggatcacgaggtcaggagttcgagaccagcctggccaatatggtgaaaccccgtctctactaaaaatacaaaaattagctgggtgtagtggtgtgtgcctgtagccccagctactcaggaggctgaggcagaaaaatctatcgaacccgggaggcggaggttgaggtgagcccgagatcgcactgttgcactccagcctgggcgacagagcgagactccatctcaaaaaaaacaaaaaagcaaaaaaaaacccccaaaacagtttatgctgtgctttatccttggtctattgatggacattctgtgatttgtgttacttatgtcaccatgaatactactggatgaaatatcatcttgtcctctaagtacacttttgacttaacataaggttaggagagcgtactctagaatcaggaggcttcttgagttcaaatctccattagacacgtctaagctatgtgaccttggccaggttgtttgaccttcttaagccatagttttttttttagtgttaaacattataacaataaaaattacctcaaagagttgttattaggatgaaataaaataatatatctttagcacttagcaaaaagttatttcccctttgaattttaattttttaaaatttgttgaatgttattgctacttgcacagagctttaaatccgactttgtgtgtgtgtgttggagtgatgggggttgatggggatggctcatgaagtgaaaagagaaagaggtatggatgctatactttcattgacccgaaagagtaactttattaaagatttaccttccttgtacaagcattttgtattgaaaccttataactaaatcttttattatggaaataatccagcatgtctcatttagagtttacatattttggttctttccagcttcaataagacattcatttatttccagaattagagctgttttttttctgtgtataagtaaaacaaatgtcatgcagcttgtttgaacgagttctaatagtttgcagtttctcaagaccaaaagcagcagaggagaaatcttacatgtttcaaatactttgcgttgagccataccacatagcatttagaatgatttaagaatgaatggcaacacaattaaaacaatcattgtcatttgaaggtattggttgaaacagctgaaattaaataacatgttacttgttaatgataaagttttaaaactcatagaaagtcagaggatgcaaataaaataagtccaacccaaaattataaagaaccttaagaaatacagtgaaatgaaaatgtgatgcactaatgaaagggaatggtgaatgaataaaacaagaagtattctgtttcaaagataagacgttcatacttcgaaagtctagttattgctttaagtgaaagacgatggaaatagaagagcgtatattttaaaatgaacagttgtggatgaatattagataagaaagcaagagaactctctctctgcttccccgggttctcatctcttaaggtaactaggttgaaacatttctgttttttgttcttctcatgtaacaccatctaccatgtttgtacctctgtatctagatttaaacagtacccactggtttcttgctttgaaagatggggacttagctcactaaagtatctgtaccctctttctctcttcttcttcacaactttaaaatatagttttagtataacttttatgtattggttattttaaaacacagtgtaatatatataagactctgtttctaggatcagctgctttattgactgccacacctttcctcccaaattgtttcccgagttatgtcatctgtcccattacttttactcttgtgaaggtttacaacatttacattttcttttgtaactatagtaaattgtaaaatcttccatgttttggctgtagattgattctaaacattaaaaaaagaatgtttatattaccatgctttttcaaattccttggaaaatctttagaatattttgctttgtaggactgaaattgttattctggatcctttgtttctgagcttcttcatcttgtgtatgtgttatgacatacatatttttgtcagacactatgactgtgacatattatgtcagacaatgtatgattgtagtaaaaaaaaaaaataaaaccttgttatgtcaaccacagggcaccctgcaaaggctcaggagtgctctgacactattccaggatttggtagggattggactatctccagcggagctgttctaatgggctgttgctggagaaggtttgaggtggttgactttggcctggattgtcatttcaaattgagagaacttttataataaaagtttggaaggtttgtgcgttcccctctaccccagctgtctaccctcacttcctctctcattttcctttccgagaatttgaatttccccaggaacttctggacactctgaagtttcaggcattactttgtcatggagggacaaagggttgagagcctttgacttaaaattctccataacatctttcttcctttattccttgtgtttccactggctgagtaacctgggtcagaagatgattccatcaggatgataatgctgcattgcattttcatcatctttttcatatatgaagctttcatgtccattatttgacatatatacacacaagggagacatttcattgtgccattgtacacagaaatatactgagctcacacaggctctaacatcatgcacatatttcacctctatccaatcatttcctctctatccttagagaaggcctgggctgctgggtatggagttagggccctttccttggctcctccagctttcttcctaaatccctttctgacctcagcatctgtcagtgtgaagcatgtgtggtgccctgcagggtgttccagattttctggagcaacaaaaggggtaaaggacatagcaaagaccttatgttggttcccaaacctgcatgatgttgaagtagtgagttcagaggaaatgtgggaggactctgtactgtttcacgtggtctacatatacaaagagaacgtgggagtgcaccctaactgaaaatacattttagctatacagttgtttttaaaggtttatgcttttgggtttacagtgtttataccagtaagctttggaattgctcctagtttgtgaaattgattgcaaaacatttgaccttccttattagcccctgatcgctagcagctagcatcaatgcttaggccctcaggatacggcaaagtaaaactaatggttgcttctaggtctctgtgtattatagtctctgtcctagtttccagtgtagaagtcattggatccttacttagttgctccctgaaattgttaaatgtggatcatctggattctgaatggagtttctactccaagacatgtgatgaactgtctgtaaacaagaaacccagagtgacactgattttattttcttgtaactgctgttatcaagtgtgtttccaaactttttgtttttggagacagagtctcactctgtcgcccaggctggagtgcagtggtgcgatgtcagctcactgcagcctctgcctcccagattcaagcgattctcgtgcctcagccccccaagtagctgggactacaggtgcgtgccaccatgccaagctaatttttgtatttttggtagagatggggtttcaccatgttggccaggctggtcttgaattcattacctcaagtgacctgcccacctcggcttcccaaagtgctgggattacaggcgtgagccaccgcgcctggcctgtttccaaacttttgctaaagaaatatttacatgttttggcctttatttttttctgactcatgtcagagtttgcgttcctgtaattttagtgaaagggagaatatgtaaaattatagaggtgagatgggccgtaggaaaatatatatatatatatggcttcaaagtgtagaaatgtgaagtcttatgtgcattagattttattacaaactttcttaaccatattggtaagaaatttattgtttaagtttattgtctaatttaagacttgtatggcttcatgaattgtgacagaatgtgctacattttgtatctctggtttttatttccctgatgggccatatgcataggtgatattaagggatgtccctgttgatatcactatgttagtgtcccaagctaccaacccagcattgagtctcatgagtttgctttatctgtctgccaggattcatcttgcttttataactcaggaattttttttccttttatttggccatctcttcctcttcttcttttttttaaagtatggaattcttctgtttttgttttagacccaatgtctgtggatcacgttataatgcttactgttgccctggatggaaaaccttacctggcggaaatcagtgtattgtccgtaagtaaatagaaaacttgtcattctgcatgtccttcttttgttgtgttggttgcatggggagccttagaatgtggccttttgtaactgtactattaatctgttgatagtacagccttccagctttaagacttttctacctttccagtttgggaaatacatcaacttggtcaaaccctgtcaaagtttagtcacggggatactttgcttgaggttgtgtcatttacatatgttgtgcctggctacacagactatctaattactttgatgggagtttgaatgaaagggtattattgctgcttttcttattgtaatttctaactttgttggccactcacgggccttaccaaaccctgtacattgaatttgggtgattgagggaccaagagcagacctgactcttagacagaggggaaaggaaggagatagatcaccagacgaagatcagtggaaagactaagaaagatctcaaatgataacagaggttcctctattgatttctgctggcaaggcaaacttccagatttccccaatatcccacaaatgttgagtgacaaatcgcatgccagacaaggtgttctttaatggagacaccaaagtcaaatttagtcatgatgcctgcccttcatgagcttttacagttgttgtacctatgaaataatgtccagttttcagaaaactccagtagtataatggggaaatttagagctgaagggacattaagaatcacttagttcaccttctcacttggctgacagtggtcaatggagtattcaatagactatattggccaatatttgcttcatgacctgaaaaagtttaactgtttctcaattcttgattttgaccagaaagcatctcctttatttggcacattatggtctaagaccaaaattggatcactaaaagagaaatataatggtatttggatttttctcaatgaactttataatagaaccctttcttagccttctgtagagttctctgagaaatgatgtctccagatatttaaataaatgtttactggatctttgacagtttgtttcttagtcgtttccagtttccatcctaaactctttggatgtttgaatgcactttctatcaagtgtactcttttagccttgcatatcatgtttgcacttgcaagattgtgcaggagcttgaggaaaagatcatgcctgtcatgacgaaaagtagtgaccaagtgctagtctgccgataaatataaatcatatgccatttaaacttactgttgtgaccactagcagagcatttggtaccagcatgatattagtctctgggtggtatgcaaatgttagtatttctctaaaggatgaatggcttcctgactgtagaatcagtactctagcagtagattccagcattcttctctcagactgttgatggaattcagaacaggataaaaattaaacattaaacatttacaataggctggacgcggtggtttacgcctgtaatcccagcactttgagaggccgaggcaggcggatcacaaggtcaggagattgagactgtcctggctaacacagtgaaaccctgtctctactaaaaatacaaaaaattagctgggcatggtggcacatgcctgtagtcccagctactcgggaggctgaggcaggagaatggcatgaacctgggagacggagcttgcagtgagcagagattgcgccactgcactccagcctgggtgacagagcgagactccatctcaaaaaacaaagcaaaacaaaataaatttacaataaaattggctcccaagagtaataatgtaatttttatatcattaaatcttagagttaatataataatatatttcttgtgatcatataaatatgtttagatgcaggatttaatttgtttgtttggttttctcttcatagcctgtcctgggcttctgatggattgagtgctgtggactaagcaaagagaggttgagaaccaccgtgactggataaaggagttgtggattttaaagccagagtttatttagttcaatagacttgttttgaaaatgagtacacctgaggcttaaggtcatataagtcatgatagcaaagtttgtgagggacctgagaacccaggtttcctcatttgaggattggtcccctataacaaatcgtgttccaaatccatgtgctaacagacctctggtttattcacagccatttgccggcattcctgtggggatggattttgttcgaggccaaatatgtgcacttgcccatctggtcagatagctccttcctgtggctccagatccagtaagtctaacatgtcattatatataatattattttatgtggttataccccattttctcctaaatttgattttggctttcctctttcctgcaatacattttttcactagaacatctgccttctctgttctgcccaaaatacttggaaaggctttccttcatctggcctctcatttcccttctttactctttataggaaaattacctatggggcatagttactatgaatagtataaagcttatggccttttatgtaggtatcgccttattcatctttgtatctccagtgtaaacaccataaaaggtgctcaatgaaatggttgtttaatggacatttttggctcaagaaatctaggcatgcttccttgtggtactgaaatatgaatctgattaaaaacttatttaagactcaagacccctgctttacaagaagaaaatgtaagaagtcattatggaagtttctgggggtgatttataatgaagcataaacatatttttcctttcagaatgttgccactttctgtgatgccagatgaatatccacagttcattcttcagaaccttttcttgcttgttctgttgtttttcttttgggggtttgggcaagtgagtcataattggttgtttaaaaagctgaagttcttgtttgtataaacagcccctcaaaactttgaccgtccccatggcaaaaaacgtaggtcccttttccgtttctttttgtcctgtaagaaaatgcaccccccttattgtgtgtcctattttgacaaagttttaaagaaaaacattgtggaataagtgcattctcttttgtttactgcaagtagagacttcactgtgtcaaggctcattacctgttaagagtctgaacatttgagtgtgtctctcacaagccaattaacaggttagggcaaattgtcctgtgtagcactcctggtgccctcttgcctcccttggcttcatggatgaacacgggggactcttcctgagagctttgtatacttttctggccagagagcatgccaggtctgcatgcagggcaagctggaagtgctgggggttagtggacctggaagcagacttttaaccaacaacagatggagagtggttggataagtgcctcagcttccttgcctctcagtttggataaccatgaggttcactctgcactgtctcctgaagttccccagtgggaccgagccctcgctgttcacagtgataatagatttgataatgtactttattagcttccttctctttttgtctcactttcccactctcctatgagtgtttcctagaattactttcagaacaaactacttccatttaaattattgtctcagaatctgcttctggtggagcccacacagtaacagccaccttttactaaatacagccagttacaattgggatagaaattgccctatgggctgggactcttgcttattgcactgaatgtgtagcatagttttccttgatctcagcttggtgtcagacatgcatcttcccagtaatagcaggttcattctacgtagcaagggcccctgaactggaggaatagaacgaggcagagaagccagctggcagcacatctgggaacatgcgggacatctccgtctctataagggtgacttccaggctgccgctgaagcataagcatctcagggttggaaaagaagtgcagttataaagttgggaatagaccccatctctcagattggtccctgaaccaactaacaacattgcactcctctgggggaagaaatatagccagatggcaaaactgggtattaagttgggaaggtcttcaatgataatgtgaactgataatgacttctctatcgagtagaaatcatgagatgtggagacaggatgttaacaagaccagagggaaaagccatggtcctggtagaatccaagttaactgtggggtgtgacgagtatagtagtaaggtcctggggccagatttagtctagagactaaaatccaagactgtgggtggtgctttctgaggaagtctgagtcatatctatggtacctggacgttagacaaagtccccaagtagcttgtggatgagagtagtgtaaggaggaggttctggtttcatcaggatctttggggttacttgaaatctttaaaattgttggctttgattctctctgcactaatattgtctaaatggcttgcaaaattaaagatggcaaaatattttaaattaaggatagctggggatgatcagaattcatttctcatcttttggagtgatgttctagggaacagctgtgccattccacagaacatcctgatcactttgctaactttcctgctaatagaaggacaattctactcagtgaaatgtttgcattcactacatgtggttctactaaaaaggatcaatttagatcactgaacgaatttttcctctgaaaaattttatactttttatatgatagggatcaaggaggtctaggcaagtcgtgggacctcagagaggcttagttttcccacttgaatatgaacagaatggaagaagtgttgttctttcaggtggtttttgacttgagtgtcctgtgactctgagaatagaaaatgatctcttagtgacctgaatgagagattgcatttccagaaggttcaaagtaccagccagtgattctcttggacaacaggaagttgtggcttcccttggtgctggtggaactctcgacactcgtcattcagcaccagggcaaaaagaatgattggctagacagcgtcaaaacagtagtttttctagactttaattccagccctctttaggactgttctttgctatgtcagtctctgaggatacagatggattttgagcaatcctaattgtcataaagacctatcatggtttactgatgtatgaatttactcattgttctaatatgtgtatacacacattcaaatatatattagcttgtaacactgggattaataaactctataactttacatatatatttgtcagtttgggcttctataacaaaatactgtagactgggtcatttataaacaataaaaatgtatttttttacagttctagaggctgggaagtccaagatcaagaggccagcagattacatgtctggtgaaggccttctcctcctagatggtgctttctgtgtgtcctcacatggcagaagggacaaacaggcctcccaggcctttttttttttttataaggatactaatcctttcatgagggctctgcctgcataacttaatcacctccccaaaggccccactgctccatactctcccattagggactaagtttcaacatatgaattttgtggggacacaaacatttagacaataatatatatatatatatatatgtatatgtatgtgtatatatataattgtctaattatatatataattatatatgatacatgataaaagttgtttcctatagtttatattttgtaattttgtattttctattttgtaattcctacagtttatattttgtaattttgaaatcttctcattctgttttactctttacactttaagaatgctaaaaattaaacttcatattctgagataattgtagatttacaaacagttgccttagtctgttttctgctgctataacagtataccacagactggataacttataaacaacaaaagtttatttggctcgtggttctggaggctgggaagtccagagcatggcaccaatgtctatagagggccatcccatggtggaaggcatcacatggggagcaagtatgagagacagacagaaaatggggctgaactcccgagatgaccaacccactcctgagataatggcataaatccatttatgagggcaaagccctcatgaccttatcacgtcttaaaggttccacctcttaataccatcacaatgataattaaatttcaacatgagttttggaaggaacattccaaccatggcagttgtaagaaatcagaaatatcctgggtattctttatttagttttccccattgtgacatcttgcaagactatagtacaagagcagaaccaggatatcacaaaatcaatacagttaagatgcagaacatttccatcaccacaaagagcgctgatgttacccttttattgtcattttcttcccgacataattctctctttaattctgacaaccactaatctgttctacatttctataattttttcatttcacaaatgttatataaatggaatcacagaatatgtaaccttttggaagtggcttttttcactcatcagaattctctggagagtcatctaggttgttgcagtatgaacagcttgttatcttttattgctgagtagtagtacatgctatggatgtaccacaagtttgtttggccattcacctattgaagggcatctgagttgtcatcagtttttttttctttattatttgaactaagctgctatgaacatttgtgtacaagtttgtggtgtgaacacaaatcttatgttctctgggataaatacacagaaatgcaatttctaagttgtatgatagtttcatgtttagcattttaagaactgtcaaactgtttttggagtcgccgtatgtaccattttgcattctcaccagcagtgtatgaatgacccagtttctctgcatccttaccagcttttggtgttgtctttattttttattttagctattctgattgctgtgtagtcatctcttactgtggtttcaatttgcatttccctattggatagtgatgtcaaacatctttttatgtgcttattgccacctgtatatctttttcagtgaaaggtctctttatatcttttgtccagattcttatttttcattaaaataatttttttagacggggtcttactctgtcacccaggttggagtacagtggtgcgatctcagctcactgcaacctccgtctcccaggctcaagttatcctcccacctcagcctcttgagtagctgggactacaggggcacaccaccatgccccactaagttttttgtatttttggtagagacagggttttgccatgctgcccaggctggtcttgaactcctgagctcaagcaatctgcatgccttgggctcccaaagtgttgggattacaggcatgagccactgtgcctggcctcttttgcccagatgctaattgaattgtttgttatttcattgttgagttttgagaattctttgtatactctaaatactagctgtttatcagatatgttatttgcaggcattttatcacactctgtagcttgctttttaatatttttaatgggatctttcatagagcaaatgttttcaaatttgagtaagtctaacttatcagttttccctttactggatcatgctttcattgtcaagtctaggaatgctttgtctactcctagattctgaagattttctccaacttttttctgatggtttcatagttttatttttatttacttattctttgagacagggtcttgctctgccacccagatgggtaggcagattttccccactttatcctttttttgttttagctattctagttcttttctgtaaaaactgtagattaatcttgtctatatttacaaaaccttttaggattttgataggaattgcatcaaacctgtatatcaatttggggccctttacacttttcaaaccccttatagtttgatcacattttctcatttaatttacttcaattcaatgagagtgtcagcaggaccagtcgcagacaaaacctctcggacaccggttttaggaaggggctttaatcagctgggagcaagagtttggggcatttgtactcccaatgcaaatctgagctctaagggtgtaagaaggccagcagaacaattctagaccagtgtgttagcaagtttgagggagtatggtgcaaccatcctgaaagtgtggggacattcagaggaagggaaggtggtgctttagccagtctggaagaagtcctccttgaaaaagcttttcagggaagtgtgggatttatatggactgggaggagaagcatgcatggaatctactcagacttgtccttagaaatggttgaactctttgctttctactccaccctttgtggaagcacctttatcactactgtcatttaacttgtccttctctacagcttttccagcttggctagattttgtttgtttatttgtttgtttgagaattttagtgaagtttctcttccaagctgtgtgtctttaggcatccccagacatctgttcacttaagggaaatgccattgctgttatccctctaaatgaaaattgtttttatcctgcagtgactctgattgtccctgtggactcttgtctcaggtgtagagtccagaagttagtctagctgtttaatttgtctgtctgtgcttttcctagtacctaaattaaaatcacatgttcgtcatacaaatgcttatgtgcaaattgctcccagtgttcttcctgccagttgtgcctgccaagatgatggcaggtctttagaatcattccaaacctaatgcatcccaaagaaaatcattacctgaggtattgagatccaggtgccagccctgcctctctctcattcccatagcgtgctcacattgttcttttctgatgaatcatttaagaactaatctgtgctgggctgtaatctaaagaaaatttcttctgctctttctggccaatgctgccaaatgaaagacgttcagtaagtcactgttgaatgactgaaatgactgactgacatctgatatgaacacaaaattaatttgggatcttttatggatatggggagatggcaacattttctgttagctctgggttattgagccttacatgaaaccctttacggctgtctgctcgtcttcaagggcaggtcctcactgggaccctaggacactcagggttcactgcatatggctggatctgtgcactttgattcccctagtgttttcaatttctagtaaaatcttaacacagattgagtttaggaatatcttctgacttggggtacttagtgcatccagtaaagaatacagcatcattatgggtgtaggaggaacccctaggtttcagttggcttttttaagagacgtagaacttggtctcctaattatgatacatctagaattcttgttcaaatcagtataaatttagaatatgcatcaatggcaggactgaatccaaaataaaaccaatttcggtatatattctctgtaaactatttcctgcgtgtacagtgaaactacgtatctagttctttcacttccccacagaaatcctgagcgactgctcccacctttatcggaatgctttattccccactaaagatctaagactcacaacgaatacaaagtttcccatggttaacacggtggcaaagcaagtgattcagagcctattacctgtgctgagcctgcctcctcctggcttcccccaaggattcatgcatatggttccttgatgtcttcttgtttcacaagtctgaatgagtgcttttattttttaaagaaagaatattttatgctggaaaaggtttgcctgaaagacagggtaaaaaatatatatcagggagattttttattatattgcatttaattgtaaacttaccattcttgccagaaagaagaattcattctgattttcaacttgaacaaataatgtaaagtcactaaactactgttagcttttttatctcaaagtagttaaatggctttgttgctcatgtgggaatggaaattagctcttggcatgaactgctttaattgaaatcagtttgaaggctgagttcctatgctgcttgacagatgacatcatttcctgtgcttttcccaatcctcactgtttttctaagataggatgaagctaagtttaacttcaaatttaaagcaactatacaccttttcatgacctacttagaatattattcaaagttttcactaaatcattttttttctttgtatacgtatagacagatttttagttaaaaaagcatcttggctgagatgttttaacggaatcataagagcctaaaataactgcaatcagtttccggggttgcttgatttcattactccaacaaaggagttatttctgcattcatacatggggaaacaaagataaaaatatttttaatagcaacctacttagtagggctgtataagtgcctcggacacaatggacaacttctaagtctcagtttggtctttgggcatggcttttgatgtcatcatcaggcagcatgagttaagtaaataaaaattaatttagcacagttttatacagcacttacatataaagcaaggtgctactctaggcacttaagaggtattgcataattaatgctctcccactccccactctgaagaagtttttaaacaaatgagatggggcaaaataagtaaaaataggctggattatataatatatgcttcaaaagagaaatatgaagtaattggaaaggagagagggctcacatttggtttgggagatatcagaaaagattagcggaaggaagcaatatttgaaatgggttttggagatagataggatttcaggtttgggggagaactgtgtgtgtgttgtgttggggtttaggagttaggggcaaggagacaaagaggcaggtaagagagagggttctacagagggactaggacaaggaaagtgccgggtgttttgcatggcacatagtaggcactcagaaatgttcattgagtgaaagaatgactgataagtagatcaggggatggagtcataggacatagtgggcatgtgccaaggagcctcgaaagatacctggggccatgctgaggggaccgtgaatgtggagagatggaggtggctctagttcagtagaaacaggcctttgatggtgtttcagtgtgtggcatgttgttgaaaaggcatttaactttcaactcaacctaacttctttgtgctgtaaaaggaagggtatagaagatagtgggttctgcactttccttccctgttggcaggctgagatttgtgtagctccttataaaaattgtccctttctcctgaagtcaagtagccacttttcaataccgtggctgaggattcctaacaaggggtaatggacagggtggctgttgggaggaatcttctatttgctctgaagagaagatttggcccctgtgcttcaggaagagtgagcataaacagcagatttctgcttttgtgtagaaagaagatattctcttctccttagctaaaattatcgaaccttcttctctgagaatttacttccacagcttggaggaccagacagaataagccaaacctccaaagcccaatcctggcctccatgtgtaggcaggtatcaacaaggattagtggttaattcaatcaagctttggactaggaaatagcctaggattttgaaagtgctattagcattcctaaattactgacctagagatagcctgaacactggagaaatgagagcacttgcctgcgctgttgtcattgctcactatgagcccgtggctgtcttttactccagcttctctgagtgtctcattgtctggggtctaaggctgtcagcccatggtctttctaccctgggccccgaaatgaacacttctgtaggtgaaaatgaggatcttatttagtttgaggttacagtttaaacaagcagctctttctcaggcaaatccagctgtccctgtcgtcaggcagtgttgttattaaatgtctttgtaggtattttcttttttctctattctgcctctaaaatttcttttaacaaaattctttggaatttgctactcttaactgttcccctgtgccatctacctgggattctaaatcttttcacgggaaaattattgccatcataatcttgtctcatatggttactcaaggcaatactttcttgttggtataaattacagaaatgacattgagttgtaatttctgttaaattaaagaagtcatttagcactattaaagtgaatgccaaagaaacaattgcattgcatggtaaatgatttttttttctttctttcgctcgctctgtcactcaggctggagtacagtggtgcgatctccgctcactacaacctctgcccccccaggttcaagcgattctcttgcctcagcctccggagtggctgggattacaggcatgcgccattacgcctggctaatttttgtatttttagtagggacggggttccaccatgttggccaggctggtctcaaactcctgacctcaggtgatccgcctaccttggcctcccaaagtgttgggattacaggcatgagccactgcgcctagccggtaaatgattttacacacacaaataatatgtttagcattctcaattaggtcattatcaggtaaaaatagatgaatcctgataagctatttgattttctcttcaaataactacaaatcaactcctgtgagctgttgcaatctatgcatttaagttgcaaaagtgaattcttcttcttttttttcaagtacaacactgcaatattcgctgtatgaatggaggtagctgcagtgacgatcactgtctatgccagaaaggatacatagggactcactgtggacaacgtaagtacactgtagttataagtattctagatgttaacctgtttgtagacaagtagaataaagagataagtgctgatggattttcttcgattacctgggacacagcatgtttacaagtgtccagtgacctttacagatgaacaaatcacttactcaaaaaacttaacaccaaatttccaattggaaccttgattggttacaggttgtttgattcattttcctctcatttaccttcaccaccttgcttgcctgatctccttgatttctagtcaccaccaaaggagcagaattcttgttcattccagacacataccttccacccacttgctgaacttcaacacttggattttcaggaagcatctcaaataaaatatttcaaaactcagcctcatcattctctctaaacatgtcctttatcttgattggtggtatctgcatccctctcatttcctaatctagattctgctaccgaagtacttatcacatggtgttcagtttgaaggttcatttgcacacaccatttattgtatctactttctaccagtccctgtgctttgcagaagacgaacattctttttaaaaaccttgttttttttttttgttactttaagatgagcatatataccctacagaaaatttggaaaagtttaaaaatacaaaaagtaaaattattcgtgatttcatcattccagatagtatcttctagacttgtaatgcatatttggtacatgagttcttactgtatatatagtttttgtaccactttttcacttaatactttattcaaagtatgctcattacacattttaaaatacattttaatggttgcctagtactctattacctggatgtttgactgtttatttaatgaatcctcaatggtgggcgttattcagggcgtttctaatttttgcttttgtgtatatatttattaggattaataatgttattataaataaacaaaaatgtagagaatgccctagtgaccatctgtgttagtctgttttcatgctgctgataaagacatacccaagactggccaatttataaaagaaagaggtttattggacttacagttccacatggctggggaggcttcataatcatggtggaaggcagggagcaacaagtcacgtcttacatggatggcagcaggcagaaagagcttgtgcaggaaaactcccccttatgataaccatcagatcttgtgagacttactgttatgggaacagcatgggaaagagacctgcccccatgattcaattacttcccacctcccacaacatatgagaattcaagatgagatttgggtggtgacacagccaaactgtatcaccatccacacactgcagtgggagaagaatattggttgagttttgtgtagcccagcctggagagaggagaggcagcctccgcagtgtgggtgatccttgggctgagtcttgagggatgggtaggagcttacctgtcaggtgatggggaatggacctttttgggcagatggtagagcatgaccaaagcaccagcacaagacacagcaagggatgtgggacatagcaagtgctttggtgttgctagagcttaaatgcagaggagagtgaggggaaaggaagtaaggtcagataggatgtcatgggccaggttttgatgcctttatacatactatgttttcttccaaagtagggctaggaaagaagagtgagaccacaacaataaacaacactaacaacatcaataacctacatcttttcagttactctgtgcttactgtgtgctaggcacattttagaactctatgtgtgttaactcatttaatatgacaacaactctttgtattagaggacataaatgttaccctctggcagatgagggaactggaacacagggacctcagtagttcctctaagggtatatagatggtaatcggcagagttggggttggaacccaagcagtctgactccatagcccatgtgtttactcttgtgaaataccaaccttattacccttcacttacgaaggtttacagtgagaaagatcacagtgtggaagcgcaactggaggaggacaaaacaggagcaggaagacaagtcctaactaaggctatggctgtggagatggcgagatggggctggatcccaaggcattccaggagaatcaggaggggctgctgggcatctcttctgctccccttggtgctccctgagggagtttagcccaatgcccaacacacaagtgcttaattaacactggcagaattagaaaacttttcctaaacttcagcttcctcatctgtaatctgggagggttggcttaggcaagctcaaaatttcttttctgtttagaagctcttcattctccctgactataaatcaagaggcaaagaagacaattaatttacataaacctctctggttatatgatgagtaatggcctcctgccataatttttggttaaaaagggttgtgtcagttcaggtcctcttatgccaagaaaatatcaagacagaattagacataaaagagaatttattggggaaaagacccgtgaagaataaaggaaagaggaagcagaagtaggagggaatggtcttcagaccatgatgcctgtctgatcctgtgcaaggagggagggaaggaaggacaattgcatagaaggaacttcagcctgtagtgcagctccaaaaagccatagccaggttgatggagaacccagggcaaaaagtgcccatcaaagagttccatgatgggtggaaatagccaggctttagtatcctaatgctgtgtttagtcattggctgtgagcctgcccttgacatgaacattgcagcagatctgaaggtacagcagctggaagtggtctgccagctaaacttgcaggagattctcttgagggaaagtatgagtggctcaacttcatggctgctatagggtaatgtatggaaaaatgtatagaaaatatataaggagcaaggaatttgaatggaggttttgggggagcctcatggagcagtaagatttcagctgggctttgaagagtgggtggaactgacatatttggcagagaagagcctgccacgcatgacgaagatgcctagaaagagcccatgcatgcacgagttacaggaacttgtacaaagaggagttgttcagcacatgaactttcaattcttattttaatgtcatttctaacaagcaaaatatcctgccctgaagcatctctagatttactgcaccaatagtttccgtaagttctgttataactctcaattggattttcattatggtacttaaattactgaagatcattagtagtattttgttgtttgcagttaattgtgcaattgaacatgctacatttctgtaatggtgacatcagaggggctgatatttcccctcatgggagccctgttgcaattaaacgtaaatcataagcaaaagagtctttgctaacacacagttcccattcagtgacatctcttagaaaccactgttttcgaggttaaactgaaagcattgctcagatgcttcacggaatgagaccatcagcattaacatagatacaaactcatctattccaggcagctttacctaagagtggactgaggaatatctgagtatgtgtaactgtagagtgaccgtccaaaacaaacaccagggtgactttagacattttattgttgtccttccagaggaccacaagtgttacttcattagcatttattttcaggtaaagcgtctcagctctctccttattttacagctgtttgtgaaagtggctgtctcaatggaggaaggtgtgtggccccaaatcgatgtgcatgcacttacggatttactggaccccagtgtgaaagaggtaatggtttttaaaatcatttacgtaaagacatgctggtacctaaagctgttactaatttgcacagacattgggtctgcatggctacttcctgaatgttgctgagctttgaggggatttctcatttgtcattgggaaggtccctaggatgacaagacagcggccctgaatctatgcatgatattcggcaatgtttgtcagtccaagtttacctaaattcagttatttgctaatttggtggtactcagttatgagtgtatacataattaccagttggcatcaggataaaaaggggagaactttcttctgtaagggtaaggattaagctctttattatgccagtgaattaagtggtcttgaacaaaacatatgtatggaaagggagaatttcagtatgaaaagcacacctaaagatctgttggacctgttgggggctgtagaggtgtacaagctcagcattcaacactcaccatagatatattgagtgtctgctgagaagctactttgtgtagatggtttattcagtactcatcgcagcctgctagagtgtgtagaattatccttaattttgcatatgagaagatgaaggcacaaagaggtccagggatgtccccaaggccacatacataagaaacctttaatttgaatgtgtgttttgtctcttcaagtctaatgtttactgctgctcttaattaaaagaaacattctacctgatttgcctacctaaaaatacaagtatgatattgagatatgtgtggatatgcaatattcttaagtttttttccctgaactttggtcttactaataatcttgtctctacatttatagatttttttctcatcatccctagttttataatgaaagtttagaagttttatgttacacaaaactgtaattgaaaatttgcatgaacttttaaactgcagtaatcacttttagccaaagttgtatagacatcttattctaagatggaaagtaaagattcagtagcagatgttgaatatgtcatttaaaacatgtaatagaggaaaacaaagagcagagagtggtttgtgagaaattattttctgtctgtgtttataatttatctaaattcagttatttgctaataatgcagtaatacctatttgagcaagaaattccaggtcgattactttgattactaggtaaattacattgtatctctattaatgggaccactgcatggtattgatgtgtaatgcataatagacctttacattgcatgttgatatcctttaggagtccctccttaaactgcttctctttacaacttgcacagatgtgtttttattcgctaataattataatggtccagagtactaaaaactatttcttctaggcaatatcattctgtggccttattacttaatcagggaagttgtaggagattaaaattgttaatgtgtagcttgaggagtggtgtgtgaaaataatttctcagatgataatgctgggcataatttgttttagaaaaatcactaataagatgaagttacagggcattttacctgtaacattttacctgtaaccattttaacaaagtggttaaagatttgctgcaaagactattgatgctcatagttgatattgatgataacacagtctaaaataaagggcatgatattgaaccattccacagtgatttcttcaaagatttgatctttgtccaagattaagaaatgtcctgaatgggttaaattactaagctactaatcaaaactggcatgttactcagaggtttctccaagtttgggggtgtcttcaactgctccccttcaggaaaaagggctatcctgaaatctgcactaaggtgtaaatatctgttgactccatagaattttcccagtggtgattttcaaaatcaaattcatccccaagtggcagattttcaggcatttgtggtagtggagactggagagcagaaggcaggcttgcccgttagtagcagaagggtagtgccatctacccactgcctgttttacccacgggtacagtcccagaccttcaatgggagaagaaaaacatgggtgtcatttcccacaccacatgggagagaggagtctttttgattccagaattctatttccatttgtagagtcttcactgtttgctgctcttatgaaagtcacctgcttacctctttgaagaattagaggcagtagattctcttacttagatgtatgttcgtgatttcaagagtgatgaataaaaatctgataccgagtcaggacagatccatcctgaagtgtggggaagtattcagggtgacttccgatggtgggttggtatacttattgtggtgcttattactggataagtacctaggttggttgtattctgttttaactgggatgtgatgtttattttttaaagtgcagatccgggaggcctttactactttcctttctcccttcatctacattttcccttagtactctctccacatctctttttatagcatttactgcattgcatcaaaacagcaagtttccaatctccctcactagagcataagttttcaggagcaactatagtttcttcatcttcttaattctagccttactgtgtgatgcacagtacatgacccatagatgatgaactggattcatttaatagcatcaaaaaatctggagatataatgatcggatatgaacaagtatctcctggaaataattgctgtttgccaacagtcctggatattgatttcattggtttcatgctaaacagagctgattacaatgttgatatctaattgaatttggtcccatctttcagaagaatgatctttcaggtccacaagactgtcatttttcagttaacagggatgcaaaaaggaggaatgttttgatcaaaactaagtggcaataaaaacaaaagcaaaaacctcttatcatgatataatacacatgtaagggaacatttagaatgtcagttacaagtacttctcaggataaagatctatgtccctgggagaccttggaacttttatacattaataactacctcagagacccactatgagtgtgaaatacgcctttgggggtcatactggcaggatttgtatcacattaagccaataagtcaatcttaatcatccatgaacatagtattttggttttgtgatggagagaagcagcagatctcatgcttgaattatgaatcataatagtcatataacagtgtaataagattataaagcaattagtcttacttgcagctttttgtcattaagataagtttgtttaaaaacattcttggctggccagcctcatccccagtgggcaggtagcaatgatatattttaccattgccactaccattgtttctctacacccagaggataaaaaatagagacctgtggcttatttggcctgtgatgtctactttttaaaagctgaataggaatacctttaaatacatcttctagtttgtcatagtccccaccactacctactgtcacatcttgctcaagttcattcatttagcttaggtattagcccttgtgagcattcaagtttgccacctcctgctgctttctctgtcaaagattgtgtctttattttttttaaccacaagtttctttaatttttcttcctgtcacttttttttggtaagttcacatttgtggttttcttgttgcctcctactccgaccctttgccttctctttgcttgggccttgagcaactagtagaacttaatcacttcttagctcagtggtacagtatgttagcatttgttatcagattattgaagtgaggtcagtgcctgttttggcaatgacaatacaagctagtcgtatattgccatagttactgctaacaaaaaaactgtgtggaatccctttctcttgccatcttgcctcagaatgcacatttaaaatcttgttaaatgcctttgtattaaacacagtgaatcatatgagtggatgagacttttcagggtcatgtcaaaagagaaaagaatgatggagatagacctgaacttggagatgggggtggggtgtgatgatgaataggcttagggaagaagagaaacaaagagatacagcaagagaaccaggagagcattgaaccaaacaaacaaaaaggagttcaagaaataacttggcaattgttagactcatcgaaggtctgagaatgagaatcataaagcggccattggacgtaagaacagctgacatgtactgagtacttgcagtgtgccagggggtgtgctaagcacttcactttgatgatttgcaacaaccttatgagaaaagtcctgtaataagtcccatcttatggaggaataagcagaggcaaagagagatcaagtgccttgtccaagaagggacagcttataagtggtaaaatagaggcctgaacctagacattctggctcctaagcctgtgcacatagccactgtgtagtacttggacttcactggaaaggggccactcgtaactctaaagacctcactggaaaggggccactcataactctaaagacctcactggaaaggggccactcgtaactctaaagacctcactggaaaggggccactcataactctaaagacttttctgaggaacggtaagaagaaacctagaactatgaatcttagaatggaagtcaagatgaaaaggcaaaagaaaggattcttgcatattcttggatgtttcaaatgtagggttttggaatattcctctatttgattgatttcaacgtacgaatctgctcttggaaagagagagattcctgtgtgtttacaggacatataagtgtgctccaaaggactgaactaacatgcctggaagtagacatatggaatgaatattgtcatttagtgcagttatcatggaaagttatatcattttcttgtaatattacaacagctcaaaatgtgtttggaactcttttttggaggtgcctttacagaatcagcaatacattcaaatcagtgtgtgatttttttttttcccttttgaggaggcatttgagttttcagaaacagcctacagtaatttactgttaattctagtgactacagtgggtaatcacacattttagctgtttgggatcaaaagcagacttagatttaaaaaatactaaaaataattttctcatgtggttcataaagcacatggaattggtttaatgttttaatgtcaaactttatgtgagccagaggatgaagccttttggaagcataaatgcaaatagcaagaagttttctctcatttctccatctgaagctgctcatcatgtatcctcagaatattagcatgcacgtggactcttctaaatcctggtgcatttgttctgtgttaaattcctacccaagtctaaactgtgaagacaatacttggatttctgccaacttaagaaagtctgttggctgttatgctggctatcagtagataaagtataggggaaagcattgttgaactgatagccttaaggaaaaggaacaattggggccaaagtggagtagaataaaaatgagaggatggaaataatccttagttcattagagaagcagaacagttgaaagtgaactagctcttcatgcaggtacttgcttcctaggaaattacagtcttaatgaagctgaaaaggtttttgtatttgttagcacaacaatgaaacagaatagaacaaacaacagctaggttgattgtaattccacctccttcttatatgtgcagttgacgtttgagaaacttgtcctcacaccttgtttctctgatgatgtaaaaatgattttgcacagatatctttctaatgattttattgaatgactttcaaaaatactacattaagcagttgataaacacatattatataaatccaaaaaggcagcatctatactgtgtctagtgaatggaaaggactaacatgtaattatccaaatatataataatcagatagtccattttggaaacacctgcttcgaaaaagaaagtaaaaactttaccttatctcaagacctgtttagagagcttcatggaatcaggagctgattttcctgtgctttttttctcctggtgtttttcaggaaggtattaataaaatacagattcattattattttttctctatgtagaagtaagttttacagagctgcatttctgacacgaattttacataattttaaattgtaggtggctatcactaaagttcccaaggtaatgccacaggctaactcccattctccatgtgcctttggaaggcagagctctgtgaactatgtatattttcttctttccaaaagcaaaaggcagtaaactgtcattactaaactacactgaaggcctctatgaacctctcttttggtatttagtttcaatggaaagtaacaatgtggcagggcgtggtggctcacgcctgtaatcccagcactttgggaggccggggcaggcgaatcacgaggtcaggagatcgagaccatcctggctctactgtgaaaccctgtctctactacaaatagaaaaacaaaattagccgggcgtggtggtgggcacctatagtcccagttactcgggaggctgaagcgggagaatggcgtgaacccaggaggtggagcttgcagtgagccgagatcacgccactgcactccagcctgggcgacagagcgagacgccgtctcaaaaaaaaaaaaaaaaaaaaaagaaagtaacaatgtgtagatagcaggggcacaatgccctaaatgttactgtgcgtctacagtggtattgcaacatttgtggcagctggtggatcactgaataaactagattttcctagaatagttccaggaattgcatcttttgacacacacactcgtttttttgtggctgggtaactgtatacactgagggcacacatgctcctctgtctcgcaggctgcacatatgtggtatgaacaagcagtggggatgggatgcaaccagaaagaagcttgatttttgtctcccactcactgtccctctcggcccactttgtaggctacttcttctcctgctggtagatgaaatcatctggtctgttttggactttctcccctatagttcctttaatgggggcagaggcatctgtgttctgactgttgctgacattttcttcctcagtcgctgggcatccagtggtacttccagcctcttgagttctctttgctgctccaaggagccatctgggaaaggagctaggctcagtccacatcagctttctttttggcggcccctagcttgttggcagaaaacattcatgcattttttctgccacgataaattgctggagtgcaaactattgacacgttagcaaatgctcattggaaccattgtccaagcatctggccagacagtttccaggcatttgacagtccctagtccacagtgtcctccagacttctggggataggtatcatgcaatctgaggagtctccctgaagcctctctcatgacttggcatcataatgtggcccttcaccagtttcccaggaagggctagtaacagcccagctctctccagagtaacccgcttcccatcacttgctactttggacatttgaatactcttgatatgcataaaggtttaagaggtcatcatcacccactttgcaaattatgcatcaaaatatcacacttgacttagaatgtggcatctgttcccttggtggttcaattgaaattttgattctaacattctcttgtgttatcaaagctaatcatttagtacaactgttaaatttagtgtcatggtttcatcttcaaaaacagtttttttaacttcatttttttttagctcttatgaacttattaaaaagataaaactaatttttatatgtcgttagccccacatttaatatttgaaccacttttcgatcttagatgttcaaacagtagaacagtactgaacaatagaaatataatgtgagccacatatataattttaacttttcttgtagccacatgaaaaagtaaaaggaaacaggtgaaattaattttaataatatattttatttaacccaatatatctgaaagttttatgtcaatagatactcagtattaaaaattatctatgagatatattgtattctcttttccattctaagtcgttgaaatccaatgcatatattataccacatctcagtttggaccagctaatatccacatgtggctatcatcttggacagcacaactctagaacttccagtaatacatatccaaactttacccaaagtatctactagatttccagttttctttcttttccttccttctgctgcttctccagctcttcagaaagcagcatcttagaaaatcaaagagaggctgcattgatatttgaaaagtaaaccattaaaaaaaagaactggggcctcagagctgagcctaatttctcaggttctctgtcttagtagaagtttgatcaaatataagtgataaagctcaatctcatgttatatcatgtcaattagatataacaactacagcatatatttaataaagccttggcactaagctaggcatgatgatagaatcatgagaggagtgtatggctcttgtcatgagggccttaaaataatttttggaaagacagacatgcatactatattggaaacagttaagtaaccaagcagggccaggatttagctaggcagaggagataaaggaaagtactacaggtaaagggaagagttagtacagatttagaggcttgtattgacctggggaaaagggaggaccctgctgtgtcagctttcatggtactggagcccttctgtgggagaagaggcaaaggcacaacgtcaactcacataactccaaagaagggagggcctattgcaagcttctccacgatgcccttccattctattgaactgtgcttctgtacaatttctgtctgaagcaggatattgggattaaaaaatgcccctttgtatgtataaattagtgggaagactggtctatttctgaaactgttttcactttcttatagacggcattcaggaaatccttaccaattttatatgcccaactgagagtacttcagaacacttaatgtttatgttcccagtagttatggtctctagagagtctatgctgtttttggtttatgaacatatgttggacaaatacatggggcttcatggtcccgacgatgtgccaaagtactttttgtagaacatcagtcccatgagggattccatgaaattaagttgccatggatataatatcatttttggaaactccatcccatgtcttcttggggaggcatcgggtttgttagctcttgggagtcctgcaggaaggaaactgtttttacttagtttaactcacatctccaagcccatgaattttagaatttcttctttccaatttgttttcccttaacacctttaatgtcttcatcttggagatctggattcttattattttgacagtcattttgaaagtcacttgacatctgcatgacaacattttcatattctagatagatgttttgaatccatgtatgatcctcattttaaagataaatatttgcctaaatgtctagaggtttttggaggaagatcttcattatttaatcattcaccttttgggttcctaagaggattcatttgaccataaatttaaacacagcatgagacactcatcctttggggtttggttctcaaatactttaaagaatcatataggagagctggactatcccattaaataccgataacttcctagtttttaatggcttgatgtggtcagtgtgcatgccatcctggttctggttcttatcagccactgggggtactacttctagaactaggagtatgagatattcttagagctagagctcccttttctatactggttagatccttttctttcaaggtcaagtttaagtctcattctctccccagtcacttcctgactgtaggaggccagcccccaaacccccaccccaaccagccccatcagtttctatgcaactttgctgacatggccacctctggcctcccggaccccacccacatttcagttgctcagtgaatctattaaatttttggtttttgccattcactttaaggattacatcagacattttagcatttttattcctccaatgaattcttgtttttcttgcattttattacattttaaactgattaactgacccagtgcttgtctctggggatatgtactcatgatttttaaatatttactaagaggtaaagaatgagcatattcaccttgtcaaaaaactttttttccatgtgcatttattgatttttgtgttgaaatacttctatcagcataaaaccatctagaattctgtttcatggcttcaggaagccttatcagcaaattgcaatatttaagtttccttaaaaatattttctttactaagtgaaacataaatcatctattaattttaaaatatgaaataattatataggtattatttcagtattttctttaaaaagtcaatttggtttatgagtcccatcatctgggaattacacaattggctaatctgcttttgggactactaaaatagaggtttatgtatagtctttcagtcagactatggtactccccataggtcaaagactagaaattagatctgatacttcttcctatttcactaccaagcttagagctgtgaagagagtaggtatctattaaatatttgttgatttacataatttaactgtgggctcttgaagtcgatgagagggagtgtttaaatgttaaatacatctgtttaatccaacattctaagaaaagacattctggacaacaatatttataaatctatgtgtatgttatatggaaatattagtgtagttatttataactgaaatattgtaggaagtgaacgcatgaaaaaaaatgttctccaactttcctgccatattccctcggtgataatcttttgtctctgaactgtttgagaagagctttataagtaaacaatagattgggatatttgttttctcaggaaataaagaatgttctaatggttgagtttataagatagatccatttctatctctgtccttagagagcccttatcttgttgcctgccctctcctaggaggcattgttgacctttaccattgtaggcactgaaccacgctgaaagagaagccttacaggatggaggcaacttttatccaaattgaaaatgtttttataaacatacattagctcttcatgaaccatttgtttcctgaagtcccaatggaaatgatcatattctgttagggattccaatgatatattctttaaactaagactcgtgaacgttaaaaggcaaaagcgaagccagaagtaaattttgactcattctttatataatcatttgaaaacttcacttgaaaactggagaaaattttggaactttcttgttctactatggagaagataaaagcagaagcatccacagtatcttaatgatataaaactggctttggaaagaagtatgtaatagaattcagattgtccttggaggaaaacaaccctaaatcaccatcgaaaattctttatttatttattttttcagacggcataatttggagtgggattgggctatttcttttcagaccttatttaggcctcatttctttctacagtgttctccacattgccaagcagaataagctatcacaaaactaaacaaaaggcagtgcctagaaggcatcccatcccttgacggagccaactgggagtgtacccaggactttcctgttctcatggctcctggggttgttattctttactttttatgaatgagacaaaatgatagtgaaattattttcagaactaaatcatatctcaaaggagtcttcattccaacttgtcagtatcacatgacaatcattttaatgttttcatttaaaatatctaattaggaggagttgtgtttttctaattgcctagccattcctagaaaactgatcacgaactcacgctctgaggataaatcttgctacttgctggattggtggccttgagcaagttactgcatgtctctcaggcacagtttcctaatctatacaatgagggtaattatagtatttatctagtaagattgtcaggaagattaagtgagatcatccacaaagtacttagcacaggatctggcacataatacatgtataagaaatgttaactattttaaattcacatgaaaatgagggtaatcttggttgacaagtatcatttcattaacagtatcatgaaatgttcacatatccctgaaattacacctaaacttaaaggcctcattttgaccattttttccacttagaagttttgttattttacttgaacagcatattttttggatcccctattcagatgaaacccaacattcttgagctggatatagaaaggtcaacatcaagaaagaagcacatcaaccgtgtgcttttctttagtacacattcaactgttgcagttgtaatgaaggctaaaactacaatagtgcaaatagtaataaagaaagagaaaatgaaggggtaaggggaaaactatttccataaaatgtaatggtgactgtgtctgggaagcatttgttctcccaatagctaaccaaaaattcctgaaagatttgcttacttttactgacatacaggtacagaagggaaaatgaacttgtctattcagaaaaggccaataacgaaatataagaggtacttagctattttagaaatgcggcattctaaaatcaatgagaggtaatagacacttacccatcagtaaaataaactgaacatctctgtaaagtatacagtttccaggtggctgtaagaccttaagtctacaaatacggcctggtcaggttggatgggagtgggggatgcttttactcatggaaccatgtgccattcttcttttgttgcaaaggactaaaagtgttagtcccagaggactaaagttagaaaaatcaaaacatttggttattttaaacccacaaatttcaagctgcccttgttagtgttcagttttgttaagtctatccataaaaaggtgtgatgttatgctgaaaagaaattgttctaagacgaagagaggaggtgtgagtttatctatcatgcatgagtatttctcaggcactatgctaatgactggagatgtataataatgaatgaaacacacgcatcccgccttctggagtcacattcctgtggagagatggaagcagtgcttagaagggcatgtgtaggaaggctggccacacattgagaggtgtgcagtggtgctgtgactcccacgctgggaataggagctctgtacatttttctatagcacattagaagtttgatggctccggctgaccatgagactcttcccagaggagcctctggaataccaactttgttaagatgagagagctcttcttataggtttccaatgcccttcaaagtcagagggatcttgagtcttttgctgcttagattgcttttcctctaatccttgtgctcccacagggactctgatccctagctttcccccagaaacgttaatgaactggaactcaagtgtccaaaaaaatgcaagtacaccacaaaaatggtttgtttaggcgtcaaacattttgagataatgcatacttttgaatggatgcctgcagtcttgtccctggggaacgcctttggatgtcatgcaatcctggcttcagtaaatcatttgctgtttggacaagtcgtggccaccacgtcagtcactagatacatttgtaatggtttacgtgaacaataacaacaaccacctagcaacacactgtttggtcatgtcatttttttctaataccacatgtggttttgtgggctttagaagaataaattcttactgcatctaaaaggtcttgaaaattaaacagcaaatattgttggaggcctactgtgcacaataggtgaaatcacactgcatgttgtaagaatgaaacatgggtctttgctagtttattagtaattttatactccacacgggagagactatttctgttctgttcaacattttaggtctaatgcctgacacgcagtagcccagcaagtatttgttgactggaaaaatgaacaaatgagtagttttcaggcatagtttatttcttgaatttcctgtaattcaaaaaagaaatgactgatctaccatctgtactttttagccgatagttttttccctcgactttttaaaaccatgaacacaacagtgtcaggtagagccaagtgtattctgtgaagtgttaatacctcagagatgccacatttatgtcatcccttccatttatgcagcacttatgaacatataccaccttagtcagtccttggggcaacccttcatattttatagcaaagagtgagattgaaggggaacctctgtgactcggaattctaaggcaggtgtctaggaatgagacttatgtcttctcagtcagcccagactatggggcatctatattctccaacatgtatttgcttgcttttagagctcactgtggtcgctagcattaccttttgttattattaactatcttttaattttagctctatctttgttctttcctctcatttttcacacctttttgattttcagtcagactgctgacactttgctatttctgttctctgtgtctcttagacactatgtccatttttaaaatttcaaatttgagggaactaggcaatatttagaattaattttgtcaaggagagcttgtctttaattgtaagtggatattatgtggtgaaaacacttggcttagctgaaattgagctgtgcatagaatcagaagacaatctggtcctgaaggagtctgagaacacacaggcatggataatccggatgtgtgaatgaatgaactgctgctgtgtcacgctgcccgggacatccttctgttggaatttctgtgaaagtagaccaggcatattgcatattggagtgtgtattccaggaagagttgagaattggttttcttttatgacctctttgttttcttgctgcacgtatcaggagatttgcagtttctgtcatataaaaactactggaaatttagaattatctcctctgagagcatgagccccttgagaacagggagttttgactgtctaattacagtggctagaaaatgtctaacacagagtagatggtcaatacatatttgttgaattaaagaatggatctggcatatatacagctgatcactttttgcaataggacatgggttgatggtgtagtgcatgatttgttggtgcattgctgtgatgatgttctgagctcacccagcctcagttactcaatgacagcaagttcaagtcatgtcagagttggtgtttggctcttgtctgccccactatacaagtgcatgcagttttagtctctgttttggtgggtagtttcctacccctctggctcgctatacttgattatgaaattataattggctttcgtttatctctttaggatagaatagtaactgtagctaatctgtggctgaaaatagggagataagaatgaaaataattaaaatggatcactctgggtagcctgaagtgacatggattaatgtactatcagttttttccccctgagaaacatttggtcacaaggaagtttggctttcagaagaaattcagatttgggtgtgtggcttttggcatagtctagcatcactggaatggcctaaagtagatgtttctttttttcccatgccttcctgtgggtgctcagaacaacccggtcttttgactgtagggttatctgccattcgtagactgagcattatcttgccaagtcatatggagaagccagttaccgagtgcacttggagcagaagataatacttggctgaagcatcctagaaagcctaaaaagcttatgtcagagggatataacgtagagtttctaaggagaggtggagaaagagactgattgatcgattgcttgatctccaaagggcaggggctctaccacgtgtttcatagtgctaggaaatggcaaactttaaaaaggtgttcttcagttgccccaagaaatacaaatgtcacgcttgtctgactgtcagggatgaatggtcctagtgcatgcatgatgactgtatattcttctttgatagcgccatggtgtgggtaggtatgaggatctgttggcttagaagcaattggaaaaactggacaaggaaggaaaagaaaatgaaactaagaggctggattgagaaataccaagaagggtggaaatttcaagctttttttaacttcagtaactgtaagagagaaagaaagagaatgaaacagaaatgtctgactgtgtcccttcaatttcaaaacatattttgtagctctccactgactctggtttattcattatttatttaatagactcctttgttaacttcaggaagttaatactagtggcaattcttttagtcgtattgggttgctaaaaagctgtggaccctaccacataccacagtttagattaattgaatctaagtgtgcatgagtttgattaaatagggatttattattaagagcccttcttaggacatatgagcttggaagagcctgatttataacttagtagctttttcactttgtgaagggatgggacataaagtgttcttttccagagtgatgtggactgagataagatttatagattagtgaaagaagtccacgtctcagtcaaaagatttccagaaatgttctcctcattattcttcagagacctgagctattccagatgtccataggtttcagaaaggtagcttctggggagttgagactttctaaaagatgaaaatgtcaaccttcttccttccctgcttttttgagatggtagtagagctatatattcaactgtatgtagatgaaattgtaatataagaagaaaaataatggccattattaaaattcagcagtaggccaaacaggaattatataactgttttgcttcatagatagaattgttcctaaattcagctgatatggaatttttaagaatttattttttggggggtcaagaaatgttctgttgtaagcatgcaaggaaaaacttcttattctctgctctaattgctacatccagatatttgttatgacatacaagcaagattcagtgctcgtggtgaaatctctgtgcctcaaattgcatttgccctgcctgccctcctttcaaagctgtgcttaccactttggtataaggtcactgaaagtgtctgcgagctttaacaagttggagatgcatttctttttttttttttttccccttttttatttttatttttattattatactttaagttttagggtacatgtgcacattgtgcaggttagttacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatggtttccaatttcatccatgtccctacaaaggacatgaatgcatcattttttatggctgcatagtattccatggtgtatatgtgccacattttcttaattcagtctatcattgttggacatttgccattgtggaagtcaatgtggcgattcctcagggatctagaactagaagtaccatttgacccagccatcccattactgggtatatacccaaaagacttggagatgcatttctacagctgacatttttcacttaaaaataaattataggatgcgctttggagagcacacgcctaggagtggaacattaacaaaggatacgtcaaaccacagacacttctagtggatccagttcacagtattgccacacagcctgaaaaaataacattagtaccagcaaaactatcatccctaacattcagtcattatccctgtggacaggcttgggaacagccatgtggatgtagctgctttgtgcttcttcccatgcagatttgatttttctttccactttctcccttttaatgaatgaactaaaaatgaatttgaactacttgccaaccttagaaggtttgattttaaaatatattttcttctcaaatacacgaaccagtagcatcactttcaattccctactcccattctctgtccaaaaatacatatgccaatcttcaattttttttttgtagattgcatgtaaacgatggttggtttgtataaagataaatattactttagtaacaagcacatagtaacagcttaatttctttttgaattgttaggctgcacaaatcaatcatgtggtgccagctgaagactgcttttacaacaagacatatgttacaaatatattaatcttagcggcatatggcacctgagaccttgtaggaaggcgttgcaaaaaggacgatcatgccctattagctggctcacttcctaacttacattaattcgtgcattatggaacgtcaccaacacatgaaacaaaaagtagaaatggcactgctgagtaatcacaagccattgactaaagaaacttcagggaaggcggggcaatgagcattctttgaaccacttaattcaagaaataacaggctttgtttatttaagaggccagtctgtctgttttctgattgcattcttattgtgaaaatgccagagcatattacaatggataaaatgagaggaaaaaaagggcgatttaagtaggccaggaaagagtggtggtagatgtttgaatgcccccccttggaattaatcagtggtttataaacctgaaatactttttaattttgagaactgagtttctgactcaaattatacaagagaaaatgttacttggcttgagaaaggaaaaactttggttcatgtaaatatgtaccctcatgcctttatcatgggggaattgtaattagggattcagaatcttgagaacactattgtgacctagttatttctgtacagcaagtgctcacaggaggtactggctagacctgaaaataatgaattaagagattccagctgggatgtgatgaaagcatttttgggaatctctgtatcttggctggaccacatgggttataacttggagagacctaaacgagtagtagtatatgacagatttatagtccaattgatgttgggcatcagaaaaaaaggctgaggttaaaaaaaatgacctgagaattatgagttctaaaagaattgctattggaagggatgctaatgcaggaaagcatgaattccttatatgagggcaataaaaataataaaatttggtgctgaggcattgaatgggaaacacagtagcttatttttcacagagacccctcctccaagatcccttatctaccttctctgctgtacagttctccacaacacatcctccatctaacatatagtatattttctgtctgacctagttcttccatgacattattaaactccatgagggcagacattttgtttgccactgctcccaccatcccccacactttgttgtatccttagctacaagagtggtgtgtgacacttagtaggctcttgataaaaattgttgaatgaatgaatgaatgaacgagtgcatcaatggtgtcatttttaagccagaaattcattttagtccctctcttccctgcatctatctctccctccctcccaccttcccttcattcctccagcaggcactggatgtgctaaggcacaaagaccaataaaacaaggttcctgccctccagcttatggtctgttgggatcaacccatgggtaaatgaaggagtccagtacagagtgataatgctatattagacatgtgcacaaagggagatcagagtagagggggaaaaaaacatttaatcaggctgagaggtcaaggacaatttttttccagagaattaaggattggaaaattaaggatttgtagagcctaaaagaatatgtaagagttgatgaaaaatgaaatgacttgcaagaaaggatacgacctggaagaagaagacaacgttgtcagggaaacggcaggtagttcaccatgaagggagggagatgatgggagcagatggagtttggaggtaagttaaatggagagtcatttcaaaatcattggttttccaaggtgttttgttgtgttcattgagagtcaacaatactgagacttcataatacttcagacaagtaggtgagaccactccatgtgagttttggtcctcttgctcttctgtttcccagtttactatgtgccccttcccagcttgatatgtcaggctaagaagtaagtggactttctgtttctattcttttacttaggataatgctttccagttctaaccatgatgctgcaaaaaacatgattttattcttttttatggcagagtagtattccatggtgtgtgtgtgtgtgtgtgtgtgtgtgtgtatctcacattttctttatccagccctccattgatgaatccttatgttgattctatatctttgctttgggaatagtgctgtgataaaaatatgagtacaggcgtctttttaatataatgatttctcttcctttgggtagatattgttggattagttctttgagaaatgtccatactgttttccgcagaggttggacagagccaaatattacatgttttcacttataagtgtgagctaaacagtgggtacacttggacagagagagtggaatgatggacattggagactaccaaaggtgagaaggtaggaggagggtgaaagttgaaaaattacctattgggtacaatgctcacaattcagataatgggtacagtaaaagccagagtttgccattatgcaatatgtgcatgtaagaaacctgcgcttgtaccccctaaatacatacatacatacatacatacatacatacatacatacatatgtaaatacataaagaattgagcggagctctaaagctggtttaccatttccttgccagagcattatttggagtgtggagactttaacatttaatacgagttgcaagactctaaagtccatgctagagcaattgctctttcatcctcattttgttatctgtgattgtgggcaggggccatctctgaaagaatactcctgtctttcatggtatttacttgagtttatacttcgtgtcacacgtgaactatttcccgtctctaatctgcaaatgttcccttctggaacccgtttttatgtttaacctataggaatgcctaactgttgagtaaaatggtgcttttgtgttattttcatctaacataacctcagaattttagtagattttagtattaatatctttatatgtgatgcagtcatcatcaatatttgttcttttaaattaacattcaaaattaaatgaacaaaacaacagtgatattcataaaattggatgctattttgtgtcaggcttgagtttccaaatggaagcctcctgattgtcctgatctgatgtcacatggaagccactgcatactcttgatcttttctatgtttctaatcattttattaacatttcttggaatcttttctagcttattgcatttatattggctggttttatagtgataagaagattgagagctgtttaggatatagatgttatctgtacgtggtgcctgtacaaagtaggtgcttaatatgtttttttttttttgaatgggcaagtaagagttatatttttaaaacatgcattggatcattaaccacttcctactgcctttaggaaaaagtccagactcctttgccagagccaccaggccatttacaacctggaagcagcagaccttttcagccttatctcttgctgtcacaaacaacaatccacaatctacagtatatgtttgcagtgccatgcttcatccatgctgctccttccatttgacattcttactgatttgtcagatgagaaagcttccattagccattcacagaagaatcacttctctatttccaaaacattgtttgtacttccaggataatcacactggttcatttcactgtctatacttatctccccatctaggttgtacactcaagacagaggctctgtcttacttacatttgtatctttagggtctaatattgtaccactgaccattgcaaggactcaggaatgtgctctgaattaattaacaaggtaattaggccagtgccacagcctgagtatcacacagcttcatggtctctgctccacaccatgagaacaggacccgtgcggtcgggacaaggctaaagaggcctaaccctcagccagggctctgcaaggctgcaccaaggctgggtttaatctgggacccctcattcatccacagtcagtagaggagtgaccatcactggcttctaaaaatccatggcgtcctggcctgtctgcacagcctaccctcatcagagaagagttctttgatggtactgcccagggtctcttgatagcagaggttttcctgggggagcaggctcagtcaaagcctcagtctggttctgatggttcctttaattgtttgccaagaatctggttaaagggaacatgacagacttcaagggactgatgagaatccaagatctccttgctggccacaaatcattaattgagagctatgccttaggagggtaatatatattttctttcttatgaccatgattttacatgtgctgaagcttatttagtctttaactctccattcacttagccttgtaagacctgttttggaataatcttaattattattgttattttaaaatttagccattgtccttttttatttttataacactataagccatattgtttaatttacaatttattatattctgttgtgatatgagatcatagtgatggttagtacaacaatgtgatagctatcactttatgcaccattttaagattaatgggcatcatgatatgagttatagatatgaagttccaatgtataatttgagctgtgttgtgtattctgggccataatcatcacataactcagcatatgtatatataaatatatggaaaaacacaaacttgcaaaaacaatttgagacaatcccaaaagatagatctcaaagaaagatttctttcttagttgaaacgctttcttagcctcctgttttcggataatgctcaaactccttagtggaccagacaaagcctcccatgagctggtctttcccacctcgctggctcatccccagcaggtgcccttcatttatctgcagaaccatgcccacatcctcccattgttcccccttttcacacttaacagatgttcgcaactagtctacttgtctctgtttggagcccttcgcctcttgttttttaaaaaaatttaaatgcaaaacagtgcagtgactaataagacaaccatatttaaactgtctacctggtattaacaaatgtcaacatttcatgaattttaaatgaacgaaccagagcatctcagataaagcttatgtccctctttttctccctagttcctttgccattcctctctccagaggtgactgccatcatgaatttgtgctagagtttttaatcttgtcaatttactatgtgtatgatttcgtggccatttgtaactgtgtagattttacttgtacactttctctccaagatttttttaaaaatgccgttttagacaatccccagtactgatccttgggggctctttgcttcctattctttgaggggtctttgtttttttttttaacaaactaattaaattgttgcttatttcttaaaaatttttttactgtttctggtctggagcttcttcagtgattttgtgacagtcttggaaaatctaattttaattctcccctttattgaaaacttggttggccttttctttttctgacctcctcttgcccctacaaaggtagagattaataatacatgatttctttttacagaaagcacattacttatttattagcttggtagtttcagcattgagaatccttcatttataatgttcagaatttttctcaaagaccttttaacatttcgatcctttacttaagaaatcctgatatcaaagtaatccatattcataatagacaatgtgaaaagtattttttttaatttagaaaagtgcagagaaattggagaaaatactcataggtccctgagtgactgctattaatgtttaatatgctcatttaagaaagtttgggaagtagcgaagaaactacctaccatactaatataatcacagttaatatttgcctgactatatttccttctagtttctatttttctttacatagtaaatttctttgcaatcacaacataaattcagtttgtattatatgttttccacacatacacattttaaaatactatataaccctgtgttttcattttttaagcatttgggctctacccttagctttaatttttttctgttatttcgttatgtgtaacatctttgaacacagagtgttttttgtatttagaatggagtgaaattgttggaggatggctacaggcactttaaagcccttactacctattatgaatgtggtcacgtgtgcacctgcatgtctaagttttggtttcacctcattcttgccatcatagggattttttaaataataaaaaagaaagaaaaatccttgcttattcccaacaatagacatttactctttattgaaataggttcttaaatctttttttaatcttctttactttaaatatttttgcaggtatttaaatttgtattagtgtacatatatttttattttcattttacatgtggtccttttcctcgtgatttatctatggcttttaagattagaaagtctttgtgctttcaaagattcaataaatatttttattcatgttcttccagttttttgtggttcgatttttaaatatatttgatgctttaatctaatttggatttgttgtaggcctaagacagatctaccagggtgccattgttctgctatacctagtttaaaccagtgataaatgctatcagtggtggatggatgaattccaagattcatttcacattttgtacctgactctttgtaggagtgttatttaaatcaggctgatgggtgttgctaaaatgttggaccagccttggacttctcatacccatgctgacctgtggctcagtgggaatctagcatttgtccctgaacgtgcattgcccttggtttctgaatagcctccagctagtttatactagatctttggcctttctctggggcttgtgaactctgctttccagcaaacaatgtaccctcactattagtcaacagaccattttccttaggccctggaaggcctataacacaagctccttcatccacaggcagaatcccttccaatcacctttcctcttggatctgcccacccatcccctgcagcctggccagcagatgccagtttgcctgggctggtcagcacattcacaccagctctctctccttagctgactgaaaggctttcttttttagctccatgactgcagaataaataagagcaataacattgctcttttgttttaaataaatgagtatggggcaagtgattcaatcaataactgagcaagaattgacttttccagtttaaatgtagtgagcaccctatcacctagagtgttcaacagattcaggaaaacattttaagaaatgttagataggggagtcatgaatttcatgaggatgactgtctccataatcttctcaccctaaggttctgaagttacgtgagtatctcatttcacacctcccttttttttttttcaaagttttcccaacatttacagtagcagaggcacaaaacaaattttttgcatgtgtatttatgtatgtgtatacatccttttattgatctcttcatgaaaaggtaaggaatgtgatatagatttatgtaaagaatcttatttgctagaacgtgatgttaatgaggtcataaccgcaggtttgatccttagataagccaactgtgttaagtcctaggattagtttggaaaaaatggcttctaaaaaacaggaaaaatatgattggaaaacaggtttagtatctgccccaggtggttagatatataaagcttacttatccagtgagtgtaagaaaccaaaaccaaaacaaacagaaagagtattaagtccatacagttgagatagaagtagaatatctgaccacagacttgtaggttgtattagttgacaacgtgtgcatctttttaggtaaatataagaattggtttgtgaattgattttttttttcaaaaaagcatcatggaggtgtaatttacataccataaaattcacccatcttaagtgtataattcaattcaatttaattcaaattttagtaaatttagagttatgcaaccattaccacaatctagtttcagaacattttggtcatcccccaaaagatttcttacacctgttggcaaaaaatccttgctctctcccagagccctgggcaaccactaatacactttctgtctctatagatatgccttttctggacctttcaaataaatagaatcttataacacatattattttatatttggcttttttcacttggcataatgttgtagcatgtagtttattcctttttattgtggagtaatattccattgtaaggatatatcatattttgttcatacattcaccagctgatggacattttgattgtttccagtatggggctattatgaataatattgctattaacattcacatacaagtctttgtctgaccatatgtatttcttctcttgggtggatatttaggtgtagaattgctggattatatgccaagtttatatttaactttttaagaaactgcctaattattttccaaggtagctgtaccattttacattcccattaaacaatgagtgagggttctagtttctccatattctcacaactattttactgtctttctttttcattataaccattctagtggatgtgaaatgatgtcctgtggttttcatttttattttcctaatgattagtggtgttgaacatcttttcatgtgcctattcatgtatcttctttggtaacatgtttactctaatgtcttgccggcttttaaaattgggttatcttcttattgagttgtaagagttccttgtagtttttaatgcaagttctttatcagatattggaaatattttcttccagcctgtgacttgtctttttaattttcgtaatggcgccttttgaagtataaacatttttaattttgatgatgtctaaattatcagtctttttcttttatgaattgtgcttctgatattttatctaagaactctttgcctacccaagatcttaaaatttttctcatgttttcttctagaagttgcatagttttagctcttatatttaagtctgtgatccattttgaattaatttttgtatatggtgtgaggtgagggtcaactgttttgcatgtacatatccatatccaatgttactagtactatttgttgaaaagaccatcttttctcattgaatttccttgacacttttgctgaaaatcagttagccgtaaccagaagggtttatttctggcctttctattctgtttcattgatctaatctctgttcttactctagtaccatagtctcttgattactgttgctttgtagtaagttttgaagtcctccaactttattcttcttcttctaaattgttttggctactctgggtcctttgcatttccatataaattttaccttcaacttgtcagtttccacaaaacattgcattgagattttgataaagattacctttaatctacaggtcaatttgtgaagaaatgttaacagtattgatttttccattctgtgaacatggaatgcctctccacttatttaaagatttttcgacttatcttggcaatgttttgttcagtgcacaaattatgcacttttgtcattagatttattactataaatcttattccttttgatgtaattgtgaattgaattgctttgtaatttaattttctgattgttcattgttagtatataaaactatgactgctctttgtatactgatgttgtattctgtgacttttctggacttttttttttttttttggtagattccttaggattttcttatacaggattatattgtcttggaataaagatagtctttctttctttctttctttctttctttctttctttctttctttcttctttctttctttctttctttctttctttctttctttctttctttctttctttctttctttcttatctgtatactttaatttcttttctttgcatcattgcactggttagaaccccaagaacaatgttcaatagaagtaacaagaactgatatccttatcttgctcctgatattagaaagaaagcatttgttatttcgccattatgtatcatgttagctgtaggtttttcgtaggtacccttcaacaggttgaggtagtttctttctgtttatgttttgttgagagttttatcatgaatagacattggatttcgtcaaatgcttggtctatatctattgagatgatcatgtggtttttgtctgttattctattaatatggtgtattacattaattgattttcagatgttaaactgaccttgcattcctaggacaaattccatttggtcatggtgaatacttctttttatatattgttggatttggtgtgatagttctgtgttgagggtttttctgtctctgttcatcgggaatattggtctgtagttttcttttcatgtcttcgtctggctttggtatcagggtaatcctggctcacagaaaagttgagaagtgagccaatttattttttttaaactggtctcagttagggggaaggaaggatggtacacaacagtgtttctctatctatgatgaaatttcatttaaaaatcatttcttatcttgtgaattgatactttaaaaatataataaaactgaattactagaaaagtcatacaaaaatatacaaataaaagccccactgatgaattatattcagcctatattaaattactccatgaaattgataaaaacgttcctaaaggtttactcttaatttctgtgtttacctcatcacagactggacacaaaacagttctcacaaatctgtgaaccagcttttagtctggtgtaaagcactggtgtaaacccatgcttctcaaactttaatgttcatagaaatcacctggggatcctgttcaagagcagattccgatttggcaggttgggggcagggcctgagtctctgcatttccatcaaactcccgggtgatggtgatgcggctgctgctgggccacaggtcacactttgagtgccaaggctatgaaaaacaatgcagacagcaacgtaaatgtgatttttaaataaccctgtcataaattgctttgggacatattttggattttccaagattgttggattgttactcagctgtcaggattctctagatatcagttgtttttcttggcctgtgacctttctgggtctccagctgttcctctataaatccaaggggttgaactagaagatctctgaagtcctttccagatctcacagtctatgattttaagcatccatgtcaaaggagaattatggtttcatttgcattttctttttgtataaacctaataaaacatgaacccaaagttttatgctacaacagttcttaacataatgttaaaaagtaacagtaaacatgctttactaaattttggatgattcaggaagattagtgtcaacattcaaaggtttttccatgttgaagtcttgaagagaaagggtgggggtcttgtttaactttatagttggaaatccaattaaaaaaataactggcttgcttaaagtgtggagacacaagtaaaataggtgtttatattatgaaattcaagttgacacaaaatagctgaaaggcttcaatttcagccaagttgaaatgatgtcattgtcctttatatttcattttatttactgagatacttgaaactttttcccctgttgcttaaaagcaaatgaaaagggtggtaaatctgtggtggaaatgtgttgtcaaaacctccaggggctgtatcctcagccttcagcacatattagtgtgattctgctattcttactacagatgattacagcaaactctgcaatgaagggtggaggcatttggtcagcctccaaagaaagtgactaatatttgacctaatgtacagagtacatgaataacatattcttagggtaagaaaaaaattctggtttacagggtgtgtaagagttcatatttctttttcaattcttccaaaagatttaaaatactcagctgctctattaaatttttaattcctcaggctcaaatgcaaatcatgcattagatgccattattcaattcaatttaagaacagactcttgccccaggaatttattaaaatagtttagaatcttgaagataaagagtatcagttttgtgagtttgtagtaccctcattcttcaaaacagctttttcgttttatacactgttgagtaatggtttccctgggtacagacatttgaagtctacaaaatatataggagtttttatttgctgagattagtggaaagttagcattttctttttctttttttttttttatcacattgaacatcatttaaataatatacttactgtatttctgttatttttggcacaatattttacttggtgggtttccttttattcatttagtaataatggggtcagcttggcaggccttttgtttttaattaactaacacatgattgtgttatgtgttaagatatgttcattaatgttaggaaaaacacagatgaaaatgtttacagtggttcactctgggtggtgggattatagttgaatttcattttctgatttctaattttttgtgtcttttgaatgttctacaaaggccacataatttttttgaattagaaaagaccacaagtataaaattaataaaagcttagaatttctagctttatttctctctggagaaagggaacttttcatgtatctatttaatatgtatgatgcacttactatacaccatgcactttgctgggtctggggaggaataggggaggtgagagacagctgtttcccttaagctcagttctagatctttatctgaccaaggtatggtgggtggggagcaataaatgatatcccccaatgaattattaccatcgtaaagtggtaatcattttatgcttctcgcctggaatttaaagaggatgaattgagattctatatgtaaggcacttggtctaatacttggtacataggaaagtaatcatgattactgtgctttgcacattcatggtgatgaactcattacctctggagttaggccggtctgtttagatagcctgggggaaaggtgagaccagatacccaggtgacattcatctctgagatacctcccccatttctgcagttattcttccacgtggcatccttttaaataccaaccactaaaagtttggtttattaacttaattccttccaagccaagtttctgttgggacctttctctgagaatgcagttctagttttatcatgaaggatagtgagaaactaggatttattatgtagttgtgcaactataaatatttatttcatcgatatgtgagggccacctgggatttttgctttttaattaattaaattaattttatattaatagacaataagcatttgagaaggcaaagatatacctagacaaaaaaaaaagtcctgaatcactgaaagcagtttagacagagacattgagtccagaaacttcaacttaattctccccaaagtgtcttttctgtgaccccacaacaaagcacacacaaaaccgcattggctttgtatcacagaaatgctttcctgtcccagcagttgattctaataagtttgttttattgatctggttgcaaggggtgctgtccaacaaataatcctatacaataaaaagccttctcaagtgactgttgaatagtcagggtggtgttggtgtctgtgtgatgatgaaggtgatgggtgagcaaagttcagctaatcacagggttattgttctatggtgaggcagccacagcgtcactcttgagctttctgcatgcctgcctcccataccaaacattacagccttcccctaaaacttccagaccacccactggaacaatatagtatataaaaggatccagatgcttggaaagagaaagggtgaagtgcagagcatgcgtgatacctgctcgttggcccttctagattttgagcactgtttttacatagctggctcactaaagagatcaaacttcatctccaagtctcattttcagagcattttttgaaatatatcaagattaaaatgtatcacaaaaaatctgcatttttaaaattgttctggattcaggggtgactgtgcctctacggctctgcacctttcttcagtattccccagaaaacagggggaaacaaatcgttgtaggatgtgcacacacgtggagctctaaagctagacaggatgtggggaatagaggagagagtagagagtgtcaaataacagagtgatacccacgaggaaagagtaccaaatacatggggagcgcccgtttgcagaatggcacaggagagttggctaaatacacataacttacacttgaaggcttaattgcttggaaatttttaaaatattttgttttataaatgtatatatttggaacttaggctacttggtagctttgcagtggttcacctggtgaaatatggcttctcaatctgtttgttcaaaacagatttaatagatagggtttttttccctcctccctgcctgctccctgcaggacagctgatttacaagaggcaatctccttcatatgatactcattaattaatttatttacctaaccccttcattttctctcaccttcctctccagtgttgcttccttagtttctctttatcacattaccattaaaaatatttacctaaaagtctctttctctctctcaagttagcttcagaaaaggagagctggccgcctgttttcacccatatcttcagtgcctagaatagtgtctggcagacagtaggtactcaatgaatattgatgataaaacttagttcatgaagaagttctagacaggactatgagtaaaacatcttggttcatttgattgttcatctgttcattcattcactgtctctcatgtatctattgaagacatagtctgtgctaaggactgtagtactaggtactgggcatataatcctcctctaaaggactttacaaatagataaaaacatcttcttttggtacaatctcttcatttaaataaaagactaatgaaaattagatttagaatgtttcattacaaattttagagtcctccaaactattgattaaaacaatacataaatgtttcccttccagtttaaattaaatcagaaagcttgtgtgggctgttctccttgcctggtttagactggaagaccccagctgtagggaagatgctttcctcaaaccatgggcaggcagagctttcctgccagcgagcaagttggcatgctggtgtttgagtggcagtccattagttggcatcaccacctagtgcaatctctaaaaaatagcaatctttgtccttgaaaatgaaaatactttggttttaaaaatatgtttctgtttttaatgaatccaagacttgagttaatttaaaggcactcacatttccctttgctgatggcgacacctaaaacgttcatgcccatgcacaaaagggtattccatttggagttctcttacattgactcaattccctatttgtaatacacaacatggccaccattgggcaacaaaataactttattaaagcaaagaaaaactgtgggttactgtgttacatgctctttcagaattgtaaagtttccctgaagtagatatatcacagtaatccatggcctctttgtggcctacggtctgccaaaattactgaagatgtcccagcatcacagcacggacctgtggagaggaactttatagcattctggcccaatctctgctttttgtagagggttctgaggagtttcggtgaactgagcttactaaccaggggtcacagagctaattgatgggagtccaggcttgattccattcttctaacatccagtccagtgttgcccaaaatgtgatctactgacaacttacgtcatgattggcagggttactcagcaaaaatgattcctggcccccagcagaatcaaaattattgagggttcagtccagggatttgcgtttcaataagttcctcagtggttcttatggacactaaaatttgggctttttaccaataagccttaagaccccatttccagggaaagctatgtgctaaatagttcttccagaatgcttgcccaagagaatgacttgccttcatatttgctctgctgtgtatattgacagtataaaccatttcaagatgagctttaaggatgagtaaaaacatacgctaaattaggagctgaaatctttaatttagagatactttttccatagtctgagagtaggaaaattttcatctgaaggttgtttattcagtggatgaatcaaaaattgttgataaagtctaaaaaaggtaaatatgattctttaaaattttgaattgagtgtaatggagcttgaattgatatttagtatgttctatttacttgtgttttcataaaaaccttgctggatgaatattcagggtgccaataaatttgttacctgtttggccataggaactgggcagagggaagttatgggaagacttttcagtgaatattttctatgcttcttgatttttgaaccctttgaatatattgcctattcacaaatttttaaataatataaatgtttaaagcattaacattcattgtagggccttagtaggtgattgctctgactctgcccaggctacaaaaacacatactctagaatctaggtgtccctgtagcagaaggtaatgaacatttccaaagggcagagccaggaagggaaagactgcacattcagctagttttaaggaaatcactaattggcttgaaaagacaagtcattttgttttagcacttatactcattattttaaagcccctccctgacagaccactcatcactggggttttgggtgaccttgggcaaatcactcaaccctcttgagactttgttttctagtctgtaataatactgatgaaaactccctgtatttcagttggctgacgatttctgaatacattacttagttttcacaacaactctgggggttgggtagtatggcatgatccctattgttcagatgaggaaattatgacccagagaggttatatggtttagagagggtcacacaggggtgggacatctaacttccagtactgggctctttccactgtggcatgcaggggacgtggattaggcaatttccagggcctcttctggcatccaagtccttgagtatatgagctatttggggctccgtcaacatttgttgaagtcttttggaaaaatccaaaggaaattgaagccatgggtttgcaattttagaagctcgcattgtaattagagtatcaaaatgtgctcatacgaagacaaccgaggaatacttacaaagccaacacataccaagttatgcaaattacaaatataccagatctcatatcacatagcacaaactctgcacctaactaccaaggggatggggaatcccaaacctcagagaataacatttgactctctcatcctctcctaaatgatactagcaactgctctttgagcacccagtaaggcaagcatttgttacgtattatcacatttaatccttaccacatcctctgaggcaggtattattatcccaattttataggataaggaaacaagacttagagattaagtgatttgaataaggcttgtaggtggtaaagcccatcaccaaccagggtccttattattattgttatttttattgctatctcctacaggaaagttaggatcctttattgatttaaggtgtgtgcgctttgtctcatgcctggctcgtcttcttgtctaagagtacacgtagcgtggtttcagataagggtatgttgaagagaaaacttaacgtacctctgccaatacccagggtgagcctgatttcatgcagtagcaatttgagtcgcctttagtgggcccatgagtaaaggaggcccatgaattctgccttcttgcctcaaaactctttattatgtgagcctggcttctcctgtgtagcatctgttacttcgttttgccttccacatgtactaagtagaaatagacaaacttaactcttgcagataatagatgactgaaaacagatgatgggcacacaaaacaggctttgtctccataggattttgttggtaaaatacttcgtctttcacttcaatatattttgttcattgttttgctgctgcttagatatgaaaactttcctctatcgtcctaatcttctgatatgccatcatctctttcaacctcttttccgatgccagagtgaatccagtctgcccttgaatactgtagaaacctcttggcagttgttaacaagccttagcatttactcagtcattctgggaagagaggggaatttacactgtttccttagttcacatagacacaggcgaggtaagtagcctggctgggttggcagaggttcttgaggattgtaaaaactgtgctttgctccggaccctggctcctcacagaggtctgcctgcttgtccttggtctgtgtcctccgcaggccttttacttgagtcagactcctctaatgagagagttcttgggtttcagtctgggggaatccagcctccacccgccagacttcctggagagctctctgctgatgctgaaagtgcctggagccttgaggattggatcaagctccctttcgaaggggtctcaaaattctttagacataatatatttgtggctacaatttgttaagaaaggaaacaggctgtactagccaataaattgtcaaaggagcacatacctaagatagagagaatggtttgcagcacacaacgctctcactcccttttctagtgctctgtattcagtatttacactaacttttagtagcagctgatttctaagaagacttctggcttctgctctttgcattgaccaaaactcttggggcatgtgttgagtgagggaatacctttttattcacctgcttcctagtctgaactttcagataatcggcacttcttgttcccagtgtgaatccaaagagctgaaacagctttctttgtgggaaatcaggtaagtgggatttctctacagggatgcagatgcagatctgaatgcatgtacagtgctccatagctcactgactaagctttaaccagcaagtcagagctatacagcacctataggtactcccacgatacttcaaaaattttcatggaattataaacattgattgtcagaaaaacagacctagttatctcattttgcaggctttgcgtctttgaacacatttgatatccattcctactaaattttctctctgaatctgatctgtctgctattcatatatttctgttgttttattagtatgtgctgtagccagatattttgctaatttgtgtgctttttctttgctttttcataattctgcctaacttcttaggtatagaatttccaaagctagttgttagtgtgccaaaacagccaaaacagctttaacaaaaaaaactatgctttgcttgactgggctgtaagatgacttagataatttatgcttcccttcaccatacttgggggagtacctgtttagaaagggttttatatcctggcttggaataggtctaataatttaaaccctctctcctggaattaccaaggtctaaaactaaaccttatgctaataatgttgaagttgaaatggttttcaaaatgatacccaagtgtttataattttttatgtgctgaactgttttgtttagataaactggaagaagatattctgggataggaaatggctgaaggaaacaaaggtgtgtgcagagaaatacatgaaatgtgttgtaggatcaaagatttaacagtttatatggaacaaggagacctcaaatagggagaggggaaatggagttggatggtaacttggcctggctgagaggacttggagtgctgattattatttatgcctagcttgtttaagagtttttaaaaaataggaaaccacatgtgaatgggagtgggggaaccactctaacttttaacttagccacataggagaagcctacttattcagacctcaagccttagtcctggcaaattcatctcctggtgatggcttaattatatttcaggcatagtattcaaggtgagtgttaagtttttatttttaagtgagaatcttgcaaatgcaagcatatcaactgatagccagtgtcttagggcccctgcacaaacagctaagtatgctcagagagccctactgtggaaaagatgccctagaggaacacccagtcatcctttcctttaaccttcatctcatcgttttctcttcccttccccaacctggacctatcttgcccagccttctcaatgaatacttggcatgaacttcattcactcaactttgtcgctgacacgcccgttgtactgacagaatcctggcttgaatggcgcttgctcagctgtgctttagacaaacccttctggctgacctggtttaaacctggctttcttgacgccatcctcagcgtgttccaaggtgaaaaaggactctgctgccccttctgttgctcctctgcaggggaaaccagttgccacttggcaccaggatgtatcaggccggcatccagagtagtaacatgatttagtgaaaatagtactagaccaggaggaaacttgagtcctagtgctggtttgcttttcagtggctgtgtgaccttgggcaaatcattgcaccaccccaatctcagtttttttcatctatgaagtgacgagctgttctctaaaaacctttctgatcctcaaagtcaggaattcacataggttaccaaattcttgaatgaatagagatttgggttctaagtgcttttcttttcatctactgcactgcctttttacacaaaacaggggccatctctatattgttttgtagtgtgcactcaactcccctctcaatcttgggttcaggtaccaaaaagaccttccttcacctgcacagttcactacaaagaagggcattcgaaaagtctgtaagtgggccaggtgattcaggatgtttcgcgttactttaagaagctttttcttgaattaaatcactctatttttagcaactcactgggtgatgcttttaaaaatatcactgataaaaaatatgtgcttgagacaattacaggtatttcacatataatatttcacccaaatcttaacaaccttaaattctctccgcttgacacgtgaggggattgaggcttactgagattaaacaatgacacagggctaagaatgggcagggttggaatttaggtcagaactttctgtgtccacagcctgaattcaactctggcactatgttcactatgaggagtagctgccattgctgtaagaatacctggcgttttgtgcaggagatctcagggaaccctttttgttaggtttcaaagaaaatgatttctaactgcatttcagatgcctggaatttatgctgtgccaagcacttttccacttaattctaaatccgtgggtatttcaaggggaatttaacccatgtggttctgattcacttgtacttaactcatcaaaaaggattgttttgtaaaccttagcctcttcttatgaatgctttcgagctcatatttggctggcattggctggatttcgaatctgccatggttgaagcttggttcttaaatccttctttccaacaactattttgtggtagtttcatcctgggagtggatggaaattgaaggtgagtcatgaaggctcttccaaaactttaccaggattccagtggtatagacagtcactaacctttgaggttcgtgaggtttgttgcactcacctacagccttaccccattaagtagttgaattgtgcatggatgtgatctatgagggtaaaaaattaaaatcatagatgttgcattttcccctgggatggtgtagagaaaaattgtctttgagataaaaggtatttgtggaggttaggtatattactactttggaaaggccttttagcatagagtcttctatttgggagacattagagttatagagctagtggaaagtttctttcggaaacccccattagaaatgtagaaggcaaaagcctatttattatctttgcatttagatgagttgggtacattcagttctgataacctgctgagttggagaattaattaacttgtctaattaacttcacatgagctcatctaaggaatgtgtgtagttgtgtggcccaggggaagcaagagcaatttttatacctagttaacagtttggtttaagaaagatatattgagtgtcttctattccaggaagttggggatagaagataagagttcagagataaacaagactctctcctcctaaggaacctaccatttggtaggttataacctatatgcttctctttggaccatggccaaatggtatgactggcaaatagtcaatgtacagcaatacaccatgggagctcagaagatgaagatgttcattttgatatatgaagctggacaggcttttcccaaaatgcagtgtttaagtttggtcttgaaggataagaaggcttttaaaggcagggtcaagggcgagacaaccagacatgttcttgggtaatacagacaatgccaaatagtctccacagatttctgctctgtttatagacgtggagtggggtgactctgcggaggtgaatcagagcgttagaagctcatgctgggcgaaagggggttgtgcacagtcctcgataatgagcagctgggattaacatgacagtttttaaccgagcacagattttcagggctgggacagtttagccttggatcaagaagaaaacacaggaaagggacaaggaagggaacaagatgtgaaggaacagtatgtgagatttacacatcatcactgcatgccatgtttaaatagaacatactgcataacatcttaacatgcccttacatttctatagtgtacaaataatggcttattctgtctcacgttgaagaaaccaattaaatgatgcatgttgggtataaaggttttttctattgaaaatatcattgtcatagaatagaaagagttacaatcagacagaaaattaaatatcttaaatatttctcttgtatagtgtttacaaacaccctattatcatccctatttataattaagaaaactgtggatcagaaagtaaataatttgcccatggtcacataggtatataagacacttccatttcagtttgcagatataatgtgtatgtgtgtatgtagcttaccttttctatttgtcatactttttcaattcactatatgacacatttacagagtatatgtcatgtatgtgttagttacaaacctattttaaaaatgaatactgcccaacctaagcagtaaaatatgactgatacccatttaggattccccgtaccatctctttcctgcttctccacagggaggtaacctctatcatagattttattacatatatttttttagctgacaccaacattgcttctgtgttaccatggtttacagtgaatatatttacaaaaacaaaattgggataattttcatttcttgcaaacaacactccaacactgcactgaaggctttgttagctcaagatttaggagtatgagaacaaggtcctgaaactgatttgaacgttgcttcaatctcgactgctgtgatttaatcctggggagcaagagggcaaaaatgaggccaaaggggaggcatgaagtaaccaacagggcctgatctgggatttgaaagatgtagattgtcgttccatctgccactaatttgttctgtgacattgagaaaataactttgccgctctgtgttttgatttacccttgtgtacattgtaccgtcattttgaggaaggcaaagtagtggggaaagcacagcttttagaatcagaaacaccaaaagctgaattctcattctgccacttactgtttgtagaaccttgggcaaatttcttaactttactttgagcctcagtttccttctttataaaatgaagcaaaagtcttcctcagagaattgttgtgagaattaagtgagacagcatgtctcccttgtagccagcaccatgctccataaatgctcattttctttttcttcttctataagtttccttccaattctaaaataggagattccagtgctcatcttatacataaacgactgaagcacaaccagctcataattatggaatttcctgtattaaagggctcaacatttctctcaaatcagacttgtcattagaagactttccaaggtctggatgaatcttttgaaattaacaataacatctggaaaaaaaaaatggctcatctcacactcacagagtagagagaaaggagtgagaagtattatataagttcatttactacccttgattctcccgttccctgagccaaaacaatagactataaagctgcgacttcatttttattgtttcataagccatctgcatttgcataaagtgtcagtaccgttaccctatttaaaggttgaatgtcactgtgaatgcaatacttaccttttactgtctcccgggaacctacctaggcatttacatagttctttgctttcttttcaatccattcttattgacgtattgtttgaaattggccactgtttgggaataactccaaaattccattatttccatgtgtccactctgtttatatttttatgattgttatggtaagcaatcaaatatgtaacatttgggaactgaggggaggggatggtggtctttactttcaattgacggtagtatatagggcatatcacattcaaaatatctcaattatttaaaaaatagaatagagaaagagggtcatctaacagagatattagtgagcttatttaaaaaatagaacgtatcttacaagtgagaactggcagtaatcttatgatggtaatgatgcatatgaccatttatttgatttaattggaaaaatatgtgtacatcagagaacagtggattaacggagatgatcagagttgagtcatgtctcaacattagatatcttactaggtttcgaggaagaaaaattaagttgatttggggaatatgagcttaggaaggaatatctggaattctcatttgcatttgggtaaaatttggttatgcacttgacctactttgctcaatctctttgctcttaatttttaaaatacaagctacataaaaattccagaaatgtagtatcttatgcttggattattcactcatatatatgtcaaatgacaacataatttgtggacttggtgtctcagttagaaatgagtttggatgcaaatgatgcaaaacccaaccacagtgacttaaacaaataggggttaatttttcttatgtcaggaatgaatttggaggtatatggtagctggtggtgattccactgctcaaaaatgtcatcaggccagccagtggctcacgcctgtaatccctgcactttgggaggctgaggtgggaggatcgcttgagcccaggacttcaagaccagcctgggcaacatagggagaccccatctctacaaaaaataaaaaaataggcaggcatggtgacatgtgcctgtagtctcagctatttgggaggctgaggtgggaggattgcttgagcccaggaggttgaggatatagtgagctgtgatcccaccactgaactctagctagggcgacacaatgagattctgtctcaaaaaaaaaaaaaagaaaaaaaaagtcattgaaactgaggttcttctttctttgtgctttataaaaccacaatgagataccatctaacacctattaaagctgctattaaaaagtcaaaaaataacagatgctgcagaggttgtggagaaaaaggaacacttatacactgttgttggaagtgtaattagttcaaccattgtggaagacagtgtggtgattcctcaaagacctaattacagaaataccatttgacccagcaataccactaccgggtatatacccaaaggaacataaatcattatattataaagacacatgcatgtgtatgctcattgcagcactattcacaatagcaaagaaatgaaatccacctaactgtccatcaatgagaccggaaaaagaaaatgtggtacatatacaccatggaatactatacagccataaaagggaactttgcaaggacatggatagagctagaggccactatacttagcaaactaacacagcaacagaaaccaaatactacatattcttacttataagtgggaactaaatgatgagaacagatggacgcatagaggagaatagcacacactgggccttttggagggcggagggtgggagaagggagaggattagggaaaacaactaatgggaactaggcttaatacttgggtgatgaaataatctgcacaacgaacccccttgacacaagtttacctatgtaacaaacctgcgcttgtacccctgaacttaaactaaaagttaaaaaaaaaaaaaaaagaacaaggtcttcatgaatccaggcttggacttgatctgcatgtcacctttatctttgctctatattgcaaattcaactgttgtttttaacaaaaggccaggcaagggagtagagataacttagaacaaatctcttagctcttcagaatggattaaaaggtgtgtcttgcagattgtgggtcattgacgtcatttgtttctaagaatagcgggatgtattggttatgtgtacccatggtatgtgtgggaggagaggaaaaatagaaggaccagggactatggtaggtattttgtatacttatttactactcatacaaccccaggaagcagagaaaactgactcaaagggtaactttattcactgccacattgataatcagcattccagaattcaaatcaagcatgatagattcacggaattataagtagttaattacatcttgagcaaagggaatgaatagttcaaaagattaaggatttagactaacttaaagatatgtcattttgcatcctccattcattcattcattcattcattcattcataaatacttgagtgcttattatgggcccatggggatattctaggccatggagatgcaaagtttaaagagacaaaatatgtatccttaaggctcacaatctgatgaaagacaatcatataagtgagagtttaccatggagtttggttagtgccacagaggagggaaggagtaagtcgtcaggggagacttccaagtggaggaatttggtggaaaaatagggagaggaaaggcattccaggtagaggagatggcatttgcaaagacgtgtggaagagaaacagcaccgtgagttgaggaactgcagttcactcagtgtcaatggagggggaaggcatttagggaagaggccagagaggaagccaagtagggagcatttcacagagcgttttagggtctaactgaagttaggttcactccagcagggcaaagggaaatgagggtctacactaaagcagtagcaattgaatttcagaggaggggcaataaagaagctgttgaggtggtaaatttgacaaagtttgcgggtgattaggtgggggtgtgagggatactctgtaatccccgctgccctgagtctgtggccctgtgatgtgggctgtggtgatgccctttcccaaaataagaagtgtgggaggagcaagtctaatggcaaaacaagcttctatcagacatctttctacacgctctgcccttcctgcactatggaaacaaccttctcttcctaacctagctgaagccatcctggctcaggccagctgaaaggccacgagggcgtctgaatggttcatgatttgaccacttgaatgccatcagagagtgatgtgtctaactcgagacgaacagcaaattagttgctgagctgagactggcgtgcaggcctcctcacttttaggcttattgtctttaggttctagccctgcactgtgttctgcctaaatgggcaaggtaacattatccacaaatgcctgctgccgtttggggaaaactaaccaggacggtatgtgttactaaaagttagctatcaatttatagagggcagtgatgactttcatgcaggtttatgtttctatgtggctccctttggaattacaagtaaaggaaggggagaactggagtcgtttttttgtctgtgcttgtgtcactaactaggagagtttttttttttcttttctttgagaatgaacatataaaactctagtaaatcagagtaagttatctaagtaatgccaaattcttattagttacttctttttaaatagtgcaggggattattaccttttctgagccatggacacttttaagaatttgatgaaagaacacgttcttcttccaaaaaggaataaatgaaggcactgtattgagtccaagtgcattggttgcaagtaatggaactagcttaagcagaagaggggatttactgtaaggaaatcccaggttataagaaacccaagggcaggtactatagcagggctttacccagggctggaagcaaaaaccaaatgctctctccaactctttctggagccagctggtctctatccctgccccatgcaggtggactgctctgtgcatcatgtacatgccgcctccctgctcccaaggtaagtcacctgaggtctagccagctgcagaggtgaacaccagtgctcgtcaatcccaattccagatttctggaagagaatatgtgattgctcacttaattgtgttcagattcatcgaacttgcagatgtgatttatgtatagtttcagggcacctttagacctaccaagtcccaattgtggtcttcaagttaagaacccataactagagaaatctgaatgcccatagaccagcagcactaacttttagccgtacaactactgcagaaatttgaaaatacatttgaatagaaagcatttgcatgagcatagttcctaagaacacttgctttgtgcaggagttgtgaattttaaatattagtagtgaaatcccaggatggcgaatatgatgtattttaaattataacactttccaaggtcattgatattctattcctaacttttacccttaaaggtttggaaaattccattttaattattgttaacatgcttcataaatatccaagggaataaaacatagacctgttaatacatccagagagctaaaatctggctcaagttgttttttcttccacagttggagaaaattgtggtgtttggcttccctcttggggcattttaaaccacttttaatgctgtctcttattattttctaaccatatacactttccgaacgtatctaactagctgccttagatgaaaccccagtgtctggccaagctgatataaatctctagtaagtggtaagagggaacagagtaacacagtgccctgtcagtgttcagacagtacatgatttagtagttgtaggacttatagtctcaggagcaactttaaatcttttttctagttctatagaatggaagtttctaaggcatatactattctgccactggctccactgggcaacacttagctagaactagagtggcctatctgcccatgggatagtattaagatttaactcttcacatcatgtgtacctggggtgtctgggaaataactattaattccaaagagcaggatgaatatttgcataattgctagtctgtgccataaaacagttgtcactcaccagtggcccagaatatcgaaatctgtatgtttccagtggagctgccaagagaccccatgtgattgtcccattagtgatgtgttctcactccacttagcaggtctgaaaaatggacgaccataaaataacagtgaaaactcagttctagggtctgctgccttagttgttggtgtctaagaatatggatcatctgttgtatttgatatctgagcacgtactgatttttgtcaggaatcttctcttgttgatgaattaaatctacataatcgggttttggtgctgctgcctctcccaccccctcagctcccatgcctgtcttttgcacggttcactcacgtgttctgagtaatgcttgtactttcttccaacttgtctttcttcagctgagttcagtgccagactctgagctggaaacagtctcaggaatttttcattcatcagacattttcttccaaagaaaagttctgagaagaggagggccaccttgatagtatgttagcatgcttctgtgactgtgtgtgtgtgtgtgtgtgtgtgtgtgtgtgtgtgtgtgtgaaagagagaagatatacaaacaacctatataccacatatctattagcacatggatatttgataaaaagccaattctagaaataacatttgccaaccaatgtatcaaaaccatctccctgccgtttatctgtcttgatattacagaaagttcatatttatagaaggcatttctcagctgtggttaataatggctgaacttttgtccctgctttaagttttccaccagatctctcagaattgatgctatcatggaatgtgaatgtggtgtgtctccatttcctgtagaatgaactcagggctggcagctaaagctagtggtcttggattcccatgccctgtcatttacgaaaggggcagtggagttcctctggaggaaatcccacccaccacgccaggattccatcacatattgttggtctgggccgtgggtacttcatacttggttttctgtgaaaattcaccaagtgtgtttgaagtaagaatctcaaccctaatgtttatacataaatgtctgaatatgataggagtaaatgcttgctcacaaaaaggaagggaaggaaaagaaatttataaaaaagcaaaaacacacaagtcagggtataattacattatacacaggttttgtttttgttcattttgatagcattaagatttacagataatatgattttatttagggacagcctcactaattcaagttacctgttctacaccaggtaccttattgtgagaatgggaagaacttgttaacggattattagtatttacagcctaatcttccctagtttccccgtttcagcaaatgaccatttattcagtgatggaagccagaagcccgggagccttccggtttccctcacgcttcccatctgatccatccacacgtgctgttggttctttggcccaaggacgtcccctacctgctggccttccaccctttctatgccaccactctcgccaactttcacctcaaatccttcagtagcctccctgaaaccctttccatttcaactcctgagcccttaaaggagcacacttctcaaataacagtggcttttattttcagtggctttttattgagctttgagccagatccagactcctcatcatatcccgagatgtcctgcataatccagcccctgccaaaggatccaacctcatggcatgccccttcccctttgcactcaaagctctggtcacagcggctttcttttaatcctagagaagccaggctatctgccagcccagagccactgttcttgctgtctcccatacttagaaagcgcttagatgttgcacagctggcttgtgctcatcctttaggcctcagtttaaatgtcacctcctcaaagaagtcttttctgataacttttaccaaggcaggtgtacccaattattctctatgacagcagcatgcttgtttcatttgtaactaaattacaacctcaaatctaaaactattttaatgtgttgatctatttattcactacctcctccacaagattgcaaactccatgtgaacagaggttttatgttgtgctattcactgatacagggttgtggctcaataagtatttgtcgaatgcattaaggaaacccatgattctgttttacagttgtaaaatgtaggcctttacaactgtaaagcattgaagtcaaagtgtttaatttaattttaggttgtggaatttctttctttctttctttcttttttgatacagggtgtcactctgttgcccaggcttgagagcagtggtgtgatcgcggctcactacggcaagcgatcctcacacctcagcctcttgagtagctgggagtacaggcgcctaccatcacacccagctacatttttgtgtattttttgtaaagatggggttttgctgtgttgcctaagctggtcttgaactcctgggctgaagcgatccacctgcctcgtcctcccaaagtgctgggggtataggcatgagccactgtgccagctagaattttctttttattgtgttaaagtatacataagataaaatttaccattttaaccacttctttgtgtacagtttggtggcattaagtacattcacattgttgtgcaccttgtcacccccatccatctccagaaccttttcatgttcccaaactaaaactctccattcctccctcccctaaatccctggcaaccatcattgcactgctgtctatgaatttgactgctctgggtacctcatattagtgcactgcaatcgattgatattttatatcaatttatttttattgcctctttaccaacatatgccttcaccctccacgtacacaatattcagtgttaaaattggcttgctactgaaaatctcatttctaataattatttaatgataaaacattctattaggattcttcatgaacttaattcatcttttgtggaacttatttttggaaaataaacaatattacaaggtacttttatgatatacaggttaatttaagaatatgttgcccctgacaatttttatatttaatcataagaccctttcctcttgggctactaatcttgtttttggattggagagaatattttatgcttcatggctttgaaaaaatataaaagaacaaataaattgttatacaatattattgtttttgtcttgctgtttaatagctgatgctctgtggtcaaacttcagtgtttggtttaacgtggcatttcatacaagctgttttaaaagggaatgaatcagagccaactggttctttaaagtggaatttgcagaccattaagaatgaaagtattctgtatgattttattatcttgatggtaaatatgtcacccaaactatgatttgactttaccgattctcccagtctttttttttctagtaaaagtagagataactttacaggaagatgaaagtcagtaatgacttgtaggatttatagtgaaggaacaaataatatcaggtaaatgattatttcaaaatgagatattcttttactctgaacaagatttctaactgttttcttcatcatggaacagaataaaatgtggtaacaatttgctgcagttgaattgctgccacacataattgggtcccacagaactatggcctggattttggtgaattgcttagtctgcatgttagattaaaaggtgtacaacaaatcaccttgtttctgcagttttgaatgacatttacatttaagtcatagtggtaatacttttcatttatggaataaagaaaataaaatcagggaaaatactaatgtagaaatggttttgtttttttcctatatggtttatttctaaagtgctttttaaaaacatttagttacaattaagccatacctcagaagcagtttgttaaaggtaaacattttgcataatacagtttggtaaattttgccaaaaggttgtattcttttaataacactgtatagaccatgttaaataggtaatcttgtgtgcagtattttatataaatgcatggattggaaagtatattcaaaccttattgtgtcattttaaaaatgccatgtagcttaaataagatgggagaagcaacattgcatagtaaaagtaggcctgaaaggaatttctttcccctgaaattttattataaaaaatttcaaacttaaagttgaaggaataatataaagtatacacatatactttccacttatattgaataattgttcccacttttatacacataatagctctctatgtgtatgtacacatatgtatgtatatatgtgtatatagaatatgtaaaatatatattaaaatatgtatttattatttatttacattgctgaattatttgaaagttaagttgcatacatcatgagacgtcacctctaagcactaaggacattcttgtatgtaaccacaataccgttatcacacctagaaaaacaacaattctgcagtgtcatgtagtatgtagtccacataagatttctgaaattgtctcttttagaaacagtatccaattgagttttgattattatgatttttaatctaaaataatctctgtacttcttttggtgaagagaaagtaatttgcttttggaaaagttctagacaattgccttagaaaatatcacatgttctgagttttctggttgtttccttgtggtgtaatttaccttgttcctctatccctatattccctttcagctagaagtttggtgtggaagtttgattagattaagccttgacactttttgacaagaaacttcatagataatgtgcactactttatattttataaaatcaggagtcccggaagaatttcagacgatctccgtgatagtgcaattctggaatgaatcaagagttgacttttggtgttactgatgctaaataggccttgtatttgggccccaattggagaatgcccctggaattccactcagatacaagctgcagcagtgggtaggggttggatgtgagagttcctgacagcggcatgagatcatgtatatcagtgtgctttgtaaaactagaaggaaagagactggaaatgggaattctactaactattaggacactgcagtagtggatgatcaaccttcctaaattttgactttgttgtttgctttgatgagctggtagttagtataattaactataatataattagtaaagaacataataaagtgcctcataatcagtgcagcactgtggaaatgaatagtattttgccatgattaggatgtcagtcctagttgagaaatactgggttatgtcgagtggcagtgatgccagtttatgggctggcttatgttcctaaagttagactttcagataagtagttgttatcttgcagagatctccaattaatcatggcacacgagtactcttcattaaaggaaaagagaaagaaggaaaaaaaatacacacacacacacacacacacacacacacatcttagagtcctagagggcagaaataatcttggggagcttttgcaagacgtatatgcctgggccccatgccacatctactgaatcgggttccatggggaaaactgggggaggacagggcgggacccaggcatcagcattttacaaaagctcccccaagtgattctattatgtcctaaggttaagaatgattgcagtaagaagaagtaacagcagttaggaggctgattatggtaatggaacttcttaactttaattttccttagactaaaagttctctgaactccttcctcagaaagttgtattgaaattccacacattaggagcctaatgttccccaggccaacctacctgggagaaataagtgtgctgtgaccctctatgtcatggataaattgatatctcattcttttgtttgtcatttttatgaaaagaaggatttaaaataattggagcctagtgcccaaaattatatccttgtgccttccctgcagtttgtggtttagtgactgggcaggagggacgagaattcattgtaccacagaatattctttccctgtaaacgatgcatttgcttcggggtgaagtctgattacaaatgaaagtgaaataatgctgtagaccacagcattctgagctgcagagctgggcatgagctgaggatcagaggctgcagacacatgttggtcagagcccaagccttgaggccaaatctaacgggactggagagcaatccttgagctaaccactcagaatgggaacatggagatgcagaatttcccatgaaccagccacactggagtaagccagttaaaaacaattagagtcgcactttaattttggaaagacttggcctgttgccctagttcatgaaggtcttataaggaagtgattgtagagcaatttgcaaatagaaagcatttctaatactatattttagttgcattaggaataatgatttacactgaagccaggaatgagtcagacgttacacaagctttgagttaagcacactccctgtctaatgctgagactatctgaaaaaaaaaaaaaaaagagtatgtaaatttagcttaatatcatgtaagtgctatgggaataattgtaaataattggattattagtaaggaattgggagtgtgggcagatttctttctgcggttggagtattggactaaaaacagcataaccttggcaatctaaatgaagtacaggacgaaaagcacatgccgccaaatcggaatgacatttgaaaaccatgttaatacagcatttaccttccaagacatttttagatccaattttatttcatccagattatgcctctccctctacaatcagcaatttttgtttaaaatatggatctacaaatacatttatatccacttgctaatctgtactgtcaaataagccagtttgaatttgtttccaaaataactttgtctatagtgataaatatctagcacagaaatgtactaagtccatagtttctattctacataaagtattcgccaaatatatagtatacttaataaattggatccctgtggactgttgggatgcctaatatagattgtcagaattaacaactaccatctcgattctatgtatttcatattgaaataagaataatacgttattgaccctggaaaagtcttaaggggtttttttttttaatgaagatcttccaatgagaaattcacatgtgaagttatgaatcagtggcagacagaactgaatcagatttgtattagcattttgtagagtgtctggattttgctggtgtcactcacaaaacaccatatttgtatctatcctgaaccttggcaatcctcatatataagataattccatagagtatcttggcaagaggaggtggaaaaacaaatcccaacagtgttgaagagaggattataaattaaaattcatgttgcgttatgctttttaaaaaggattgaatatggcaagctaacctgaatctgtttgattaaagcatttgcacttgtctcagtaaattaacagaaagaaacaagcctaaattctctttcttgttacctaacatggagagttttatttattttttaaataaaagattacactgctgtgatctttctagtctcagatgtaggatatatatagtcataaaaatcttgatgactgtttttatcctgaaaaggattcattgtaatgtacactgaatgctatgtgtaataatgaagaattagaggcaatttaaatgatagacagtaagaaaattactgaacacattctgttataacttgatggaaaattatgcagcaattaaaatcatattgtagaatagcatttattacatgggaaaaagctttggcaatgttaagtgaagaaaatccagcaggattcaaaagtatatttttagtataatccttattttatgattaaaaaaataaaacacacacatgcatacacacaaaatcttacgtacgataatataatcaatacgttatcaagggtttctttaggtgtaattacatttgtttatatgctactgccttttctcaattgtctaaagtaattacttaattttgaattaaaatacataataaaatattgaaatagaaaggaaagaccaaacagcaaagatgtatttattaaatccctataggtatttgtttgggagaattgagccaaaaaaataaagatgactttggtatttcactttgtccacatagttcctgcattttaaagagattttgttccaaattactgcagtgctgagtgactttttcttcatcgaaagaacgaaatgagggctgagatttattcaacagctcagtatttaatacttgtttatatttttgtttgaattcagtatctgtggaagaagatagcaggttttgaataaatctggcatacaatgtaaaatattaaactatacctacagcttgactatataaaactaaaaaaacagtagagtaagaaatgcataaacaaagtaaaaaaaaaaagacaaatgataaacagagaaagtgtcaggagacagggctggaaaggtgggtggggctatatcatgcagagaagagggacacagaggtcttaggcttgtcttttggcatggtgagtctggttgcatgtagatatcactcacacaatttttgacctgtttgcatatcacctgtactagtatttaatatttttaaaaaattgaattaaaaggtttttcaattcatcatcctcatagcagacataactgtgaaatcatgagtctgatatatttatgctgtttcataatacacattaaaattaatatgtgactactaaaatctaaaattatcttgcatcctgtgagtgggacataacactggcatggagggagggagctggggaactggggactcggcatttggaccatcctgtctgtctctccagtgctgccatagcttggatatggtagtcttctttacatatatgactggcatggagttttgtttttggaattcttcagaaggttgatcttacagcatgggcatcagagcagtgctgtttctgcaacaccattgaacagaggtggttcattgcagatagcagaggagagggaggaagagcacgtagtgatggggagcagatggagttgaaattccaagggaggggttggagtggagatgcaagaaaaagaaagcaagagagaacacacaggatagagggatgccagcagataagattcagctattgccaaaacattgttacgatccagaatgttgactcttgctggtactgtaatgaaaagttgtccttttttccttagtaaatagcatgtctgcgatgtcctatgagctacttaaagaaagaagaaaataatgaaagcatcccagtagtttcattagcacagccagtgattttcataaaactgttgcgttcacaggtgaaaggaacttactggggtcattgagtccatttttagactcacagggatcactgcacctaaacacttctgaaaatgacctggaagcatgcaaatgttggtttgtggatagaagcccatgagtcttaccccagcccagcctcccttgtctgtcaaggtcattgtagaaccacggaaatggatattatggccctgatttctctcacaaggggacaacctgggtttggtcctctgtgctcactacgtctttatctttcttatttgttgttggctctctctctgtaggaaaaaaaaaaaagaggcagatcttatagctggtggtagactgctctgattggaaattctcttgtggacttagcttatccctgttttgctttaagatggtccttttgcctaggggttacaatgatttcagaccagtgtcctcactctttatattaaaacctaatgtgttttgcatggacaaaattttaaattcttgtttgttggtttgcttgttttgtatttgaaataagatgaccccaactcaaaagaaacagataaccatttcttttattgaaggaactcccaggaagaaggtgccatgacttgcctcactgcaagcttcaaaattctttgctttctcagccctaaataacaatagactggaagctctgtgaggtcagggatttggcctcttttagtcactgaagcatctgtatcaggcataggagctgattcagtgtaggcactgatatattttcttaagtaatgagtggataataatattaccatgttacatttgtatagcaattcacagttgtaaagagttttccattagctcgcctgatcctcacaatgccgttttcaaagtgggtaacaactgatgttttcatccctattttgtaggttaggaaatcgggttcagaagtagaatggtctatccaaggccttacacagggacagtgatgcatgattctgtccctgaaattcatttctcaatttggagtcaagcaagatggagcacagctgttcctctgcatgatggttcctgcttttctggattttcatcagatttttattctttattttcagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaaggtaaacccgggctgatggaattattaatggattaatcttatttgctctggagagccattctccaatgaagttgaagagaatggaaaagtagtgtcagctacataacttcacaatttcgctgactgcatgatatccaactaaggcattaggaacgtggctctcgagagagcagctgaagtcttactgaatgttttcttgccaaccattccccctttctgaccccagaggtgtttgtatgtacctctgactccaggggtggtgtgattctgtttacagcgatgcagtgcattatggcagtgctgtgtagaaacacaaagcaaggtttgtgaacaaggtagtttatgtttttcttaattttttttcttcatttgaaactgttgagttcctctctcatgggttgtgcttaattgacctgaagaaaattgtttctctcgacattttgcatgctacattttgcatttttttacaagtccaaaataaattaggatttgtttcacagttttaaatatccccagatgtcgcctgctagctgcttctcctgcctcccgtagaagcccttactctgtttttggcttttactcctgttcttccagctgtacaaattcttttattgtctggatgtctggcaggaaacaggaggaagtgaacagaggcagctccacactaaactgatgggattgaaaactctcagcctgtatctgtttcctttagacagcctcaggactttttatagcaagttgcaatattttcagaaacttcaggatatgcttttctgaggcaaatagataatactttggcgttgttttgtatgttaattctaagggtaatgtgcaataaaacagaacttgagcttagtcacacagttttgtgggtctccattacattccacttcaataaattccacttctgatattgtcattcctggccttcagctcccatgtacaacatacagctcctttggatgcccttaaatgtatccctctgaatgtcaggagaagaaataagtcaccttgaaactctaaaattatcaagggatggattgtagtattttacaaaagtttagttgttttttggtgccttcttatttttcccgtttttagaaaatcccagtgagttttgaagaatttgttcatcttgggattacaaagttagctaatacccatgaacttgttgacagtgaccagagagctagacttttaactgcctcagctgcccatcagtgacccattgtcagaggttagggtgctaatggaattgggggggtggggataatgaactgccttctctttagctttgctattcgtttcataaatctggatctttccagcatttgcttcctgtttctttctaactctgctattcaacatccaagaaaaaaaatgttttttataagaaaagttttgaaaacccattgaatcacaatggcagttatattgctattttgagagtgaaattcttcatgtttggttgttgttgttgttgttgttgttgttttttctaagagattctgccaccaggttgtggctcttgctccttgctggtgtttccagtccttgggtcagatgtgaggggctgtgggcaaatgggttcataaaggagcttattctgtcttcagacctggagtatacagccagtggagaattgccttgtctatattttctgttggccagaaatcatgatcaacaagacagctagttctgcctatatgtaaaaatcttgattttcaaaaacattttaaaaaatacattcaacacatcaagagaatggaaaattctggtctaagacaaaactgaaattggctagaaaacataatttaatgattttccacatataatcatgtatctgtgggttaagatatttcatttaaaacagtaagtgatacttttataataaactaaattgttgtttctttaatatcccttttactgcatgctgacttttctcaagaacacaggttgagatcttataaacagcaatcacttttttctttactcaatgaagagtgaaactaaagagcacattaagcttccaggtttcaaaaagaatacattagactgtttgcttggggattctttattaaatcagacttttctgttatgaacaaagagatggagagaatgtacatgtactttataatctttataacaaaagtagtgagcctgaaatgattaattttgctcctggaaggttaatatttgggcttacacataagaacccaagttagtccttaggtgctggttatacaacagtgaagaaaatggacaaagtccctgctttctggaagcttatattgaagacattttgaagacattcaatttattaaataaaacaaacaggcatgtattaggtcagtgggtggttagtcctgtggaaaaaaataaacagggaaggaaggatgattagagccagcagccaggtgttgctgttggactgtcaagggaagggctcgtggctaaagtggcattggagcacagacctggaggatgagacatcgtgggccatgcagctctctggaggaagactattccgggcagaggggcagccttacagagctctgtggcaggtgcatccttggcatatttgaggaatccagtgtggtgggagagataggagggtggaaaatgggtaaaagatcagagaagtcatgtcgaactccccaggacgtagtacacacttgcacgttgagctggggaaagacatgatctcactgacatttacaaaagtggcttctggtggccactgtgccagcaaggtaagtctgcagctgaaactacacactcactcacctaacaatctctctcacttcttggcctaattttctgagttgtttaatttttactgtgcaaggcacttctccagaatgtgaagtgaacatttccacttcatttgcgcaaaaacattagctgtctcgtgtagtctgagtgaccttcaataaattccgttttaactaaatcactcagtacaactcttaaaggtagtttcattgtagaaatgtattgcattttgatttgcaagattttttgaataactctgattattactaccaatctggagataaaaatgaggccgtgaataatggccttttaaacgtatctttatactttgctgcatatgtgctaaaacccgcaaaagttaatgcactctcctctacattaggaaacatggaaggtgggaaaacaaaaaatacttgtgacttcttatggaacattattaatcaaacgatgtattttacataatgcaattgtgagaaacagtttctctaatcatattccaaatattgtgatggacaaataactcaccgatataaatatggtaacataattgtggacaaattatcacattttattctgcaatgaatttcatatgagttttttttttttctctctgtcttctgtaatctgacagatgtggatgaatgccaggccatccccgggctctgtcagggaggaaattgcattaatactgttgggtcttttgagtgcaaatgccctgctggacacaaacttaatgaagtgtcacaaaaatgtgaaggtaagaaatcttatgctttgcagttggggggtgtagtgggggcaggcaaaactcaacattagaaacaagcttgtttgcaaattattcctaaatccttctgtctttgtcatccctgtgaatgtgtaaatataatatttttaacagtaataatatgcctttgtgctattggaccagaaaaaccctgtagctttttccacttttatagacccaaaacaagaggtccatctgaatcaaattaaatattaaaaacatgaaatatttttgaaccaacatttggtttaaaatgttcaacacacatgtttttgcatagttctagagacatgaatttaaatttggtcattagatatcattcagaataatatatcttccgaagtttttctagttaaaaggtatgtttgattttgtgtgtggggaggcagattgatctattaacccttatatttatgctcctagtacatgctcatgattttcttttctgggggatggtaattgcctatcaaatgaaaagcttttaatgttagtcaaacagaaaagtaatttgagataatttttatatttacatttagtttatagattgaacttctacaaatatatatacagaggatgtgtttatagtcaccactactgctactgctctttgccgaaatgaggcctgacttccaattacagtcataatttcttcgtgagaggggagcatctagaaaatatgtaggcagcattggactctcttttctttgatgagtgcatgtaacttatatatagtaatgtccaacaatagtgtaacagcattctcagggctacatctctcatcaagatcagaagagaaaacttattccttcatcctcaactcagcccaccttgaggtttcacttagatggatgcatagtcattgataacagatgctgttatattcaagcccctagactctaacagtgagtacattctaagctatctgcctaggctggatatctaaccttgacaattgccactgtatatcagatgagcaaaagacagctttaaatttaaggtgcaattcataagttacatgtaagacatttaatatctacttgccctgaaactgaataatctaactctgatagaactatctttatgagttggaattgtttttaggttataaatcatcattgaatttataattgatactgcattcttgaacatgttatacatagttattcggggtagttgtgaaaaaatagttctttctaaagacttcttaaaaaaacattttaagtttcaaagaacaataaagttgactcttgataggccaatgtattttagaagttgtactgtagatctaaatttgaagcagagaatgttggcactgaaaggggcaaagaactcagctatttccacactctacattatatattaaggaatggtgtcttgggtgtattaagtaccctgtctgaggccattcagacaagactgctcaaatttacctctttaactcacactctggtgcttgctgagccatattacattgtcctctttcctagatgaaagttattattctggaatagattttcgggccatatacacacacacacacacatacacatatatatatacacacacacacacatatacacacacacatatctttatatagacacacatatatctatatacacacacacatatatatatgacattaacttaacaagccattaaagtttatcacatgcaaaacctacatcaacgataggttgtgttttatcttttaggctttctcagtttaatatattcagcttcagaatatataatcagcttcaagattgaggggagtatagtccttatgacttgtccagtctgtgttttgttttctgaaattatgatggcttccagcctgagtagaattgattttgtctcttgcttttcattcagacaagtcaattaacaggaatggtctatggatgtggactagacagaagattctaatttaatgctcagactgaaagaaaaatcattcgaatctttttattgatgctaagaaacctattatggtggtgtatccagtggaccaaaaactcagtctattacttaatccttttccacacacaaaaattttccagctacatgtgaaagtcagcagcaagataaaaacagactattttggctagatttttttttcctttgccatctactattacattaatttagataatggttttttccttcttttccttctagtatcaatgcaaaattgatactagaggagaatgtcctgttagtgctatacattctctggcctggagactggtgtgaacagggttgacctgtcttactctggtaagaaagtaatcaggaagtaccctgagagctcttggcaagccgggttcactttttcgacgtccttgctcttttccggttacagtgtctcactgtggaaatggcataactctgggcatcggctggtgtctagatggccaatagagggaacccaggaagtctggcccgtaatcactgaatatgttccctagaaagatgatgagtataaccatggggttctgtgcccttgtgaaaatgtcctggtacctttgccattgctttgagtggctttttaaaggtagcttcctttagacttggaggggaaggaattgagtacttttcatagaattttttcaagaaaaaccaattccatcaaattggctttagcaaattcacaagatgctaaccctcacgctctcagatctgagaatgccattattcgagttgctttccatgagatcttcctcttgcagaattctcacttccttcctaaaatgtccctctttccaaaaactaaaaaaaaaagaaatgttacggaaaagtgttttataaatacatataattggaggacattttgaaatgtaaattaacaagttgaagggatttaaataacaattattaaattttcatacatttaagaaggaaaagattgagatttatagctgtgatttgagaaaaaaggaaagagttcatgcccaccttctttgttgatctttccaatgactgtagagtacgcatgctgaaagaacacatgaacatttttctttggaaaccaagtccatatttgcataggttactatgggaggaaattaagaaataaaaagcgtaattaagggattaagttttatttctggaagaagtccgttggattcctaattaaccactaatattttgggatttagattatcgccagcccagcctttagcaattataatagcactgcatgatgcacaggacctttttaaaagtgtagcttttaaatccatgcactccataatatgtgagccaaaaacctcaggacttcccctttccaaaataatagcatatttatctcatggctacttactgttaggggctcttatcctctcaggagctaaggagaattcccggggcggcttaacccactaccatagatggggctccatcctctttcagctgtttgcaggccctagactttcactgttcaaggtaactggctctctctatacaattagttgaaaaaaaaaaaaatctctgcggtgaaggtcaaagagccctggaaataaggcaggcctggctcccgtccttgatgccccgtggtcaagtccctaatgctttgtgtgatcttagataagtcaattaccatctctgagttacttcagctttcaaatgagggggttgaacaagatgctatgtgggggttctttccagttccagaattcagactccattttcaagttgtgatcgggcggcggatgcagcatgaataagaattcagactccattttcaagttgtgatcaggcggcggatgcagcatggataagaattcagactccattttcaagttgtgatcaggcggcggatgcagcatggataagaattcagactccattttcaagttgtgatgaggcggcggatgcagcatggataagaattcagactccattttcaagttgtgatgcggcggatgcagcatggataagaattcagactccattttcaagttgtgatcgggcggcggatgcagcatggataagaattcagactccattttcaagttgtgatcgggcggcggatgcagcatggataagaattcagactccattttcaagttgtgatcgggcggcggatgcagcatggataagaattcagactccattttcaagttgtgatcgggcggcggatgcagcatggataagaattcagactccattttcaagttgtgatcgggcggcggatgcagcatggataaaagctggcgtacgtgatgtgactataaaatagtatggctgacgtttttgtcaacatgaagagtcagcttgtttagtttttagtgatacattttacactgggttgagtttgtacaatcaaagttaagctcacaggctcagtggcattcatgatcattagtgtgtcacatgttacttttaaacagctgccacagtttttagtttttttctctcattgtattagtatctaggcagtcaggatcaggttaactgtcaggatcaggtttctcttgtcaagtccacaatcttggatggagcttctagatagccaagtaatagatggtgatgcctgtcccagaacagacaccaagctccatccatctgccctccacactctttcctcccattctgccagaggagccctaggatgaaggggcttaggcatgggaagaatgctctgggagaacagatgagactgaaggatgggaaggagcagaaacaaaggacaggtggcgaataaggaaggaagagatctgccatttgtgactcttcttaaggtcacagcaagaagccagtggggtcatggacagctaccatgggacagctactccccagcagctctgcctccttttctgcctcaaggaagcagggagaaatgtccagagcacggaaatagctcttcccagccaagcaccactccccagcaagcgtccccacctggtttgctttcatggctggcatttgacacagcctgatttatagaaactgagaaagtgaccgttctcaaattccctcttaacttgggatgcctcaaattcaattaaaaggagatgaacacagagtgggaagaacttggagaaataataaattcatatgaatgagtttcagagtgtgagtcaatcctattcaaacaccttattctggcctttgctgtcgggaactttccaccacagcctggtaatagatagaactcttgcttttatttgttacgaagccatgccactgagaaacaaggtggtttaggaaaggggaaaggcactagacacctgaaggcaaaagggtgtgtcactgagaaggggacatattaaggggaatttgaagtcgtttaagctctttcaaatgtaacaatttggcctagtcccattttatcttaatctgtgtgaactcagggaggtgtgcactatgacatatttcctgacctgctggctttcaaaggcatgtacctaggtggaaactccccacacccaccctaaaaacccctgccagttggagacttgggtttagcctcactttataaatgatgggcctctttgctcttatttcaggtttgattcatgtcagttttctgaaggcctcagtgtaatgcaagaggcgtacctgggcaccagaggtatagaatcaggcccacagtcctacctgcattataaggattagatgattgggtacacataaagcattttgactatgtctagcactcagcacatgcaaactctcatcattattgttcttgttattgttatcttcaataaagggcccaaatctcactcagccagcatggaaaagatgtttcccccattctgccaatgttaattctattgtttaaacaaatttttctgacatgggctgtcatttaaaccttttagatattgatgtacgctaagtggccttaataagaatggtagctgtcatttatattaatgggttgagaaaaaatatttaataccacattgtctcctcatgcgatctttggcaggtgttgtaggactcagatactaacttttagggacactttgaaaaaggtacattcttcttaattacaattatagcttcctctatccttaaatgaagctttgaatcctgtaggctctttgacatacttgctttttgtttgtgttaagtagaagtgtggctgccttgagatattacgtgggtaaccctaggctctgtctgcccttggcagtttctctacctgaccctttcacagactctaatgaaatttctatctgtcagaatagaatatgcacctttaccgttacataattttgcaatgacagtgctgtttatgttagcattgactctaatataagcagtgaaatattgtttggtttagcctctagcctagcatggaagaatggtgattttggttttaaaaaggttaaactgcatgtaaacactgtcattgctgccttttttactaacaaggtgaacttgagtcagaagatacttgaatctggttcacttagaactctattttgtcttataaatgaagagagtacttagcctgtagaataaatgttcttattgggggttgtaagcctttcccagttttaacggtgtcagcctggccattgtaatactcccaggaggcctggctcaaatgtctcctttcccaaggtcagtgcagaaagctctgctggtctcagagaggaggccatgcagattccctgtgccctgagtttacttctagcctaagaaggaagctgtcatttttttctcttcttctgctggtgccgtatctgttgacatttgtcagtgtgtgggtcaggctattgaaaacctctccttgaaggaaatggccatatttgtcctaagggaattttactgcttccttgatgggaaccagtggtgtcaagccctgagggctaaccccagctttggcctccatagcattcaggatgtttattagaggatgtccttgggatcaacacctgcagaagagaagaggaagaggcaagagcgtgcagagaaggcaagctggggtgcagcccatcaacagcctccactggccccagaaggaattggggaatcggaggggccttcagtgttgtctcccattggggcaggatgcaccagactttgatcctccttcacaattgcttattgggtgtcgggtgcctgggaagggtgtgacctcgggcgaggtggctctctgcgactcaggcaatcttagaaggggctgagagccaaagaccgtgtgttgacagtattcccagcctcctgggcagcaagtccctctttgaaggggacgttggttagggcacccagtgtccatcacagttcattcaccaaccacagaagaccatcataatggtagtttgggtgccactgagaacaccaagttggccaagttgggatcagcactcagaccacaagatctcttctgtaggattccagtatccgcgttgtggaaaatagattgaaaagcagcgcaagaagtgatacagaatataaaataattagtaggagagtttaacttaatgcaaaacatggaaacaaaaggaaaacaaaattttaaaataaatgacatttgtaacattaacatgctatagttacttggtgaaacaacagtacacaggtttagattttaaaggggggtgatttcattttgccctaatctgttgaatttggtaaatcttttgggtaagtctgtgttgaaagaagcagcatctacctttgaattgactgttctccatgcggtttttactttttaatgatggctgtttccagggacatgatttgactagtgttaacatctgagtccttctactgacgaatggttttatattgtgttctacaaatgctgagattcttttttttatattccagatattgatgaatgcagcaccattcctggaatctgtgaagggggtgaatgtacaaacacagtcagcagttacttttgcaaatgtccccctggtttttacacctctccagatggtaccagatgcataggtaggtttaatgacaaacagcatgcatggtttgtgtaagtcagttccataacaaacaactttctaaacaagcttgttaaggagcacatataatttatcaactgaggtaaaatgtacatttttggaaaaatgttaaacagttgactgccctcttaaagaacagaggcaccttgtggtcattttggagacgttttgcctcccataaaagagggatgatccaggagaccttacaggtatcttcagtctattaattaatgttgcagtcgtgcagcattaaaccttgaagccatcccaggtgtctctctctttttacccccaccttcagtcattccccagaacctatgttaatttggcctgaattttttcaataatctcttaattggtctccctgcttcttggcttctctacaatccatcttgtcagatttatcttcctaaaatagtgcttcgattaaataacactcttgctcaaaccctcggtagttttccattaggacttagaaattagtggttttcagtctgtgtccagtggatccttcaagtgtttcaaagccctccagggctgcagggattgcggagggcacagagaaaagggagagagctgagtggaaagggctcttgtccccccacactcccacacacattctaggcatagcaatttcactttatctgctgtgagtgttagacttccatgtcaggtatcaattaaatcaggggttctattgtttaaaaaatagatttggctgggcgcagtagctcacacctctaatcccagcactttgggaggccgaggcgggcagtttgcttcagtcaggtcaggagttcaagaccagcctggccaacatggtgaaaccctgtctctactaaaaatacaaaaatttgccaggcgtcgtggcgggcgcctgtaatcccagctactcaggaggctgaagcaggagaatcactggaagccaggacgtggaggttccagtgagctgagatcacgccactgcactccagcctgggcgatagaacgagacttcatctgaaaaaaaaaaaaatagatttgacagctgctggatttaataattgttaagacttctttaaaagtgcagtgttctagattaaaattcaagttccaaagtgcacagtctgatatttaaggattttaagagagcttcaaactacatgaggattaagacatatttacatatcagatggttcacattttaaaagttactttctttttatcaaatgtatccatactaactttttacaaaggaggaatggaagggaactaagattcatggatcacagggtatgaggtgttttatgtaaattatctgacttgatgttcatttcacagcagtattgtagatgggaagcagctgagattgagagaggttagataaataatggcccaatagtttaagtgggtagtgagagagggatctgggattccaccgtgacctgagtgcacagcccagatttccctcattttgccttctacccctcaactctggatgcagttcactctttcttgccagatccctaggcaagccccgtttcttctttgcaactctgttgtgcccataattagacacttgtcatacaaaatgatccaagtgacctttctgccttctggtgctcctatttccctccatggtaagcaacagagacccccaaaattatccgtagtgatgagaaaatacaaatagcccctgacagtataaacaaatccaaggcttgttcgtaagacagttgtttggaatgagtaggtctcaccaatagaaaacctcctatgtagatagtggtatgcagtatcttccgtgcacatttcttctaaccgtaaaattccaactgtcacctgctgccaccacattctgagactctcagacctcccagccccgagctccctttgtgttctaagctcttttagtattattttatttcttgttctgtgatcttcctgtggcatttgtaatattgcctgtagggttgtctttttatattgttgtgttctctctcttcgactcctaggagtcataaagatgtcctttccctagtttgagcctcacaactcctaactcctggttgtacacaaccatgttcgtgacaggttaggagaagcctgttgacaggctagacgacctgcaaacgcctatttaatccataatatatttgctttgatataatgtgatttctgggtcctgagaataagggccaagtgattcaaaaggggagaaaagagtgagatttcctcctccttttcgccagatgtcttggccagggcagatttaaaatggaaggtgtttgtggttccttctgtgtccctttatgtccccttagcttgagtcctgaaggtcttcaagttattctacagccaccccttaccctctgtacaaagtgacataccaccacaacggttccccgcccccagccacccttggtgtggcactgctgcctaacgaagtgaaaaacttcaggctgctgtgtcctggaggtcatttactccaaatggtttccaattttcagttttttcttcctttacttattagcctgtaggttttcattaaaattataagttatataaatgtgtatttttaacaaaggtgcttcttcagcaaaaaaataaattagaaaaattattattatatgtgcaggtgccatctgtaaatcagggactgccagtaacccaaacttgatttgtaattttttttacccccaacattcaccattttgatcaagagtttgtgatccattgatttaacatataagtcagccagatgggcaataacatggtatcatagttgatttgcaaaataatagacattagcccattaagcttttgtcattggcaactgtaggccctagttttgctctgaaagatagcccatgctgaaaattatatgtacaaattccataatttggtcaagtgtttacactgggttttgaccaccgaattcatttgaagctgggatataagccagttttgaatatctcttcccattctgaacagtctttggtttccatgccccaaatatttactaattcccaagtatataaagtattagtggttttaaggcattacaaattagaatgtaggaagttcaatttctctgccctcttgacgggggaggtaccacctgaggcttcacagagagcatacttgtctatactccctctccagccgtttatcctggaccaggctggaataaaacttgttctgcctctttggtgaaactattagtctgaccagaggtacaggaactggaaccacaaaaaaattctggaaagcacatttatactggctagtggttttaagtacttttcggaaataatcttgtatcctttaaaactgacccataattttcttttatggtttgtctaggttggttttagtcttcttcacttgatgttaataatttaaatgtttctaaattagccttgtttttattttatttcattttattaatttattgaaacctcaagacatgagggctttgtgttcttaagaatgatgtagatgataacaattacaggtatgaccctctttgagaaaacttgaaatttaatattcagacttacaggaaacccagggatggatttttggctatgaaagatctttgctttacaaaaggatttaacccttatattcctttaaatcagtggtccccaacctttttggcacaagggactagttttgtggaagacaatttttccatggactgggagaagaggatggtttcaggatgattcaagtacattacatttattgtgcactttattatacacaataaagtgtattatattaaattaattaaattaatacacaatattaatttattatacacaataaagtgtattaaattaattaatacaagttaatattacatattaaattgtaatatgtaatgaagtaattatacaactcaccataatgtagatcaatggaagccctgagcttgttttcctgcaattagatggtcccatctgagggtgatgggagacattggcagatcatcaggcattagattctcattgggaacacacaacctagaaccctcgcatgcgcagttcacaatagggttcaccatcctatgagaatctagtgctgccactgatctgacagaggcagggctcaggcagtaatgccagcaatggggagtggctataaatacagatgaagcttcactcattcacctgccgctcaccccctgctgtacagcccagttcctaacacgccacagaccagaactggggattggggcccctgggggttagagacccctgctttaaataacaagcatattgacgatattatttgcttttcaaaatttaattttatatgatctctgtagagatatagtttacttgaagagaggtacaccctcagcacatgtcaggcagtaaaagtgttttgcattttgcttacctgccttcactgtttcgtggtaatatctcaaaggcatatggagaagttaggttttcctatgccacaaactctttccgtaacccagagctgcgctgcagtgtgtcggatgtcatgacaattagacatgatgtaacccaataaaagtgatatagaaatgcgtcttaccatgttgctttgagaagacactttctgccaaaaacaacaacaaaatccttctagagctattgtatcctataggactaagaacttggaatcaagggccattttgaagttataaataactagtaccttataaaatctgttagggccctaagacaaaaggaaatcttgattaataagcattggatctaaatgcaaagtgactcattcttcaaaaataacaacaacaacaacaaaaacttatgtctgactctcacagttgcagactggaaaataagaaagatcttttagaaatgtagactaaatgttgttttaaaatagatttacatattttcctaaaatggctcgaattaagcagtttgaaaccagggacaacccagtctctcttcagcatagagacatgtctttataaataataaactgtcactgctagtgattttcttagtctctcttttcctatggcacacatggttttaatcactcgttcccaccttgggtatggaatgtgggacttcagccaagtgcactagcacacaggggcaaaaggtgtgagaccagggatttctgactgagcactgttcctgtgcagcgctcgcagcttcccttccggggggcagaggtgtgagttaatcctgccgtagccccagtgtgaagtatggagctgctcgggcaggggagtgttgttacaagtattatctcagcgatgtgtgtgtgtgtatgtgtttctttgtcctcagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccggtaagagcccttccagttatctgcagaatatcccatcccagccctcacaagcccagtggcaatgtgcatgatgcagatgtaatggaaacttgggtaaatgagtagtctccaggaaatataagagatgacgtccagggaaatttccctagaaaatgcacaggaaaaaaaaaggggtctgtacaaagagtactgttttcaggtactgctttttacttagctggcttattactactaaacagaaaccttttggggaagtacttattctcattttagtacttaatggctctcatggagtactcaaaagctcagtagagtaaaactcagctttcagaatttttcaggtaagttgttcaggagacacatttcctttttcctaacattggactctttccttcctgctaagtcctgcttgttttttttttccttcacagtatctcttttatctgtccatttttttgtttctattagaagcgtattttctctagtctggactgttccagtagtctcctaactagtctctgaaatccaccattgccatgtacctttcccaaagtatgagtcagtgaagttcagtttaaaaaattgtgtctaggggagaaaaaggagacaccttttgactaattgagcctatttcaaaacaccatgttgtacacaatgaatgcatacaatttttattcattagtttaaaaatacataactaaacaaatacataaatacagcacactttcgttagtcgagaaagatgtccaaaaatatttccccaggatgaactcaggcaatatttagtggccaattcactccatttcttgcaaagaacatttgctacttagcacagtatttagagtcccaaatctaatcccagttcatctttttaattcttgttctttatagtagtttaaattatatgattgagttttcattgcacccaatccgagcatttctgaattcaagttggcttttttttctaaaacttcttgccagttcaggctctttctccctactcctgccatccttgcctgttatatatcctcttttcttgttaaggatctgctcaaacatgacctaatccatgaatatcccgaggtacctgcagctggaagtgctcccttcttccttgtgctcctgtggttctggctggtactatcactatggcatgagtgccatatgtgtgttcacatcttgctcttttactggttgatcaatctcattaggaaatctcattcattattgtagtctcatatttctcatgctttttacacttccatagtatttagcaaaatcttgcttataggaggcattcaaatacagagagcaacttattaggcaacatctttcccaccaattgagcatatttcaaaacatcacgttgtgcacaatgaatatatacaatttttacttgtcaattaaaatactaatacataaataaacaaatacatagatgaagtttaccttcctgagtccagtaggggaccatttagtagatcactgtttagaagcacatgacttcctactaagacatggcttaggtaccaggagaatggcttttaaaatgcatatgttaacttaggaatcagcagctttgatgtggattccttcctgtgttgaggctttgaatagagaagaggactagagcaggtttaggtgcctgcaggaagacctactttgggacagttggagcagaagaccaggttcctgtgtgtggctttacagggagctgtcctcccaggtataccactgagagatgcacagccctcagaggccttgggcaaaacagatttatagagcaaaataacttgcaggtaggtttttgtttgtccaaatgttccagtactggtgctacagagatctgggctcttacagagagtgatgcaggaaggattttagattggccagcttttcactctttaaaaaataaatcagcatcatcttgggttaagtggagataggaaagatggacatcagcttaacaaaattagccccacgttgctgatcctgaatgtaaaggggcaatgagaagattactaaatctgtaaaaaataggaagaaatatcagattcagtctgatacagtttcctagagaggttaagatgaatttaatggcattcttaaagtaaaatacccacctaattagcagaaatgctgataagctattaaatttcttttatataaattcaaaaagtcttaaaaagaaaggccgaattggtacctacaaatgcttggaagcaaagtgagttccttaatgtaactgtcatttaataaaattaacacatagttaatgaattcctgttatgtgcaatttgcagggcaaggctgagagtgggaactagtcatgagttagagatgatccctgacttcacagactacacagtcttagtggtgggaatttggtgagagcaggttcccagggaatggtggatatggcacgtacagatgataaatctataggaagaatcactgttggttgacaaacaggattgagacatcttgagtcagggaagcatgaacaacatagaattcctttacaaatacattcaagtacgtcagtatctctgtaatttgaaattccagtgaaatcgtaattaaaatgctgtaagagaattatctgaaaacataaacttgacctgagatggaaatgtcaaatatgaatgaagaaattttagaaatggaccagaaagtaccaacagtactttcctatttaacctcatgtaaattggcagaatgtcccgtgaggttgaaatatgaatgcatttcagtaagacctattactgtctgaaaataagttaaattttagtctgtaaggaaaagaaaaatattagtctaatttctattaatggctgaaactagcatagaaggtatccatgagaaaatcactgtacaactgtgaaaataaaattaccaaaatcctagcaaaagaggaaaaaaatgaaatttaaaagtcacataggttacttatagaagggaactatgaaaaaacatggctatttgtaggcaacatgaaaataaataaaataaatacatccttggaaacctggatactgcttaaaaacacctttttggaagcccagaacaaatgtgtggaaacctaaagatgatttatttgataaagacctgacactgtgaaaaatagtaatcatcctaaaaatgtagaatcatagggaagcagatgatgaagtcaggatgtcctcattcagagggtcactatgcagcattcatacccgacccacaccccttggtgtttctcctcccttatgggccacttctccattgatattgctttcttttacgaatcagtattcttcagggttctgtctttgcactcccttctcttccccttccacaccactcttacatgagctcatccatccccatggctttgagtatcacctctctgtactgatgactctgaaactcacgtctagccttgattcgtctaagcttcacactgtcttttacaactgcgaagtgatagctccacttggatgtctgatatctcaaaactcctatgttcaaaatggaacttggtttctacccaccaaatctgctatcaccatgatttttcccgtccaggcaagggcaccaacattcacccaattgctcaaccagaaaactaggagtcattcttgacttcttgtgtcctgagctctgacacttactacttcactgagcactatacatttatctcaaaaatctacttcactgaacactacacatttatctctaaaatgtgcttcagatttgtccacttctgtccgattcaatcactgactcccccatccggacatcatcatctcccccttggtcttctgcaacagccttgcctccccgcagtaatgttcttcatatgttgtaattgtaagcatgatcttctgaaaatggtcatctgatcatgtcccacccccgttgaagacatccagtggttttgcactgcgcataaaataaaattcaaattttttaatgtattctgtagagccctgtggaatccacaggtgggactggatggagaaagtagtacttttatgttttccatgaggtgaattttgatacagataaagactctgaggttttgggaggaacatggttttggatttgaattattgttccagagtggttgctgctgcaggtattaaaaatgggaatccagtcagttggttctttttcttttctccagttgacctgtgaattttgaggatcaattttattcaaaaatatctttaaaaaaataaggatgacttctgtgggcctatgatcataagctacagctcagctgttgtgttttgttttgttgtgtttttctagaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagtaagaattcaaaaatcatctagttatttttcttgcattgttcaagttaacatttttttattatttatttatgctactttagtcattaaataagtttgtaaattgttatattaatttttggtttacataatgttatctatatctatatcatatgtatgtctcaattttcctattgcatagagaaaaacgggaggcttcctattctccagagattaatgtccttttgttattggtgttttcaggcaactatgggagagttatgggcgatagttaaatctgattcacagaaaggattaatagaggaggtataatattagactttaggttacagagcttgcaaggcagttttataagtagttcaataccaatatctctctgcctttgttatttctgcaaactagaggtttgagagtgaggtggtgaagagggcagagaaaagcaggctgcagctgggttgtgagctccccagtgctcacagtgcaatgtgatctctgttggcagggtggaaatatgctctgttgtcaccagacgacctttgcccaaagagtatcctctttcctttctgattcaacatcttgttcattattgtcagattaagtactgatgaaagataccatagttaaaataattttaatggggcttaatgttcttctaggggtgctgccagtaaacgttactgattactgccagttggtccgctatctctgtcaaaatggacgctgcattccaactcctgggagttaccggtgtgagtgcaacaaagggttccagctggacctccgtggggagtgtattggtacgtgatccatcctaggttggcaccaagggtctgttgtaattctgttccttgactctactggttttctattgctgctgtaacaacttaccccaaacttggtggcttaatacaatacaaatttaaattatctttcagctctgtaggttagtagtccaacagaagtcttactgggctaacatccaggtgttgggagggctgtcttccttttggtggctcttgggaggaatccatctctttgcctttttcagctactagcagctgcctgtgtccttagctcatgaccccttcctccattttcaaagccagcagtgttgcatcttcaaatctctttgtctctctctggctctctcttgcaattccctcttccacatttaaggatatttgtgactgcatttggccacctgtataatccaggagactctccatctcaagatcactgattagctaccttaattccatctacaactttaattctcctttgctagctaaacatatccataggttctgggaattaagacatgagcatatttgggaggtcattattctgcctattaaagttacttttaactttcattgtaaaagatactcaaatcatttctggtaactccaatttaagacaccctaccaaaagccctaccattaaaagaaagcgttaaaaatatccccaaattatggaattttgcacattatactagtctaaatgtgtagcttaccaactctcttagactagttattttaaatggaagaaagaaagtttaaattgctgatgaggcatttaagctggtgaagggaggaaatgtaatgaaagaataatcaatttttggattggataagaacactcagctcctatcaacttgtttttaaaataagttcacctcttagttctgttatgaattctacttttataattataaatttatgatttgtcagaaatgatgagttcttactttcccaaactatttaatttcctgatgatatgaacaccccttctagaggtcatccagagctgagtagaagtgggaacatctaactcagggttgcggaatgtgaggtcaaatctgtatctggcactaagaagcatgtggacaagtgggttatctttgctaaattttagcttcctcttgtttacaagtagggtcatataaaccagtttatctctaaatgtactgataattctaagtgactgtaaaactagtgtgagcctgtgtattgaacacatctggggatgggggagactctgtggtgattgagaactgccctttaaacaacagttgcttcatgttttgttctaacattttagtggaactcagcagggaatgcttggatatggttagaccttctttttattggaaaaaaacagagcttcaagagatactcggaatcctatccagaagccacttctgaaatgttagtctgtttggtcctcttagatcagactcaaggaagaaaaaatgtttattagatcagattgttgagttgctacatgtttggaatttttctctgcaaaatgacacatgaaaataatacactttaactgctcaaccagtcttcaaatggctaatgacatattgtagtggaaagaaaaaagatccttttattatgttatttatttctcaaaaggaaaatgttttatatgtataaaaggaacccagaaagtcttagaattatgaggtattgctatgtaattttgcactaaaatacattgtgctttgcagatgttgatgaatgtgagaaaaacccctgtgctggtggtgagtgtattaacaaccagggttcgtacacctgtcagtgccgagctggatatcagagcacactcacgcggacagaatgccgaggtatggtcctggctcctgacgtggaatgtgggacatatatgctaactgggggttggcttcaaaggagttccatggagtttaaataacccatgccggaagagactaatatagtcccgtggcttttttgaacttagttccacctattgtcattctgaaagacagtgtcataaaatctggcaagcattgaagttattttataagatgcgtctatgcctgaaggaaaatcttattttcagtattgttgtctcgtcactattattgcctcttaagttttcatctgagaagtagagagtggaattgtcctttatgacacagcaactgaggaaaatttcagttgaaattatgtgcaattaatttcttaatggaaagttctaaaagatagggatgtcactctaagcccttgctgctttttagtgtggtcagcaacagcatctcctagagctgcttggaaaggcagaatctcaggttccaccacagacatactattgcagaatctatattttaacaagatcccccagcaatctgtatgtacattgaagtttgagaagcactgctataaatgtcccctcataaaaaatttcccatcaggtttattaactaatttattaagccacccaatatgccttttattaaatgactcttatgtactgagtttctaaaacagaaataaataagatacaatgatcactgtcagggagcccaaacatctatctccatctctatctctaaattaagcacaaaatgaactgtatcattaattcagtaaagacagaaaaaaaaaacaggcaaatactctgttaaagttaaataaaagggcccatcaatgatagactggataaagaaaatgtagtacatgtacaccatggaatattatgcagccataaaaaagaatgagatcatgtccgttgcagggacatggatggagccggaggtcattataattagtaaactaacataggaacagaaaaccaaatactgcatgttctcacttttaagtgggagctaaatggtgacacatggacacatagaagggaccaacacacaccggggcctattggagggtggagggttggaggagggagaggatcaggaaaaataaccaatgggtagtaggcttaatacctgggtaatgaaataatctgtacaacaaacccccatgacagaagtttacctatttaacaaacctgcacatgtatccctaaacttaaaagttttttaaaagttaagtaaaagatagcgaggtttatatcactttagaaaattggtagccattgacaagagttaatcttatttgcctcttttagcaaaagctcttcatgagttgaagacatatagaagttttaatttttatcagtgaactggcttcaaaatttatgaattttgttctcacgtagagatttcttgccaccagtgtattttagtgcactacatataaatgaccattttaagcagaaaaaaactggagcaaggactttgaactcactaacatttctattaattagttataaatatggataggttgaacacgtaactgagttgagaaccttcttaatattatgactattgtttaatataattaacatgtacaaatagcatactaggcattttgcaataacagaaaataaaatgaaatcaatgtccagagactgcactgttaaataagcaaagagaggtggttattgagagcactcagctggggcaaggaccagccagtataaactcatgtatgtggttgttatcaatctgagacttagtattggagactgaggatgacctgaatacttaaagcactgccttctttaagagctagcactaaggttatcctgaaaataagaagttgagaacgtgctcacattattttgctgatgaaagttgccacagaatggtccaaaaggctgtgcacataactgggaagtaagtgaggggccgagtagaaggggatagaaggatgggcagaaacacagtagaggagaactttgaatgacaagctttaaatttgtcttatagggcaatggggaaccccatgacattctgaaattgaggaagagagaaaaatatgaactttttatcctgtttattttaaccttgggcctcaaaaaattatgggatccttaaaaaaaaaaagtctgctcaagaatatgtggtttttaccatttttttttgagtgtggagcaagtctgatttttagcaaggattaagaaataaacgagagagaaaaagatcgtaggttgttggcacaaagatcagacagaagaaaagcccagactgcctcagctcgtccaatgacttgtgtggaaaccactgcaggatctgcccagaaagaaagtgcatctgagggccaaccacaagacaccacacagacacagggtaaacagtcagagtaactgacatgccatgaacgcacgtgctcattgttcaggggatatttagggcacttatactcagacaaatgtgacctcaactctgcatagataggaatgctcgcatccaactccacatagtttcttggtccctgtcttctgggaataagccctggaagtgattgtgtgcctgtgtagacaaagaggtttgtgttcatcctctttgatgtttatccaggtttgtagcttctagaaactgagagaaacagataatccagggaaccatgctatccactttgggtagattgttaatatttaagggagaaatcagatacaggttgtttcagttattgttattttaacacttccgtgtcaagctctgttgtgtaccttggcataatattaaccacaatagaaaaaaaggaaaaataccctcatagaatcaatattttatttggttggtagaatactcataaagttgttttttaaaagactaagaatctatcagcagtaaccctgcacgtaaaccagaattggtataaggaagatggacattttagagatgtgattgacggttttcaggcagaattaaggtgattgtttaaaaaaatagcatatgttgtattgttctgagatagctataaaatatgtcttttaaaattatatgtttaaagatgccagccaaatttcagtataaatagtgatttatactggttaaatagatgtgcttggaaaatggtgaagaagaatctattttgtttacagacttcggatttaaggagtcttattagaaattagagttacatctaatgccattatacaggttttttatcatgtcttttcaactctgataaccctaaatatcacattatttgataaccaatttatgttggagaatattattaagtaattaaaaccaaaagccaagatcatgagtttgcaaatggagggagggggaaataaaataattttaactcccctaaataaagctatttcttctttttaaactttgattttagacattgatgagtgtttacagaatggccggatctgcaataatggacgctgcatcaacacagatggcagttttcattgcgtgtgtaatgcgggctttcatgttacacgagatgggaagaactgtgaaggtaataatagtatactaatgttagtcctctccttccattgcagtttcaatatcaggggtctttaacaagaccaaataatgagtgaaatgtcaaagtatcaaatatgttttatatattttatctcaaaaggaagcctaattttccatgatattcatttcttaatttacatttgtgtgaatcaaataacattttaatatgctaggagagcttgccatttaaagatccctggtgtgatgaaacttctgtggcacaatttcatactttctaattttttacaatcagaatttgtacattttttaaaaataggacacacctaagtctgtgtattatctagccgtttataatctttttgtttaaagtgtctgcctagtaataaaatgctactaatcagtatctgaaatatatatctaaaatagatataatgtaaaaatacatgttatgtatattttctatatatgtaatatgtgtatatatattatgtatatatgtatttctgaatatgtaatagataatattcataaaatacatatttaaatataaataatatatatctaaaatataaataatatatatttaaaatacattatatatgtctaatatatatattatatatatctaaaatatgtatatataataaatcactttggtctttctaaagcctgtaagtgaaaacactgtgtctaaaagagcaagtgcctcccaagacagctttaatatcaaataaaataacatagtgatgaatttaaagaaccatccccaatgtttaagggatcttaaaggttcactgccacagctataatccatagttgagccatgtattctaaaagtccactttttacctgcccctatttaaaattgcttcaaactacaagttatcttctggttttcatctttaaaagaattaggatgtagcctaaatacatttcaaattccactaatcttagttttgacttatgttcatattcagagcattagaagtaatatgaatctgtgaaataaatatacccactaggctattagcacatttttcagtttgtaaactattattcctaaaaaggatcctgataacttctatggagtcaaattttataaatagatatacctatacatctagccctagagtttgcatgcacatgccaaaactcaagaacttgagatatgtatttcatatgtcccatcttctccttccttagatgatcttatttggatgaaagttagccttaggctgtaataacaaaaagaaagaaatacgaagaaacagaattattttcatccagattggtttccttcgtaagcttactcttctggtcataagaaaatgtatgttttgtattttcagatatggatgaatgcagcataaggaacatgtgccttaatggaatgtgtatcaatgaagatggcagttttaaatgtatttgcaaacctggattccagctggcatcagatggacgttattgcaaaggttcgtgctataaaaccctagatcatgttcttcacgtgccttttctcctccttatgttgtttagaggtactacctttctttactgattctccccacttaaagtaccttgaattttggtttgggaaacctgactgaaactccttcttaaatccagccatccaaagagctacagtttatgcccagaagactattgttatttcagaaagggtatttgaggtcttctcaaaggagtcaaaagctatgtagcaaataaataatccaaactgcctattggtcttccaacagatgtgggcattgttctcaagaagctgagttctacctcttctttccagttagggaataatggtggttaggcttcttggtggctgttatttgccacctcttacatctttacctggacagaatagtgtagactgttatttgcaatgatctcttcctcataatttcctctaggcatcttaagacacagaaattttttttaaggataatttatttcggctttatcaagttacataagcaagaagggaaacaggattaagcagaataaataaacaaccaagaaccatttttttagtttggtaaaccattttgaaataatctcattgccccaggtatcgaagcaaaaatgaggatttttatttttgctgttgagaattggggtcctaagaaaagttactggagacaaatttgtgcttagtgtctcctgtcttatgtagggatcagtgattactgcacttggtccaggatctgagttggaaccagacttcttaaagaacctcatactcaaagcaggtccagaaaatctgctaaaatgctgcacttagagcttctgggcatagtttcagatgcagaagtgtagagggtcaagctattcaaggtagaggaaagcagaataaagtcctatggtgcctcttctctgtgtgcccctagtggacagctttggtaaacgtgttatggaagaaagccttgtattaagtccttggcaagatgtgcattttctccaggcttaaaagaacttcaagcccttggttgtttacctacattctctatgaccttcacatcaatggctcttaatattgtgcaaacctgtcttcccagcaagagaaaacagttgggtgtttcaaatttgaaggaggaaggtggtttctgtacttttgagccctgtgctaggaggaacttatatgagaagacaggattaacacatagaaatattctacagtgtaaaatagcataaaacaaagtgccaaattgtgcaaatttagcactgtacaagtaaaaaagaaaagggaagagaatgattgctggaatatttggaattaggcttccaaaaaaaaataatagaaagagatatgaaagcccctttgtgagcagacctaggagaatacataatcttcttgatgatacacagagcacactaagattcactcttcgtgcctctaggctcctgctgacccaggccacagcgtcccaacattaagtatggccaatagataatgctgtgacctcatagatgaaaccaggtttggcaaccattggcaaccagtgaaatagtatcctatcaataaattggttgttctattaatttgaaagtgctgatgatatggatggtttgttctgactttagcattctggcttaaggatctgagagagagagagagagagctccacagctctgtattattatcaatgtcttatttttttctagcttatagagcatagagtacacacactgtaataagactaaaggatgaaaaaagaaattaatcccatgtatactggatttcttcctttttataatttttgtctttatgccatagggtaagattttctcctagccctgagcacttagttctgagcccacaaagatgtgactgttcaaagctgaatcatcaatgctaattcagtctccacagttaactcatctgatcaacaacatggcttctctgttcactctctgaaagttgaagccactaactttgaccaaggttacctccctttggatctaccttacatctccgttcttattaaaaaccctttgtgttacctttcaggttgtagtctccacgttttgctgtgtgtcacaatttgaataaaaagttgaccagaataactaaccaatttgagttcctgtatttaaatataactgctgtttcaaatacaatctgtacacagaaccttggaccacccgaatatattttgtgccaaacaacacaagctaagtaaaacacgaaggtgttttactctcaatttgcctttttaaggtcaggagaaagttaatagtcccatacactagttgtatattataaaaggagttgttataaaatcatttgcttttttctttttctttttttttctaagacacagtctcactctgtctcccaggctggatggagtgcagtggcacaatctcagctcactgcaacctctgcttcctgggttcaagtaattcttgcgcctcagcctcccaagttgctgggattatagccgcatgccatcatgcccagctgatttttgtatttttagtagagatggagtttccccatgttggccaggctgatcttgaactcctggcctcaagtgatctgcccaccttagcctcccaaagtgctgggatcacaagtgtgagccactgcacctggcctaaaatcatttacttctaagtgttgtatgttttccaaaccacaattttggtgccttttgtacttccccatattaaggggggaaaaaaccctctgctattattaatatgtgtccgataaagtcttttaccagacctccttaagtatacacataaaataccataaagtgtttgtaaagtttaagaaagatttttctttgctgggttccaactgcatacagtgctgttattggccaagaatggtcatgaaaataatctatattcattttctgttctttttctgtggtgttccatcaaggctttagttgtatatcctttaattttaggcgaattttcccagagagccaagacatgggtgatactagaagtgatgccagtctgggtgatgaataccaaaaggaaagtcttcctgtagtttactattaccctagatttctgagagccctggaagagctaccctggttatacatttcacaaaaccctttgtcttttagcagccattgttctccttcctctgattctgtttttgcctttgtgattattttggatacaaaaatctcttgggagaatatattaaagttactttttatggaaaataagttccaacagttgatttctcttgattttgttactgttctttcaaaggaaaatgagaatgccatttgagcttttgttgctgatgctgcatattatttcctatcttccccattttcaagggttaaaacataattgtcaacatgttataattttagataaatgtcacttcatttttaataagtgcctttctctgccacagacattaacgagtgtgaaacccctgggatctgcatgaatgggcgttgcgtcaacactgatggctcctacagatgtgaatgcttccctggactggctgtgggtctggatggccgtgtgtgtgttggtaagaaaacatcatggctaaccttatgagagaggttcagcctctgtcactcaataaagcccaatggtaacaaacgctctctactgtagcagataagatataaagaatatttgcagagcaacaaaccaacagggtcagttctctttttgtgtaaattgaacattaatttgaggattagaaagatgagctaagtgaaaagcaagggaatccccacctatccttcccccttttcttccctaatcccgtagctgtcttcagttttctccaggcctcctttgttgatattggtcattgaaattgatgtgcatatgctattatctcatgatgaacattttaatagagaattgatgtccatgggcagtatagaatgcaaaggagaatatggataatccagaaacctgtatgatagtagttttatgaggctttataaaaagtatgagacttgttgaaaaattgataccaattttatccagattatttttaagaaaggtactcagtaagccatttgaattggaaaaggatagggcatagcaggagactgtcttcctggtggtaaagataacacagcttagttgaccaacatctacatatttatataacgaaccttttacagattaaactttctcctttttggaaagtatacctaattcagacattcagtaattgcgtgtttattttgggataggccgcatttctaataaaggtcttatttagcaggatgtgagattcaacattcatccatcattaattcaacatttattaagtgcctgctctgcacaggcccgagaaagacaaaataagtgagatataattccagcattgaagggcctcacattttagtaaaccatgatactccctagaaaactgaagcaatctggccattgatttccagtgcttagaagctgaacgtgttttgtttttctgtttttgtttattttttcttcaaatggagccccgatatcagaggcattccctgtgagttacaccagggatgatggataaataaagccctcttcaactttgacttggggggttctcatctgtttgaagtgacagtgtgatgacagatgcttcttcctgtttagacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcaggtatgtggtatcatggagatgccctcgtactgccagccttctgccaccattgaggtctttgcatttgtggaattcacagggaagatgacattttgctctccaggtacgccatgtgccttcttggggtcttggcagaggccagccagtgtctagtcacaggtacttatctaagcctcataattatttggaataggcattgcatttgtgcctctcgtataaactctcctacctcaataatactcaagctgtttgcaatacatgcaccttgccttgttttctaaagttgtttcatgatgtttgcattttgcagaaactattataaaagcagacttttacacagcgtaaaagtaaataactgtcatattacttgactatttccactagctttccaaaaggccatttgtaaattttgtttacatcccacgtattgattttggtgtggttttctttttctttcttcttcttcttcttcttttttttttttttttttgagatggagtctcgccctgttgcccaggctggagtgcagtggcgcgatctcagctcactgccacctccgcctcccgggttcaagtgattctctgcctcaaactcctgagtagctgggattacacgtgtgcgccaccacgcccggctaatttttgtatttttagtagagacgaggtttcaccatattggccaggctggtcttgaactcctgacctcgtgatccacctgcctcggcctcccaaagtgctgggattacaggtgtgagccaccgcgcccggaccggtgtggttttctttaatgatttgatttaacctgagagaaaaaactatttttctccagttgaagtgacatggcctaatgaaaagagaactggatagcgagtcagaattctcttcctccatcaacaggcagccaaattacttaatcaggggatttagttatttgtgtattttgcttatttctgaattttcctcacctacttttcaaaaggatttgaggtggcttatattaataaacataattataaaatagaataatgcagacaagctatccttagacacttcatctacaaaatgagttgccttagataatccaaaaggtcctgtccagttgtaaattatttctatttataaaacaagaatagattactgaaattaaaacaatgttctgccagtatttaaacacaattttaaggtagcttggcagtggacctctaatgtcctaaaataaagttagacctaatattgaaaatatgtagctctggttggttgtttttacatataggatttagtcagtttatttctgccctaaaggaaacaaattaaagagtaaatcataattttaaaagatttgttattttaaaaatgatagtatttgaaagtaacagttggaaattaaaatacactatgaaaagttagagaaagttaaatggaagactttaaaagaaatggggggccaggcatggtgcctcacacctgtaatcccagcactatgggaggccaaggcaggtgtatcacttgaggttaggagttcaagaccagcttggctgacatggtgaaatctcatctctactaaaaatacaaacgaacaaacaaacaaacaaaaagtcatgcgtggtggtgcgcgcctataaccccagctactcgggaggctgaggcaggagaatcacttgaatccaggaggtggaggtttcagtgagccaagatagcaccactgttctccagcgtgggtgacagagcgagactctgtctcaataaagaaagaaaaaggaaatgagggatgcctatttaaagaaaaaaactgctctggctaatgacttcacccggtgaataatatagaaattatcattttatgtatgatcaccaatcagttcaatatgtgtttataatacttttattatatacaaataccattctgttgaagacatttgcctataactttatagttgtatattattaatatcatccttttgtgtgttactttaacttttcaaagtactttacttacctactttgaatttgcaatacagacaagtatcatgaaagctggcacacaagagtacaggtgacttgttcacatgttgaatgattggaagagccaagatttagaatccaggaaccttggtgcatatagttatttgcctttgtattttcctctggaccaagtgcacttccaaagaattcttaaaatccacagggaaattatgtgggtttataaaaaggtgaccaaaagaccagatttctttaagcagttgtcttagtccagtttttgttgcagtaacagaaaaccacagattgagtaatttataaagaaaatgcattaatttctcccagttctggagcctgggaagtccaatatcaaggtgccagcatctgtggggggccttcttgccaagtcacttcacagctgaaagtggaagggcaacagagcatgcaggagtgagagaaagctagagaggactgaatgtgcttttataacaaagtcactctcatgataactaactcactcccataataatgacattaatccattcatgagggtagagccttcacgacctaatcacctcttattaggcctcacctcccagcattactattgaattggggatgaagtttccagcacatgaactttggaggacacattcaaaccaaagcaacagtaaagcttaaagagagttaaatgtaaggcccggttccactaacttttgtcttatatttgaatgaatttacccaaaaaagggtccacacatggaagtagtttcattcatttggtttctccacctctttggtcatgaaccatccgaatgtaggatatccctcatttcaagaatggggggtaggctgtttaaagtactgaaaatattcaaaaggaatgtcttcagtcagttgagggagagactccaaatatacaaaatctgaagttcatctttgtggtctgcaagtcaggcaagctacatatgaagctgtttctcactggttgctggagctgattcacattgttcagcaagccctcttgtgtcctcagccttctgacaatgacatttcacagacatggatcagttaaacccacgggagtgtaattggtcagttaaacccacaggagggtaattcggggggattttctcatggatccctcatgtcactgtctccatggcactacgcggagttagctcatcaacacctacccctcactatgtgtttataatacttttatttacttatttttttattcagggcctgagctgtgcacagtacacgttcaatcattaaacatgtaatgttaattctgtacagccaccaggtgaaatgggagttgtcattccaaatttatgggagaagaaactaacagaggaaaagggctgcttccaaaactcccagcaattagcgttgtcatcggtattaaaacccatgcttatttgaactcactacaaaaaatggtctagtaccagatcctgcctaaatggaaaacaatggtgacaataatttgcttccatttaggccaaacatcagcaaaattgtcattatctctaaaagtcctttttataaaactggtatgattttggttttcttgttttattacttacagtatttcatgcatattttagctttttgctgatacagcagaataaaaaagatgaatttctttttgttcccacacctggctttcaaacacaccttcccatctgttgtttttttgaccccttctaagatggtttgaaaattaaatcatcactgctttctcaaattcacatttgttagaagacatgataatctttggttgtataactcatttacctccaatgtcatcaggatgcaattctctggcatgcaggggataggaactatttgcttcagcagtgaggtgcagtcagcctctacaataagccccagccctgatatccagttctccttccacttaagcacagatgatttacatatgaccatgagactgtgtttgccagaaaccattggcaacttaaggggacactagtttcctttccttggatagtgtgattccagttagttctacattttcatcattcactcttatgttaagtattgttggaattgtatataaaacatggtattaattttaagaaatagaaatttgattctatctcaaatttggggacatattctttatacttcagttttttcaatatgatctcacagttttaacattaagcaatactttctctatggatataccatagagaatgaatccagtatcctgatacatattaactttaaaaatacacttaaatgcaagagtaggtattctgttgttgctcttgtgagaggaggctagagaatttgcagagagaaatgaggaaatgttaagaaccaattgtactgaaaaaacagctagcactgagaaacaaaattatccccaagatggtgggagaaagttttattaacagttaagaaaccacattttaacaggcacatttcaccgtaagtgtaaagtgttccctggtgaacaaaatcaagttataggaaaaacaccttttccgaaagggctttgcacaaggaattgctataacttgcctgtatccttaaaagttgttttccttgatgatgtgtagcctttaaaatgggagcctggtgtaaaggtgactccctggggagatacctccttttccgttaccacttaagtttggttctactcactttggaggaaatgatgtgtgcaaaaccaagggcaggatctacctgttctgcaaacaagggaatcatttactatctgttaatttattgcagcggaatatcaggcactctgcagcagtgggccaggaatgacgtcagcaggcagtggtaaggattcctttcaaaatttactaccttcagtatgtgcagaggcagcatcaggctttcttgtgggtttccagttgatccctttacactagtctggcctgactccctctctggccatcactgtgccatgtatctgggatgctcagaagccttcagtggcagagcagccggggcactgtgggctctaggatttctgggtgtggctgtgggacttggccactgagggggtcaggtgctctctcagtgtggttgatgggtgctcgcagatgatgtgtaatgacttttgttgctcatgcttgagaaggggcagcctgactctcttgtggatcttccactatcaagtaccactcgggatgatgggctagttgaaccattctccatctgcattctgaaggattctgaactgttaagtgctcagtattataaaatggcaatagagagcagtgacaacaattaactgagttagaagagaatgaaatatttagctagagaaatattggtgccatgcaaggaattaaagttaaaaaggagaattggaacaagtatgacaataggtgacaagaaagaggaagggattattttattaatataaagctacatagtttgattcagggagatctgaaagaacatggactggctgaattgattgtcagttcattcagtatgattagtttcatcattgtgcgtgaatgaaaatgtggaggggatatttagaggaggaaagaggagaggtaaggaaacttataacgaataaggagttaatggggaataagtaagttgtgatagggacttggaagaaaaaaaaaaagtcaaccctaatttatagaagagtcaggcaccaggatttgagactatccattcactggttgtcattctgcacctgccttgactatgagattccctcctcagttgtgagggtacagaagagggagggccccacctcaggtgggcagagcaacggaggctttttcagagcatgtggtgttggagctggcttttgacctgtaaataggcctgctccaagcattcctgacacagagtgaagagggcattatatgttcatagaagagtgtgaagtctgggataagtaaacaaagaatttatattttagttttatcttgaggatattgttgaacctatgaaagtttgaaccatgagaacgatataataccttgtttttaggatggtaagaatggttgcagtgtagagtagtgcagggtagatggaagaaagaggggctggtggtagggagaccagttgtcgggacttgggatctgctgtcgatccatttttccatcttggtgcttggactaggagaagtccaggaggtctccttcagcttgattaaggattggttatcttgtagttccagctgagatgcaaagttcctctcaggaacttgtgggagaaagattggactcagaatatcttacagtgagaaaaagagacagagtgttctctttccagtgaaatcgatttttttcctcctgtagctcctaaggtcattacatttattgtagtgttatatttttaacaattcattcagtatttattttataatcttaattgattttgaccttttttgtggtgcagatataaatgaatgtgcactagatcctgatatttgcccaaatggaatctgtgaaaaccttcgtgggacctataaatgtatatgcaattcaggatatgaagtggattcaactgggaaaaactgcgttggtgagaagttttacccattttctgaaacattgcctgcataatgcattccttctttcattgctgggagaaaactgcctttgagtagcttagaggactgggcaaatggacactttatacttcggatgttagcacagcatatacatatctttagtaacaaaaatttacatcactgaatcttcacagtttatgaataacgatgtatcagattcactccttgaaatgatttgctccttaaaataatgatgtatcagatttcactccttcaaagagaagctccttagatataagatgcagagattctgagccattctcatgtgactacaaagtcaaccttgattttactgagagagaagcagctcttctcccaaccatttattagacttaatcagaaaaaaacacagcttattttcaggaatacctgctctcttaaagttgggttttgcttcagacaggcatattattcagctaaaagcaagcagttttcctgaggtccctgaatcatgaagctaaattccccatgacaatcataaatgctacagattactttgtactttataatcatacctggagacaatttgaattattataaggaagaaacacccattctggaactaacacatttcaaagttggaccatactttctaaatatttatttagttccttaaatcaataaggttaatccttttaattcgacaaaatgaattaaattatataaatttaattatataatgtaactctataaagattaatgatttccagcaaatctgtattttcttcctgctaaagaaataagtgaattaaatagcctagtgactttaggctttgtagatatttagtttagatacttagtttaaaaccaggtcaagcctctgttttcctaaaatgagatagtttaggtaaaagctaatgctacaggagttttgcctttttgcttgaattgatcacgtcgttatgactttaaagatctaatgtaaaagagcaaagtagatacaggcaaagtttgggccctttttaagtgtttattttcattgactttgcagatattaatgaatgtgtactgaacagtctcctttgtgacaatggacaatgtagaaatactcctggaagttttgtctgtacctgccccaagggatttatctacaaacctgatctaaaaacatgtgaaggtaaaccatatttttgttcttatactgtgtactttgctatcttttggaatgccattagaaaaccataagactgaattagagtctcctgtattttagacagttatgccagtttagttgaaattctgtggttctacatggcactagtatgtactttgtaagccacttatggtatttacttgtaattggcattttaattgccatcatttaatagataaagaaaatgttatgtgtctgctatttgagctattcattcagaaatcacatacacatttactccagattttctaaataaaaagattcagccaagtcccgtattctatactatagagatgtactagtctatactatagagttattattttggcattccatctagtgtaggaaaaactatttagcccagctttactgtgtgggattaaggatatgtagtagcaattggggtcaaagttgaagtactcttttaggcccaagactagattttagcagtaatgtagacctgtttttgtttcagacattgatgaatgcgaatcaagtccttgcattaatggagtctgcaagaacagcccaggctcttttatttgtgaatgttcttctgaaagtactttggatccaacaaaaaccatctgcataggtatttatctttctgagaatgatttttctatgtttatcaatgttgttatacttaatgtcagcttttcctgcaaaagaatttaagtatggatgaacaatattaaaaacttcattattccttgtttcaaatgctatttttgtctataattccaaggtgtatgtttgaatttttatatagattctattaaatattattccctcctctgcagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttggtaagagaaacccatgctgtggttcctataccactccaatggtctttgcataaaaaggggaagcctagtatttcatttatctaggctcacatgagaattttcaaagatttaatcctgatggccccgaacatattgctgaatgggaaataagaagtgtcaaattttatgtgattttgttcatttattattttctatcttcacattgtaatgtggttagtttgtgttgcttccctggagcaccagtgcctgccagctctcttgggaaccttgtggttaggggttctgagctttttataggtacagattatctttcaaaaagctaattgatgtaaagaaaccggtattcatgactaaacttcataagggtttctggtgaacttctaaatctgttgggaacttgaggtttgagaaccttgctcatggttttgctgatttaatgtttaaatatataaatgtgtaaatttatgtgaatgctggaggccatgagatctccaaattatagacttgagttttctatattcaggttaaagtaattctatagtgtgattcctattttcaggtgaacagcaagagagaaagctaccttcagtttccctcttagctatcactttaacatgatctatagggcacgtctgtgtcttttggagtatcttagtggaattgagctttatttgaggagacatttcattactgttcttcctcacctatgcaatcgcagaaacattttgttatctcatacttatagcaacacaatctacttcatgttccaggtcatctttcatgtttcttacactatgtcagaactgcaaagtctggatattgttatctcaaatttgttttctgttttgtttttcgctttttattacagatcccatatgtggtaaagggtactcaagaattaaaggaacacaatgtgaaggtatttctgattacttataaaccatacatttttgtgtgcataatgaatgtttgtgttaactcggactggataaagctgtcatataacttcacagggagaaatatgcagcagagaaaaaaaataatgagaactacaaaacggaacagctgttaatttcacaagcatatatatactgttgctagtgtcagaacgctatgtccaaaggacagggtgggtggctgaaaatgttttaggttgatcgcagtttagagagactgcactttcaaaatgctatcaggaagagaaaaacaggaagtttttgatgagtctgtaaaatttgcctttctttggtttgtcctggcattttttatttgtttgtttcacagtcatgggtgatttagaaggacacattctgttttctctttgttgaaagtctgcatggagtttcttcagtttgctgtgattctttctcctggagtttcagatagacataggtcatggtgactaacacaacctgacatgacacagcagctgaaaaattttaaaaacagcaattagtcccatatgtgggatgaaatgaagttttttccctgttaaaacaaagaggcacactacaacccccacccaaggtcttgctttccaaatgatgactgaatcctttggcctttctctggtccagacccgctgttaataacttatctgacctcagcagcatattttgttgtacaagtggccaaaacaaaacaaaaaacccaaaaaggtagattccaccctctccccattgatctctcttacaaggaaagattcagaatattttttcaacattcctgttgtggaaagttatttcttctaaatagagacacagtgtgtatgagtttcttagctaatgttcccccctcttttttttttggcattggcaagtaagtgcctttcttttgattaacttggtggtgaatacttttccaaattaagtgcagagaacatattgctctccattaggcaaactgggaaggactggtacatttgagagagattggatgaatgatgaatgaatgaacatgagtatcttttaattcccctcaacccaagctgagaccaaagcatggacagaacagcctgagaccatggctgagttagaattgattgtacattttctggtgatttatcagaacttcttaaaagagacccttcactggcccacatattccttggtgggatatttttctatgctgaacttcaagctgtttcttctttgctagtttgaaaaaccaggtttttgcttctctactcatttccagacatctggtctcataaagcaaattatattgctgggaaccttacctgaaatgtccgcagctaccagagctgtctccaagaactcacaccagctgcctgtctctacaactcaaaagttattccctgaaaccaatggagaaactcttacatatttagtaataggtgggctcgttctggttgctattcaggcaccctagaaattctacacaaactacttgtaggcaaactagttttatgaacttaccaggttcaaaatggggaataattatgactctatgagtagaataaggtagaatgatattataaagatatattaactttatactttttttttctttttagatatagatgaatgtgaagtgttcccaggagtgtgtaaaaatggcctgtgtgttaacactagggggtcattcaagtgtcagtgtcccagtggaatgactttggatgccacaggaaggatctgtcttggtaaatactgagctcattatttttctaataataatttattaacgattattaaaaatgaagttaacaagatatagctgagcacttagcttcaggtacagacacacactccaaaattcagcatgtccgatagggtccatggccactcctttgacagtctttcgaatagtaagcagcaactgtagtttctgttgatatgcaactattccttaaatcactagcatcacagttatttttccagagctcttaaatcggccccatatgccgtgaactataaaatacaagctgagtggtggagaaaagaacaatatttgcacatatttggaaactgtagcccatgtcttctaagcataccctgacattggccagaaggacaggtccttgcaaaaacacctgtggagatcaggagtgaagatgccactcccctgaaaagtgaacctgagaaagctcagcccagggtaggtatcactgctagtcatagtgggatattctgtgccaactgctagagcccaaatgggatcctctagccaaattgtctcaccccaaccctaagtccttagaactctaagtcctaagtccctatgggctcgtgatagtggcaagtttgagatcgcacatctcatgcatctaaggtctggcagacttattctggtgttactactatggcttctgcctgcctagagtatatcccttggatcactggtttctgagttcatgactctggaaatgatgcttacctgtactttgcatctgaaaccacattactttgaagtgtaggctcagtgaagactattgtaggtagttaaaaaagtgggccgggtgcgatggctcacgcctgtaatcccagcacttcgggaggccgaggcaggtggatcacgaggtcaggagatcgagaccatctttgctaacatggtgaaaccccgtttctactaaaaatacaaaaaaagtagccaggcacggtggcgggcacctgtaatcccagctactcgggaggctgaggcaggagaatggcatgaacccgggagttggagcttgcagtgagccgagatagtgccactgcagtccggcctaggcaaaagagtgagactccgtctctaaaaaaaaaaaaagaaaagaaaaagaaaaagaaagtggtatacagtgaaggattttgatcacttacgaattagaattaacaaacctttaaatattgaactttatagtttatagtgtaaataaataatatggaatggaaccgggaattcaaagccaaaagtatttttgtaattaaggatgtcagttaatgctattctgagtcttagtttatttgtttaggaagaatcagtatttaatgagaatcttcttctaggttcttcagttgaaagatgcttcagtgtttaatttaggattcacttaaaaataatttatcttaatatgggcagtctgaatataaagctgaatataaagacttcaaaaactttctaacgttagaggaaacccagggagttagatatattgttaatgaccccattgtgaaggagaaagagaaggaagatacatcttacatttcaattacacttcattattttcagatgcataatctcagttgagcttcacagaaccttctgagagatgagtgcaacatcctgtaacagatgtggaaattcaggtttaggataatttattgaagacaatccactgagttacagaagaggaccaaaatccagctcttctgacctctgctctgctaggctttctgctcttctttataatcccatgaatttgggtttggggctagaggtatcccacaagtaccttgaagaatgtgcccttaagcacgtgtttaggtgaaagaaatatttgagaagtaaagtgaatggcttttctttgcatttttctctttaatctcaagtaaagcagtcctctttccagagttcatcattccacctttccaaaaatgaagtgggtcggaggaaaaggtgattgcactagggcagacacgctccaacaataaagagtacagttggcttttagctgtggaggacatgccaagacatcatggcatgcacgcatcggtgataggtatttctgtacaggagaaaaacatctcccgaaagaacactgtgggatctctcagaataccattccttatgtagaattatcagatgttgaaagggaacttttcagaagtaggaggtgcaaacatgggctgacaaagagagtctttattaggcaaggatacttaccccagagcctggggttttttttgaggaataaaactaattccagtcaataagtatacagcaaattattatgtgtgcagtattttacctaacagagtgttggcagtttggggcagtggaagccgtgtggctctatttaacctcccttgattccctctgacagatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaaggtacaatgttacgttttccatggccaattgcctccctttttagacaaataggatgcattttcatgatctcagcactctacttgatcatcccagcatggactttttgctttctgaattatataattatctttgtttagaaaagtatgaactttttgtttttaactgtttggtccaagaagtcctgggggttaaaattgttctgtatggagagatagtttcagatagtttctaggtggccctcttaaatgtcagttacgtaaactcaaaggaactttaattttgcttccaaaagctatggtaattcattgctgaagaaggacttggtgttctggagatttaatctcccagttctgtcttacatgtagaaattacttgcgtatttcttgagtgtttggtcttgttttggaaaaaggccctgtagtgggaaactcaggtcacatgttacatgtatgcagttttctagtgtacaagaagctctttaaattatattaatgagatcttgagctggatgcggtggctcatgcctataatcccagcactttgagaggccaaggtgggcagattacttgagtccaggagttcaagaccagcctgggcaacatggtgaaaccctgtgtctacaaaaaaaaaaaaaaaaaaaaaaaaaaaaatatctaggcatggtggtgcacacctgtaatcccagctactcagatggctgaggcacaagaattgcttgaatctgggaggcagaggttgcagtgagccaagcacaccactgtactccagccttgatgacagagcagatcctgtctcaaaaaaagaaagaaagacatcttaaggtatatacattaagaaaatatttttaaattgtacaaattatttgcaaataatttaaattataaattatatctttgaaatttttatatttttggcatatccaaaaaagcaccaaacagtattaagtgaatatctcattctgctacacagtcaattgatagctgtaggataatatattctaataatgttctatgtgctttaaatatagatactagtggtttagaatatattatctattcactcagcaagtagtggttaaatattcactatgtgtcaggcagtgtgctgggccctagaagtctgaatagacacattatttgcttctttaacaatgctttataaaatgtagaaatttgaaaggctagaaatgtttacaaagtcatatatctcatggatcatcacacattcttggaaatgtatactgccaagaccttaaatcaagaacttccaaccttcatgatttaaaatggtgggcattgagacctcctgactgcttgctcataaacttattttgccccacattttcttattcttgaagatatcaatgagtgcaagatgatacccagcctctgcacccacggcaagtgcagaaacaccattggcagctttaagtgcaggtgtgacagcggctttgctcttgattctgaagaaaggaactgcacaggtcagttaatgagccttaagggccaggagaggggacgtcctttaaaactctttatctttaacatattgtcgcaagaattaaggctgtcctgagactcatttgctgccacttgctgtttttgtgcagacattgacgaatgccgcatatctcctgacctctgtggcagaggccagtgtgtgaacacccctggggactttgaatgcaagtgtgacgaaggctatgaaagtggattcatgatgatgaagaactgcatgggtaagtttgggatcatttgatcaacacagaaagagaaggattccatgaagctttgatggctcatagcctatgttccaggttcttcctgctgccccagtgcaaccagtgaagttaggaatcagtctgcaacagagggagactgaggtagaaagaatgagggaattcatgctgtgggtttgtgggtgatggcggagaccagttgtgggcccttgagaagtgattttaacacctgaaatggatacccaggcggaagagaggacaattgagacagaagctgtagtagaggtccctttacaagatgtctgtccaacacttctagaaaaggtgattggtaaacttgttgctttaggtctggtttcctagaaacaaagtttgaaatggagattcttgcaaaagtggtatttcttactgtgagcaaattctctcagaaggtacttgtcaggaagtaaggagagcagggtagtgcaggagaagaaaataaaccaagagtttggctgcattttggttttagtctgatcctgcagggagatctggtgtatgaatagcaccagagagttgtcccaccttgagacaaggaggtcaagatggacacccagcaatgggtgggggaggagtgcttggtctggtggaggagatgaggcccccacctttaacatggtcatttccattttgcagatattgatgagtgtcagagagatcctctcctatgccgaggtggtgtttgccataacacagagggaagttaccgctgtgaatgcccgcctggccatcagctgtcccccaacatctccgcgtgtatcggtaaggagaaagactttcacaccatttacttgtggtcagttgtttgaatgacatcattgccaaagttggaagcttatgtttgggtgtttgttcttcttattttcccgacagacatcaatgaatgtgagctgagtgcacacctgtgccccaatggccgttgcgtgaacctcatagggaagtatcagtgtgcctgcaaccctggctaccattcaactcccgataggctattttgtgttggtaagttcttttttattttattttattttattttattttactttattttatgttatgttatgttatgttattttattttattttatttcatctctccctaaaacactctatgtactctgagttttgttttcatcgctacttttacttatctttcttgtttccctgcaatattctttttatagtggctcacgatctttggatctcatctccattatctgtttaaagagccagttaagtgaaggacataggatgttttagctctaataagcataatttgacccatgccgtttggatagggaacagtagcagcatgtgctttgtctacacacatgcataccaatgcacattaacaaatggtaactaaccacctgaaataaactaaacacggtgagtgctgtggaaaagagcagaaagctgagttgaaatcactgcccttatgtggtttagatcagctaaaagatttcaaaaaaataactattggaaagaagaccatggaatgttcatatcttacactgcaattgaggctatgcctggctctccttaaagatgggtttttgtgggacaagaattttgctttgtggtcagccctctgtaggtttagtcgtgctgtgaagagtggcacagacagtcctgtggctttattgtgccccgagtcaaagtgaaactttgtagaaactgccagtttttgcctggtttggggtgtacaccatgtggaactgccaagtctcacatggtttccacccaaaaccataaatcagcccaaagttttctgaaacatggcccaggacaactcagaacttcaactcaggttattgaaaaagattggaacctcagccaatcaaactgaatttcaagtttataagtgaatctgtggccaagagaatttcatccacgtgcctattatcataactgagatgtgttctcctagcacccaatacttctcctgcattgcaaatggcacatcatgcatggtgcaattaattgttcatctgtctcctggccacagtgtaatcattttgaagtcaaagattgtgtctgtcccattcactattagagtctcatctctagcatatagtaggtatgtcattaacatttgttgaaggaatcagtgactcagttgccctagaatgctttttcccctttatttgacgtatgcctggaaatgttaaaaatgtgccatgctcataaacacagagggaggtgtgttagcccatttttgtgatactgtaatagaatacctgaaactgggtgatttataatgaatagaaattattagttcacagttctggagggtgggaaatccaatatcaagaagccaggattttgcatggtccttcttcctacgttatcccattgaagaaagcacgagggtgaaagagagcaagagggggctgaacttgatcttttataacagcaccgatcccaccatgagggtagagccctcataggatgattacctcttttaaaggccctgcctcttaaatagtgttacaatggcagttaaatttcaacacgagtattggaggggacagacatccaaaccatatcagaaggtgatattattttcatttcttttagacattgatgaatgcagcataatgaatggtggttgtgaaaccttctgcacaaactctgaaggcagctatgaatgtagctgtcagccgggatttgcactaatgcctgaccagagatcatgcaccggtgagtaggttctagcctcatgttgaatctctcagtaggttcctaagtaaagtagtttagggcccaggctttggagtcaagcaggcttgagtccaaacccttgtttgtcatatattttaactgtatccttaatcaagatacctattattagaatcctcatctataaaatgaagttcaaattgcctgcataaaatagtatttacagagcttaccatagtacctggcatataataaatggaatataaaatacattttccttcattgaccagacttttgaagagtttgatgttttggcctaattcagtgcaactccaggtttattccttgaaccattggcaacagcatcacctgagaacttgttaaaaaaatgtaaaatctcaggccccattccagatctaccgtatcagaaactactgaggtagatcccaggaatttgttttcacaatctctccaaatgatttggatgcatgctaaagtttgagaaccagtggtctaatttacacttccttttgtatcaccctggctgcgagagctgtgagccaggtagaggtgagaaacaaagtgggtaataacataggctttgattttggcttggcttaagaagagaatttggatttaggaaccaaaattattttactgacctagaaaaatgtcccttaaaaaatctagatataaatttggctacaaaaattgttgaaaataaggccaggcacggtggcttacacttgtaatcccagcactgtgggaggctgaggcaggcagatcacctgagttcaggagttcaagaccagcctgaccaacatggtgaaaccccatttctactaaaaatacaaaattagttgggtgtggtggcacatgcctgtaatcccagctacttgggaggctgaggcaggagaatcgcttgaacctgggaggcggtggttgcagtgagccaagatcgcgccattgcactccagcctggtgacagagtgagactctgtctcaaaaaaaaaaaaaaattgttgaaagtaaatattattactaagagcatctaagtaggtatggttatttcaagtaattcttaccttaaaatattgctaaaacagttgatagaattcaggcatttataatttgacaatagggaaaataagatttataataatttttgaatgataaattaaatgaaagaaagattttaaataaataatagacttttaagcaggtgtggacgttgcccttgagcagtatattataaatattgaaaaatattttttccttttttaccaaggataacccaatgggctagtttatgcaaagcttcatttggatttgagagttaatagtcttatgctagtaggctaagtttatttgactgcggtcagttaatgttttctcactgaacagtggaaccaatatcaacaacctgtggttgttggttttattctttgcagacatcgatgagtgtgaagataatcccaatatctgtgatggtggtcagtgcacaaatatccctggagagtacaggtgcttgtgttatgatggattcatggcatctgaagacatgaagacttgtgtaggtaagcaaagaagacagaatttttcatcttgtcttgttagtcataagcactgttaaattacataaagttagtttgggtcagtgatagaaagattccataggaaaagtaaggatatttagaggcacaatactcatattttaaccagcattccaaagagagctttcttgtggctattaaatggtactcttgtcagatatgttatgaggactgactggccattcgtcagctccagatggacatttcttttatgcctatccattacttttgtccacttaaccctccttctgctttgactatcatgtaggctttttaaatccttgactaaaggcaaacaaaatttacttctgacaagaatgcagtaaactttagaactgatctatttgttttgtatagtttctattgttatgccttcaaatttgataaacttttcttctacgatctctaatctgcctttcctcacatacagtgtatttttcatctcagatgttgtagttttcacctctaaaagttcgacttgggtattttttcatatattctgtgtctctgcataagttcaatcattcctctagctgtttgaacacatggaatacagttataacaacttttagtgtctttgtctcctaattctgtcatctgcattggttctaggtcatttgaataaattgactttcttccttattttaggtcatattttcctgcttcattgagtgactggtaatttttgattggataccagatagtgtaaattgtgccttactgagtgctagatatttttgtattcctagaaatatttttgaactttgttctgaagtgtaaattacttggaaacacatggatccctttcaaagtcttgcttttaagcttttaagctacacttagtctaggggtaattttgctctgttagtgaggtaagacccttctggatattctacccaattccctgtgaattatgaggctttccagtcaggctggtgggaacaggcacaatcccagaccccctgtgaactttgaggattgttccctctcattttcttgggtagtgctttccccagccttgagtagtttgtttccttatatgaatgtgctggtcactactcatctgaatacttgcagaagactcttagcaaatctctggcattgctttcttctgtgtagctctctcctgtcctttactctgccctatgaaccctaactacctcagccttccaggatgcccagattcatctcctcaactcaaggacagtgcctggctccatctggtacctcctccttatgccatgaagttaaaactctcctattcagtaatctcgggcaattgtaggattcacctagtttttctttctctcagggatcactgtcttttgttgcctaatgtccaatgtctagaaaaccactttttaaggtatctattgtctattttttttggttgtttcatctgagaatataattttaattcctgttattctatcttggccagaagcaagagtctggtattgattatatttacatttttatcacatttatcttctgaaagcctttactgaaaatgtttgaagtcctagaattaaaatgaatgtcataaaaaatgaataatttttaatttggaaaagaagtgaagtcttaaactacttacactaagacaaccagttcatctatcctttctttcaaaatatgaaaactaaattgttatcatcatgcagactgaattaaacttttcatcctgcaatagagtatgctgttctaaaaagttttctagactgtcacataaacgagctctaaactcagcatggagcccatctgtttatttgattaactggcctgctgcttatgggccagatgaaagccagtctgaataatgagcttgcaatgtaaagaatgaagagcaaatgtaaattggcctctaaaatttaacattgtttttctgagggaaagcattttaccttttctaatgtatttgtcatagttattatgtctcgaggggaaagtactcaatgatatcaaatagctacatatattaatagtatatatgttttacagatgtcaatgagtgtgacctgaatccaaatatctgcctaagtgggacctgtgaaaacacgaaaggctcatttatctgccactgtgatatgggctactccggcaaaaaaggaaaaactggctgtacaggtgtgtttgttcaagtagaacaataaaatattaagtagttaagagattggtatcataattatagattgatacatgttttaaaactcatacattttaactatattataaaacattttgcataacatttttcattaatttagcttccacttctttgaaatttgtcatcgtttatattggatccaagttgcaggtttttttcttgacctgtggggggaaaaaggtgtattgaataaattaacactgtaaatagcacatttttatgaggttaaaaatcacattttcatatcaaattagtgaacatgctaattaccaaatattcatggcccttcaccgaagcaagccttttccaataacctcctttgccaacacttcatttaaggtttataactggaattgctctttaaaggaaaacatcctacaattcatatatttcatcaattctcactagtcttccagtgccttaaataggagtacttttgatgtattaagtcatattagtccaaggaagtctttattcatgggacttagcaaatcttatgaagtgataatgaaaccatttgcaatgttgtctgttaccaatagcacatgagaaaatgttttcacaatatttgtaggagactatcctattaaatgccaaatggaagaagttactctgtgctaatgacattgtgtttagtttataagtgtttagttggtattttcaaatatgaggcaatgacattaagtccatggaatgatataataaagttttactctagttacttatattaatttgacagattatggcatataacataatttaaaacataatggaaaccatggtgagcttgaattaggtaactgaataatttcttaataaataacagtctttaattccaaaaaccagtttggcaagctcttatgacttaaaacaaacattaaaatatttgcagattggcagtggggcaaatgtgcagatcctcctcttaattatatcaacatatttcaagaaaacaccaaaatatatttattattgtttcaaactggccaataatgctatttcaaatttattgatatgtaggataagggcaataatattattgttggttcaaaaataacagatgctagccaaattatgagaagaagcatgaagctggaatgttttcattttcactatgctactccttacatgaagcctgtctaggggtccattctgataaatggcacagtgtttaaactctcaactcctatacggcctctcggtacaaatggtgcctagctttgtatgtctatggttcaagctttatttttagcttccagtataaatataggacttggtaagggatgatggtctggcagtagtgaaaagaaaggtaagatagttctgtattatgttttaactaatagaggataatactactgttttgttaagctgagcacattgaaattcaacccagaggcagtgatgcttatgaaagaagttaatctcatggaacaaccttcattccccataagaaagaggtctctagaattcaatgctccaaattctagctaactgggtcatgtgcagtggctgattattttaggccttaccctgaagaaagcttaaattttcatgttatttaatgtagttttaggtaaatgacatataatgtatacaatgctgttggcgcagtgctggtcaataaataaaagctattgtcaaatgaaacatagacacagtgtctagaggccattttagtgaaagccattgcttctagtctatatctattgtccattgttttgttgtttcatttgagaatttaacagtctagcaaaaattttatgctactgtttactgattcatgcttgaactcagtttaaagaaggaaaatcttactctttatattgaaaggcttgtttttcgtagttgaatttgcacagatactaagaccatggtaacagagctgtgcactacagttgcatgaagtgacaccagctttacgttaagaacagcagcctttgagtcaatcacatgaacatagatttgaagtcaaagaaacatttgatcctcttcaaatctttttcatagatttgaagtcaaagaaacacttgagctcttcctccagttttgaaaattacagcctaaaatgattttccaatttgctaaaatccagctagcactgtaggaagacttgagttttatgcccctttgataccagagtaacatggcatgtgatattctcatctgaaggagtagtaccctgaattgtgttcttagtaaatccactcattcatgatcttgaacaaatcaccagggtgctctgcagttactcaaatgttctccttgggtaagtaacagccctgacctgtggaagggcatcacatttgattggaaatggcttaaccaaacagtaagtttggtatacttgaaaacgtgtttttaaaaatctggggcaaaatgttttttgaatcccatgtcactaaggctcttttagctgcttttagtttaaaattcgtgtcattcacaacttagaacaccgtcaggttaccttggtgatggctttgctaataatgttccaggcaactaatgtaagtagagataggtatcttgcctaattggataagcaagcagacaaaaggaatatgtctacttatttatctatttatttatttagatagattattgtttaatgaaaagaattatgaaaatatgtatgctattttataaggagaaattttgcttcatgagaactaagaaaaagacctctgggctccattacagttttgtctaaatatttcagctccctgtcattactgagtatttccattttaacaaataaacatgttttttcccccaatcactttagcaatgttcagaatccacccactgacttacattcccagcccacacagatgctaagggtttctttttactccgtaagctttgttcagaccctgggtattgccaagggggaatgttccatttaatggagagagaacacatttccttgaaacgcagaacacagctcttctatccttggcttaagtgggctggattacaatttttctatgacccaatgtaaggcttctgctgcttgttctacataattaaggccctgctaggtgtcatctttgatgggtggtcctggctttcacaagctaattttaagaccctacctcccatcatgtgcttacttagttaatgaataaagcaagcataccattaagtggaattaaatcagacttgttttcagttaaaatagcgggatttctgggtaattccatattggaaactagctggtttctttcataagagaaatgtctctggtggatcttggttcataggagagaatcatatatttcaaccaccaacagtcagtgagaatttgtgttcatttccttccagtttcttatcactgctaattttccttcactggctgtcggcctgtgaaaactccatgggtgttcagttaatagtgttggctcaaatttggatccaaattaagaaatccaagtagccttcacgtttggcctctccattcatggtaacgccctcttcctcaatgcctaatcaaggagtttctgcagtgcacagctctgccaggttaggatccaggagacagatgcccagatggcagagaaggcaggtgtttgtgtgggtgatacagcctctccctgcgtgactgtaagaggaggccacagcagccccgggcacaagcccatacttggatgacatacttgcatgggacatacccagagcctgtgagcagggtctgctcacaccgcacccttgcccttcaagagagccatgcaagaggacctttgagtctttgtgacaaaggtttggtggggttaagaaggttgcggtgtcactttaagtttgaatttctttgcttttcttggcttatgctattcttaatcttaaacaggaattttctgtttgcagcgaacttgtgcaggaaagagaacatttttacagaaagagatattcttggcaaacatgtactatgtttccttcatgttattgaagagtgtttcaatacagcatttttgtttgcttgttttccttatggctcactttccccttctgtttgcttttatgatgaattacagtccaagtctgccacagaaacaattaatgaatgatagttggtgcatgcatgcacacacacccacatgcaaaaaccttttatttggagatgcttttatactttatgaccacttgaagtctctccaattgttacatactgagagtgtaaaacattgagataataacttatacaaatagtcacaaaatggagaattgaatattggctcctgagttactctctcctattacccaaaagcccatgatacacagcctgttgtaaatatagtttcttttcaccttgaaaacattgccataaaactgaaaacactttctaaagttgtaaatttctattagcatattactgatgatttttaaaggagactttccattaaaaagaaatgataattttcttaattgcaagattaaacatggaaggtaaaagccatatgaaaatgataatactcataaaataagagtacctctggtcattagaaaactggaaagaaaaagattacagaattactagattaataggttgtggtcatctctgaaaattatgcttagtagaagatattagtgagtatttctataagtcagttaatattcaccaatattttggtaactccataaagcaaggcttagaataaaatcctgatatgactaaagaaatgcgctcagctgggcgcagtggttcacgccttaatcccaacactttgggaggccaaggcgggtggatcacctgaggttaggagttcaggaccagcctcaccaacatggtgataccccatccctactaaaaatacaaaaaaaaaaaaaaaaaaaaaaaaaagccaggcgtggtggcaggcacctgtaatcccagctactagggaggctgaggcaggagaattgcttgaacccaggtggcggaggttgctgtgaaccgagatcgcaccattgcactccagcctgggcgacaagagcaaaactccatcaaaaaaaaaaaaaaaaaaagaaaagaaaagaaagaaagaagctcagctaggcagctgtggcccaagggaaggagtgccaatcaccagatggggaaactgagtttcaggaggtcctggctctgcccctcactgacttgtagggcccaacttctttgtcttcttctgagaaactgagattgggagaatggaattacgagttctttccacttagaaaattccttgattctataacatctggaggctttgatacttatgcaattgaagctttttgtgtccacataagattatttgtcagagatcatgacaaatataggagagaaatttaggcaaaactccacaaaaatggtgatttgttgcattacctctgaggggagcaattacctgaggcagaaagaagtttcgacagccctgcttgggagtatttgtgctagttctgcgggatctgttaggtcaggtatggaaagacatacattcttgaattcctgtgcctacttagcactgttatccctgaattggccttcctcctcatttccttggaatgtgccatgctcaattatttagctggttaaagctcccagtcacagtctaaagctatgtgtctctcttgacctgcagtaataacttgataggtccatgtggctgccaaggttacactaaaatccacctatacaatgtgtcatgactgaaaggacattcttccaggcatgctgcttcatttttatgatcattagtgatattataaagttcttttgtaggagcaatctgttcttatttcattttgtgtttgctctagaagttatgaagaagccaaagatcccaggaccatttcagagcttcagatggaacacttggcagatagcatgtttgcaaacactttcaaatcatttaattgggcttcataagtaaacaaaaaggcaaacatgaattacttgcccagtttctttttcatgccactattcaagtgttcactggaaattcttgcagtgttttgtatggcaaaattgttcttcttgacctaagattggtgttagatgttggtttccatatagagtaccatatttatgagttcttgttcttagttaatgacaaagttgattatgagggtaacccattatagaatgggctcgttttggaaaattttcacttagtactttatgttcttttctgtaacatatttatgttagagagtctatcttggctaaagttgacaatagaattttggagaatagagcattttggaaaatttggagtcttttagtaatgtgaccctaatctggtattccttatattctgacaaaatccccattggattaacttgagttttacatgaaatatacaagaaggcttggctctccaatgtgctaggactctaagaagctagggaaaagatggcttatatactgtcttaaggaacattttctgcaaatgcttaaattagcaatacctaaaggaaagcttttgtagaaataaagcataattaaataagtgttttaagtttaagaataaaatatattttatatatagaatataatgcaaaaattttctaatttgccaacaagtttgtattttttgtctatacaagatatgaaaataatgtgcatcattactccatagttgacttactaaaaatactagcaaaagaaaatatgtgacaaggagtattaaaaccatagaaaattaagcaactcattttttatggtcttcagctgtaaaaagtcactttgcagtgactggaaacttacattaaaatacggaaaataattagagttaacaatagctagtacaatcatattgttatatctttataatttgaaatttaaagctgtttgatatatgtagagtttatatatggatgcaaaaccagtctatactataccatgggaagtttgaaggcaagtcaacttttgaatattacttattttaaaaaccaaaagacatttgtgctgagcctttttctaaatcactgctcatttttccagacatcaatgaatgtgaaattggagcacacaactgtggcaaacatgctgtatgtaccaatacagcaggaagcttcaaatgtagctgcagtcccgggtggattggagatggcattaagtgcactggtgagtaggaaagtaacagaggttgcttatcaaggactgcatagattacacatatgaaaatattaattatgtaaagttattttaatttgtgtattattggttttaaataccaccctttctgttaataatgatataacctttttctataagatctggacgaatgttccaatggaacccatatgtgcagccagcatgcagactgcaagaataccatgggatcttaccgctgtctgtgcaaggaaggatacacaggtgatggcttcacttgtacaggtatgttcacgctggaaacaactgtgtcaacactagtcagagaagccaggcattccacatttctcaggctagcaattcttttttgaagactgggtcagttaatagaaaagattcatcatttggcactagagctctgtgggaaaaaaaaaattggaaccaggtcaattagggagacctcaaaagcttctcgataggtagatacgtaggtagatagatagatagatagatatttaggtgccattatcacatcatttacagtgatctgtgctctaacataaaatgataccaaaaaagtcataccattctccacctcaagtcagctaggccttataatagttacaattggcatatatatcattatatgactgtatataatgatgtcattagtttaaacaaatcatacttccttttatatgcctagcctttatttattattattttttttttgcctatttctcaccaatgacttcctttctgtaccaacacaaggataagcttgctgtagggaactatgtaaggagaagggattagatgttctagattagaagaacagtatgtatttctctccaacaggccatcatcatcatcattatcgtcatcatcaacattccatattggtataagtaaaaatttcaaacctgctatggaattcattcacttccagttttgcaataatatattaatgaaattttctttttggctctaattaatagccatagaattaacataaacttctatacacatgtaaacatacatgattagacttgtcattacataaattatacatatacttacatgtgcatatatttacagacagcactttttatatcagagctctggagttaaataaaataataagatccattagccattaggtcgcatagctgctcctataacttaaaacattgatttatcctgagcactttgttcataaaaagtcatttaagcacaatagaggctaaggctcattaagtgatttacctggaatttttttttattccctgaaagttttatctcagatgaaatcatttttgcctaacttattgatgttttgtcatcaaaaacctcccatcattttgagaacatattcaaattccatgtattaggcatgtgtggtttatgtgtttgatatttaaatgcctgtgattattaagaaaactaggtagagattaagcagatggaatttttcttctccctatggttgccattcttttgcacttttggtgcccatctaagctaagcctgaaacttgagaaatagacacaaacatgatgtgtcatttcctgtcatgggtgtgccctccatgcggatgacccttcttgaacaggccttagtttgcatgattccttcggcttattcattttatatcattcagggtaaattatcattcaggattctgaatcagccacatgtaaatttcatattcagtgttagcctaccaaagagaaaaataaatgactttaaatgtgtcaaattgaagttatgccaaaacattgctgcactggaaagttgatagacctgaggaattagaaagcccctaaccgaggaagagtaacgtgtgtttctttctggctgtagaccttgatgagtgctctgagaacctgaatctctgtggcaatggccagtgcctcaatgcaccaggaggataccgctgtgaatgcgacatgggcttcgtgcccagtgctgacgggaaagcctgtgaaggtaactgatggggaagccactgggagccttgctgggcttgatgagattaggttatttaaacattcctgatgcttttttttttttttttttttaaactgaggtgtgttttagcttcatttctaagctggtcagttcagtttgtagagggattaggtttccagctgaccatttctcttgctgcacagaaaacctcagctgactggccacaagctgtacatccagccttggccgcatggtctgcaagggtgtatccattggtcaatgagggtaaccaagtgtggttaaatcagtgcaacccatttatccctacggagggggatgcaacctgttaatccctactgagggagaaaagagctcaaagtgcaagttccctgataatgtcctgttgtgggattatcactaaatatggaaacacaggttttaatctccactgtatttggtttgtagaaataaaagcagagcaaatagtcttgtccatacgtagaatggtatgtctcacatttgctctaaatatctaacatatatgaacatggaacagttttgcaaatctgttcaataggggacccttgggatactgccatatggcatggtatcgctcagctttaggctctgtcattctgataagtgttggtcagacacgaagagtcctgggaacctgttagctaaggctggatcccattagggaacacaagattcttccctttacccacatttgtcaaatttaagcacattctccttcattgaaaagaagatttcagtagaaataaacaaatgataacgattgtcagtagaagtttaaacaagaccctgattaatgtattagttaatagttgttccttgttaacaagacgtgaactcaaaatcagtcattagctatgacatgtatactaattccctcatgtatttttatgtgaatacttttctttgttatggaaccgttgggtgttctttatacagtttatattaaatatgcagagtttgatataaaactccttggagtcaagaaaccagattatgctcttgatcatgtgcctaataccttgtttacttttgttactccaaatatccaaggaaaacaggtactgtgccacctctggtgacacaaatagtcacagtgaaagttttgcttctcttattgctataagagaaggttttgtttgtttgtttgttcttaatataaatcatggctggtggagtggtcatggctatttaaagctagtctcaagcctgaaaatgtgactgtgtgtcaactgcacacgaagaatgttaacaggaggcagagacagaggcctggaagaagcgtgtgcggttttccaatctccgtcaacaaaggcaaacacatgccataggactagggacactggagattatgcaactaattatgacagttccctgaaagacattgtggcttgtgaaattttaattcacaacaaaaacagtgactacatagatagattaaaaaaaaaaaacgaatttagcataaggtggcttgcttgcctcttactttacgaaagtgatgtggacctacgtggaacactacaaatgagatatgtatctataaaatgctcagcccgctgcttggcatgtaatagagactgaggaaaagtaacctctcacctacgagacttcactgtgcatggcaaatcatctaaaagtctataggagaagtgcccagattggtgttagatactctgcattttcttagtatttacattagttgcctaattatatttggcaggttttttttagaaaaatataagttaagttttttgcttttttctccctccccccaagatattgatgagtgctcccttccgaacatctgtgtctttggaacttgccacaacctccctggcctgttccgctgtgagtgtgagataggctacgaactggacagaagcggcgggaactgcacaggtaagacctccactggcatcaaaatcagctccctggtgtcccgggggacccagctattggagcctccctgggactacacaagggccgtcacagaagacaagaaaagcaagggggaagtattaagaatcacagataccttttctcagacctggaactgattggaggtgaggatccagaggaaagagtctaagacaattgaaggagcacagtttgtagccttgaaattgagtttgtggctacaaaggaatgttctaggggtgctctagtggtgtagcttcccagccatttccttttctacttgggtacatttttggagagtttcgttttggaggccatgccccgggatcatgggttttctccttgtacttcgttgttgcaatacccaccccactccttcctacccctgccctgctcgtggtcaccagagtactgggtacacagagctcagccacctatctctagtgtataaatcattttcttgttgagccaaggactctcagggaacattagaaaaagcttagaaaaactacaggcacccagcagactgacactcggttctctttggcactaagactttgaaagccatttgcatttccccttcctaattcacccctctgttcaaggatactgaagaaacaacttatgttctgtatgagttcaaatttccggaaaaaatctggtcttttcaaccacctaaacaaaccatgactcaggggctctccagatcatgaccaccaccaccaccctgcaaatgctctggatggagtattcctctccagccacacattcttcccttggttttccttaaagctattacgagaccaggctgggtctcttgcatgcctcaggaagtccccctctccatggcctgtaccctgtcctgcgtgccccagatcactatcaacatcattctgtctaatctcgtttctgttactctggccctgtccgtccaaattcacatgcaatttgaacaaaaaaatcatctgcagcgcaacccgcaggagggttgccagatccaaggggaggaccaaggcaaaggtgttgtccctcttctccagtccctcctcacagaagccgtttgtctattcttgagtatttcatgagtgttcaaaacagacaaaaggaattgtacagagtggaatttgccaaaacccatgtcctaaatatctggaattctgtacatatttttggaatagaaactgaaagggaaatattcaactcagcatggatgatgggagagacactccttgccgacctcagggaacacactaagcctcacgcgtgtgtgtcaggggaagcagcaagagttgcccttctgagggtttcctgggacatcttgctctaatttgatgaaataacaagccacatatactcaatatattttcttaaaacctgtgtctgaatttttggttgaccgaggtcacaacagtgttttgccttcagttaccttgactggaatatttttcctagtgccaaagttatatatatatatgtaatatatattatattttatatatatatgtaatatatattatattttatatatatatatatttttttttttttgagacggagtctcgctctgtcgcccaggctggagtacagtggtaccatcttggctcactgcaagctccgcctcccaggttcatgccattctcctgcctcagcctcccgagtagctgggactacaggcacccaccaccacgcctggctaattttttgtatttttagtagagatgaggtttcactgtgttagccaggatggtctcgatctcctgacctcgtgatctgcctgcctcggcctcccaaagtgctgggattacaggcgtgagccaccgtgcccggcccaaagttatattttatcctgatgacaaatttgaatggtaaatgtgttctggggaaagaccaccaaagactatatcatatttccttcctgaggtgttttatctctgaagtggaagactgcatttctagatgtagttataactagtagctttaaaattcttgtttggagctctagattgggccctgttcttttatggtgatgtctgcctacactggctcaggtgataactccactactcactgttcggttttagatgtgaatgaatgcctggatccaaccacgtgcatcagtgggaactgtgtcaacactccaggcagctatatctgtgactgcccacctgattttgaactgaacccaactcgagttggctgtgttggtaagaccttaaaaacttttcagagaagcaagcatactgtgtattattttgaaaacagcaccaaacattccattctcaaagtttgcaaaatgaatgatacagaaatttaaacatttcctaactctactttagattcagatatcttttccatagggaaaattctcggtagtgtataatgttcatgggcactttttagtttctcagtaaaagtaaattacggtttttgaacagttcctgaagtgggtttgaattttcaaccccagtagaaagattctgcctgatgcttttgtgtttgtatatggtaaatagatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatgtaagtggacatcctcctatttattattatttcaactccagccagttctcctttctagatcagaagacaaaccttttctactcttagatcagagaagaaagatcagtcctctcagccctgtagaggggaccttattcccaattcgagagtcagaaaatattcctggttggctcacactaaaagatcaggtagggcaggtaacatctcacttctgtgtaagtgaaaagcagatagcattactttaaagattttccagactagggtactttcaccatgttgcttacgttccagggacacattgattatctctcctcttctcatctattgactagtttggaaggctgtacgccagactcagtgtcccggggtttgaagagaagcaattagttaagcaactataaaatggaagattattccattgttatggggtggcttgaaagaaggctttagcatatgattgtaaggacatacaaactatgtctcctaaaaatataaaagggttttcgtttttccaagtgagtcctgtattatgattcagaattagatgtagcttctttggcaaaattcagtggctactgcttatagcgtatgttgggataggtatggattctttttttgctgaagggtcatttattcaattcttctaaaaatatttgttgagtacctagaatgtgtactctggatgtgcaaagatgaattagactagatcctgcccttcaggagaatacagcatagtaggcaaattatgacctaaacataagcgctataattcaaaataggcctcagaaagagaagaaagagcaggcacagtgctgtgttggtacaaagagcacacctggtgcacattaggactccactagttgtcacccatgtaaccttgggcaagttccttagcattcataaaatacctcataggattaaatgaaatcactcatgcagagcacccagcacaggggtgagtgctcagctggctcctccttctctcttctcttcagaaagggaggtcagttctgcttgggagagggtggggacttagtgtgttttttaattgagccttcaagaaggttgtgacatgaaagaagaaattcaaaaagtatggatgattgcagaaagaggagaacaagtaaaagaggaggacttttcatttcattggtgtcgaagggggcaaactaagacacttaatttggggagtcagctttgtagattaatgacagtagcaaaacaatagatatccacaccacaccagatctggaccagagttagaactggaatatatacatataggcatgtgtacatataatttcagggagccaggacagggattagcagatctggacagaccatgacattatgaaagaactgatcttatagctcctcactgggatgatgcagcaggttacagacattcttattcacatgtcctgtacatatcaccgtcctggtgcataccactgaaataaatgtttctgggtaaaatacttggatgaaagaattaatgggggaaacccaaggacactatagaaagttgtttttggaaaccaagagaatcaatattgccacccatagaaacagaggtgcaagaaatgtctctagtcattaaggagagaattgggatgggaatcaacagagaacagcttttcctaaggctctatttggaaagggttttggaaagaagccaattaagattattaagggaagctgtagttcccagaaagtaggctgaacagaacataaaaatgaagatgaagtttttcagaaaataaaaagggaaagaaaatctgtaaaaagaaataagggatgaaggtaaggtataaaacagtccacacacatgtaagaccagggagtggttagagttcaaggactgaggacagtggccttgcactggggacacataataaaaaccactggaaaatgggaagtgtacacaaaggtgttaacttacttcagacgggcagagtaacaactaaagattcctgaaaatgaacattttcagttggatatgtgagtatttctcttgaggatactatttctaaaaactttagattcaaaacaactcaatttgaatttttgtttcaatagccgagtacaaaattctttgtcctggaggggaaggtttccgaccaaatcctatcaccgttatattggaaggtaattgtgtttcctttgtcttaaagcacacacaacttgaatttccttgggtttatttacaatgctaaaggaatgcctttgttttgattttgatagatattgatgagtgccaggagctaccagggctgtgccaaggaggaaaatgtatcaacacctttgggagtttccagtgccgctgtccaaccggctactacctgaatgaagatacacgagtgtgtgatggtaaatggtcctggtaggatgataaggtcttgcagatatcaagaactgacctgcaaaaccagaatatggttactaggaaaatagaatttagcagtgtagcacaatgttctaaacacgaacatagccaggtagatatgtctcacatgtggcaatttggactaatgttactcaagtgatgtcatttctggtaagtcctaaatctccctcttttcctgagaaaaacagaatcttattctgctggaccatagcctcatttatgcttacaaaatatttttccatgctcttcagaaaagccattttttacgtgaatggcacaggtccaatttcagtgttccttctctatttggaggagttctgggccctcttcttttaatccttcaccacttaccattggtgctcatgtattcaaataagcttctcctagaaggcggccctttggctttatgctatgagtggtggcccttgttcatcctgtgttactggaaaggtggagaatattaaccacttacaggtttcagagcacttcagccatgagccatggttttcatctacatggaggaatcacacaattgtttaggaaagagacctccttgtgctctgcataagaaatattcccctggctctttaatggcttattaggtcacccagacaatggcaaccttattgagtattagttgaacatcacagtgtatatggcacagctctaagacccatggagttaacaaagattagaatcaactccttcatttggaagtggggagaggatgtgaaatatgctccatgctgccttaccaatgcagattcatgaagccagctgttaatggcttcgggatactatataccctatcatagattttgtgagcataagaagcgtacttgtcttcctaagggatatttgatattttaatttctccacatttctatctctgcctacctttgaggatattataggttaatttattaggagactcattattatatttgataatgcctcatgtcagaaggcaagagttccttttcttttttgtttttgttttttgtttgtttgtttcgagacagagtcttgctctgttgcccaggctggagtgcaatggcatgatcttggctcactgcaacctctgcatgtagagttcaagcaattctcctgcctcagcctcccgagtagagtagctgggactacaggtgtgcaccaccacgcctggctaatttttgtatttttagtagagatggggtttcaccatgttggccaggctagtctggaactcctgacctcaagtgatccacccaccttggcctcccaaaatgctgggattacaggcatgagccgccatgcccagccaagagttccttttctaaaaccctctttcctcaaaaggcacacatttacacagagagaggacacggatgaatgaaatacctattttcgttatcttatttgaaaataccctatagattttctcctctaatgtcaacattcattaagtatcaggccattccaaaatgtgaagttttcatattcacataccactttctctttggattatagatgtgaatgaatgtgagactcctggaatctgtggtccagggacatgttacaacaccgttggcaactacacctgtatctgtcctccagactacatgcaagtgaatgggggaaataattgcatgggtaagtccaagcttttctcagtaatgcatgtttggttctcatctacaaagaggaagagagctcacaagttcatcaccttagggtgatgttactcatcagactgagtgctggcatcccttcactgtcttgttaggagactcttcccctataaatcataacttggcattttttcaccaccacgggtgggtggttgggagttttctctaaaatgtatgttggaaaatcccaaacaacagttaatagtacttcttttgtttgacttttgggtgtatctttgtacaattatatttacagtgctgacctacagtattaaaacatcacgagtcggaaacgagaaacttattgccaaatggcagtagggaattgttactaggagactgggcagagagtcatttaaagtttattaatgctacagctatataatgacttagttctgtggcatgaaatatcagggaatgtatttctcaaagtcctttatcttgtagcagcataggtagctagaaagttgtgtaagagcaagttttttgtgtccttatcaaagtcaagctacaatacaattcaaatgaaacttgcttgttgagtatccacttagaaatttgttgtgatttcccacatggcatcaccaaccctccaatccttttttttacctcccttctagatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacaggtgagttttagtttctccattatcaaaaatataggttgaaaaattacccatgaattgttggggaaatcagtcttagcgaaggaagcaaagtgtgcattgtttatctttacggggaaaaaaacggctcatgatttaaattcacagttggtgctggtcattccagccgaacactgagtcacagaatatgttttctaatgtataccctaatacgtaaccagacttgtagactcagcatatcacaaaaatataaactataaacaatgttctcattgttactgaattcttcatgtatctaaaagactgtaaacattagacaaatcaatgtgacagtaagggaaacataattccttgtctttttacttatttaaagctaaacttgttccaaaaatagttaaaggcagcctacaaagatgtaaatgttaaacaagaaataagcataaggcaaatggcaaacaagaataagaaagagccaggagcaggactaatacacaaaattcaagccgggaattcctacacacttgcctgaaataagcaataattttagccccaaactttctagcagctcctatgaaaagggagatgtgatcaagtacaaaattctcaatgagcataaagaaaactcaaaatgaaaggaaagtgcaacttttcttgatattgagatcgagataaatttcttcttatattctcatggagaaagaaactaaataatgttatttgtcttaaaaaaaaaaggctaaattgcatcctttgaataaataaagacattagtgtactgttcttatatcatatggtatatgctgtgcattatgtatatgatgatgacatcatttgccaagattatgatttgggttagttgaaattatcatgcaaggaattgattagggtattctataaagggaatcctacaccattttccacagtgatatataaaatattaaatctgttgtttggtactacctgacattgcatgcaacagaaaattgttttttagtaaaatgtattattccatccattgtttactccagaaataatataataaccaccacttagaattctgatttacctccaccctgcaaaatgtttctagaccagggcttggcaaaatacaccccatgggccaaatctgtcccaccatctacttttgaatggcctgcaagctaagaaggatttctacattttaaatggttggaaaaaatcaggagaatcgtatttcataatatgaaagttacatgaacttcagattttgtttcccataaataaaacttttttagagctcactaatttatttccatattgtctactactgctttcatggcaacattaaatagttttgactgactgtacagcctgcaaagcctaagatatttactctctgtccctttattaaaaagtttgctgacccttgatcttgaataatggtctttacaactttaggtggtacttacctgttggtaaaaaatctgaagcttatgcacacctggtgtgcatttatatgtaaaagtctatgtatatatatctatgtatgtgtatatgtatttgttttcaattatattgaaaaatacatttattatttttctgagctgttctaatataaagtgtacacaaaattaatttttttaaagattagatttttccaaagatagatagaagtcctcgcattttcttttttatcctaatggattattgcatattcctctggagaccactttggaaacccttaatgtagactaacatttacttttagaaatgattgcctgagttttgaatatctacatactcttgtgtaaaatgcaagatttcttcttgatgttggatattcaccaaattcagtcatggcttttcattagctgtgaaatctgcacatattttaagagtccctgtaatttctttaggtgaccaatgtcagctggcgttacagtgttggaagtgaacactcatagattaaggagacaaaacacaaggagaataacatgctgtattttgattaaaatacttccagaaatcttttactgattttcactgagcgtgaccaataaggcaatggccatctgaagcttagattgataccataccttaccagttacagtcatgatctggaatcacaaaatctcacagttagaagggactgctgatagaatttagttcatcctttattatctgttaaatttgactaattcaagtgagagaaagacagagagagacagaaaaggagagagggagagggagagaatatgacagagctgtaccaaatgaaatccagctccaaaaactgaaaaactggtgaaggttggttgattgacccaaattagtcattaatagatctgatgtcaagaatgtggctagatttgctatggtctcctataatctaccgagaaaatggcttttatacgtgttcctcaaaccctagatctctaaatgcagagtagagagaggcactcttaccagtccctgagttcagagctgaataacatccatattgaaatccaaactcctacaggtaaactcatgtgaatgagtggcatgtgatctggggatctctacttctccttcattatcacgtcaacattaggtcatttttttcttcaatatttgtcttacaggcaagattatatctgtaggaattttcaggtttactttttattttaaattcttcaaactacagacaaatacctttcaagaatgcttacaaaataatttttttcagtccaattattgttctttgctgacccctatcctcccatcccacctttgtttaatcattgcagatgagtttgctacactctgtggaagtcaaaggccaggctttgtcatcgacatttataccggtttacccgttggtgagtcatgacggcattgtcagaactttctggttttttgcctttgtgttagcattattttttcagttcccatttttttcttaaaggaaaaaaaatattaaacaatgcctttcactttattgaaacactgattcttagtttgaaacaaactgtgcaaacaccctgtgcagctccacctaattggcaacaacatttgttgttcatgattaaggggattggaaagcttttcccaaaattacaatcaagcatagttacaccaaccttaggcatcaacatggggagagattctgggagtggggccagttgacatttgatttaactgtaattctcaatccttccttctgactaagaccaggttaagtgacttcacaccaatccttacgtgtagattgtttacataaagtcctttcgtggatcaattttatcttacatggaatctcctcaggtcatctgctttgggaatttcagatgtgaaataaaaatcttttcggtctgaggccctgcctggtaaatgaagcagagaacacaacattgggagagatgcttgtgcaagaatcagaagtattacacagcactcagccagtgcaggcaatgcccttgtggtttaaaaccaaataacataaaagtagatggaaagctattgcattctctgagtttttccctggtgtgatttatatgcatccttagatgccctcttaagtctgcacagttgtgtctagtagcaaacatcaccacttgctttattccaccttattcataataagtaaactaaaatccacatcagcctttccagtgaccttgtttaagaaaacaagagtctggtccagcaatcagcctggctcccttagtgccaaatccatatggctccacagtctcgtccacgtccaaagaaacttcatggtttggaaagaaaaactgctaaatgacattggcatggaacacctggccctagctgctttgtttttccccttcccaaaacagatcttttaacctccctagaatctgtgatcacaagataagtggtctgtaatggtagtggttctccacggaccaaccaggcatgtaccccagcaaggctgccctccaagtttggcagtaagcaaagactagaaagaacattagcgttgtccactaggagagctggaaaggcttcagacttcatctagtccaaatgccttgcttcatatttgaggagacagaggcccagagaggggaagggactcacccaaggccacccagctaattaataacagagctgggaccagaacacagtcctgactcatggcttagtttgcttctagctcttgaaaactggacatctgttatttagctatatgcttattgttaccaaattccagcatgacaaaatatttagatgactgaaaaactttgttttatttaagctttatactctccttttggaagatcttatgattgttggcatgtggagtccattcatatagggttaaaactatagcatgtttatcaatcttgtcttaaaatataaacttcactaagttgaagttcaaataaaatcctgacaggaaaagaaaatataatttttaatatatccttttgctattttatacctaacaatggctggaaattagactcagcccgttattgttaaacttgataataatatatcacttatatttaaaacgaatgtgaatatgatgtttcgtgttctaacccacactgaatgaatggcatctgaatttgttttttgtttacttatgatacacagttgtgatgtaactttatatggcattttcatgacatgaatgacaaaggtgtgaaagatctaaagacataattgcgtgtattcaaaatagcaatgaaccctttgagattctaagctgtttcttttcattaaataggtcaattttgccttcacacaaaatcaagcccttttttaaaaatggtctaaaataaatctatgacatcaaatttctcctttaaaacagattggttatagagtgtggttcttctaaaattgcagcagctcttgtaggctccacttcagtccgtgatcatcttctcacaagtatgcaagcaaagtatgtaccttgcaaaggctcctgactataataagtaaacaacgtatctcaacaacagtcatagaaactagtgaattggaagactttggattgtagaccaaggctttgcatacctcccagctgaggtgtttcatcaaacccagccaaggggctgatggaagggccctccaggataacaaaagtgttgatgacagttctgtgaagattgtattagggtgatgcaggaaatcaccataatacgatcttcccttatatgataagggaggcaggatggcctgttaactgagtcccagtgtcaaatcctgactctgcctttcattggctgcttggtcttgggcaggttatatcctgtggcttggcctcacttgcttcatctcttagttagaatagtcatagtaccgagaccatctcatggggtggctgtgataattcagccaataaatacaggttgaatgcttgagaaatgtaccagtcatgcagcaaatgagatactgtcactattaatactattaccattattactactattactactcttatcctagagggcacttcagtggtcaggagttcagagtgggtaagacagagatgggaccactccaggctggggacatggccaagctggtgaggtgtccaaagtctctatccatagctggccagccctgccttagcagcctggatcctggctgtgttctcactcttggtcctgttttagtgctcaccaacacactgccagacacttgctcttaactgaacaaatttgaattgagcacttactacctgtcatgtagagtgctaaggaaccataacacagtgttggagagccaagcccaactcccagtcttaggaagcacacattctactgcgacagttcttccttggtgctgacctcgtttttattgtcagccccagcccagctgacatccccacacctgacttacctcctttctaaagccacatgaagtaggaagggggagttaaactggaatttgaaagatcagagttccatatgaccatgtgctcctctgtggttctttaccagctcacctctgcctttttccctaaatataggcacacttgggtggagaggctgtttacccttgaccatccctctattctactcatctggtgcatccacagtgcccagaggatacaaagatatctcctacctgtacaaaattgacattctgaagcaaaacccagaacatatatttaaatccagttagactcatgtctggaaagtggtttagttatctcaatttgctattcgttgatgtccctattgccatcaccaccaccccaacacatgcacgcacacacacacacacacacacacacacacgcacgcactttccatcttgtcttaccctgcacagggatcatgtgctgtcctgtcactcatgaatgactactctgtctctagatattgatgagtgccgggagatcccaggggtctgtgaaaatggagtgtgtatcaacatggttggcagcttccgatgtgaatgtccagtgggattcttctataatgacaagttgttggtttgtgaaggtaagtggcatcatgactttatcatatccagaaaagagctaactgatgagctacttgatacacacttggcgaatttcacaacattgaaatttcagaaatgcattaagctctagaaatagtaaagggcatggtgtggaacaacatgaaatttcatgcaaaaaaaaaaaattcactaacttcagtggaaaaaccaggaggcacattcccagcccctttcccccaacacacagtgtgttaatattagacttcccagctgatatgaaaaagctttgagttcctgggtgtgtcacatagattgctttcgtttcacattgctggaaaatcagtatgagtggacagtcatcctagttgactctcaaaatcatttctcttccagacagagactttgctactcccaagtgaaaacaaggttaatgcagatattccaaatgcatgagagaattccaaatggcaagaacagcaaatttgattttatatgaagaatgttggcatgcacatgtacttttttcattttcaaattacctcctgttgccatgtatatgtactgtgattcggagcattccttatagcacttcatattttttcctgcatctgggaaagatagttctcttacattttagtaaaagggacattactggttattaaatataccatgtgcccaggatagttggaataattttctatttaatacttacacttcaggcctctagcagaatttttattcatgttagaaagggttattaccccttagagcacgtattatagcacatatgtcaacattttaatgttaaaaaaaaaacttttttgtctatactgaagacaacttatataccacaagtaaagttatagtcctaaccacatacttgttaagttcctgtcaccaggctttcagttactgtgtccaagtgggcacatgtcccttactctgcctgctgtgtgagttagtgggaatggggtaatagcccttccgagccttcctaagaagatagccagttcagaccttggcccaagtccctgggctctgggaagccatcaaggatcaggtacctggagaggaagcatggatgtgggagagggaacccacggcagatgatcttacagtgctagagttggctgcctccctcacagccgcacttttccccctctcaaacatgctcagcatgcctgccacctgcctgtggcattttcctccccacccttcccctcagagatggctttgatgatgactgtacccaggtaccttttaaccacttatatttgctgaagctgcaggccttggccagaacccatagacaagaccacccatgaccaccaagtcaacttagaccttgctagatccatgagattaaacacatgcaactgtaccaatgcaaggcattttgctgtcagggtagcattctgtggatattgagataactaagtgctccaacttctgatttccatttcacagaatatccgtcttcagggtgaatgtttaatccagggtcagctgcttcctagcatactcttagctcttagaataggaaaatgaaggttgagtgcatacatgcctcagcaatgctgaaattggaatggattgtagaggtgatttagggagcttccacgcctctgctcttgccaagtagccacattatcagatgccacatcatagaagtgcttctctgtgacactactcagtttctccagtggcgcaatctgccccctgtgtttctatacatcctgaatacaaagcagggcagacctggtgagtgaggtggtgctgggtcccttgtaacccaaggcagacacactcctgctcctgtgtctgttgcccagagaggcacaatccacctgccttagacaggaacccccactgactgactgacagtcctgagggttttccaccacagaatcacgcccaagaggcatcggctgatgtatttgccacccccttgtaggaacttctttggtcgagccaacttctgtgtaaaagcccagaactggtactaagggccaaccttcacctgtgttataggccatcccctttattggacttagtctgtaaattagattgttccactggagcagggaagagggaaacatgtattttgccccatgatatagcatggacatgtagtaacttttgtgatgccatgaatttgaactatattagtatctgttttttgttgttgttgtttgttgttgttgttttgttttgtagacagacaaccccctaagcaaagtcaaaactctggaacacacaatatccattatccaaaatcttttctgttttaatgagagttggtttgttttcagtagttttatgataactcccatgttaggttttcttgatttgattgccttgtggtagtaatttgagcaggtgtctttacagccctgtacctcaaagcactctctacagaccaggagcacctgcatcagctgggaacttattagaaattcagactctcaggccattttccagacatgccaagtcagaatctgcattttagcaagatcccaagtgattcatgtggactttaagatttgagacattctgctcttgcagcctttcagacaatagcaaccttattgaatcataaaatccagatctttgagtaaatacaaggcttcctaggatattaatctatacccatgtcaagtgctggccctagcagccaagtttcatgacttttttttagatgtgagcatcattagagtccatatgtggtcataaatcaagccttgcatttataaatattactaagtgggaaagtttagataatggactttcggtcttcctttctttctttcttttttttttaatagactttattttctagtgcagttttaggtccacagcgatattgagaagaaggcacaaagatttatcatatattccctacccctacacatgcacagcctcccccatcatcagcatcctccatcagagtggtgcatttgttacaattgaatctccgttgacatcattatcactcagagtccactctgatgatttacattagagctcgctcttggtgttgtacattctatgggtttggaaaaatttataatgacatgtatccaccattccataactattcatagaataatctcattgccctaaaaattctctgtgctttgcctgtgtatcccctaatctcccctaacccctggcaaccactgattttttactgtctccagagttttgccttttccagaatgttatatggttggaatcatacattatgtcgcctttccagattggcttctgattcgcttagtaatatacatttaattttcttttttcttctttttctttttcctttttttttcctttttttttgtgtgtgtttttttttttttgttttattttttgtttgtttgtttgtttgttttggacttggagttttgcacttgttgcccaggctggaatgcaatggcatgatcttggctcgctgctacctccatctcccaggctcaaacggttctcctgccccagcttcccaagtagctgggattgcaggtgcccgccaccatgcccagctaactttgtatttttagtagagacggggtttcaccatgttggtcaggctggtctcaaactcctgacctcaggtgatccgcccgccttagcttcccaaagtgctaggattacaggtgtgagcaaccgcacctggccatatttaattttcttccatgtcttttcatggcttgatagctcatttctttttagtgctaagtaacattccattgtctgaatgtaccacagtttatttgttaattcacctatcgaaggacatcttggttgcttccaaattctggcaataaataaagctgctgtacacatctatgttgtcttttcaatagaacagatcaaaataaaatataaatttgttttcatgtgagaggctttgttgactggacaccagattctgttctccttcaaattcagttctcttctgctcgtagatattgacgagtgtcagaacggcccagtgtgccagcgcaacgccgaatgcatcaacactgcaggcagctaccgctgtgactgtaagcccggctaccgcttcacctccacaggacagtgcaatggtatgtagtgccccacaggctggacatgcctacccaagagtttgtcttcatgaagcttcagatatctggatttattttcagatagttaagctgaagaatatatgagttaagatttagattgatgaactctaatattaaactaaattggaaaaagggatattgtcaaaatatctaaacacttagctttttaatcctctttctggatgagatattttcaaaacaagaagtaaatcattcgcatacatagatttcgtatttgcctgtctgcttccctgcctgcaaacactcacccccacacattacacacacacacaattatgcatacacacattcccctaagcaacatttaggaccaaatgatttttttccttccacagaatccctctcagaaaggtgaggttttcaccatcttggctgcataccccaaatctagacagtgaagctctcctgagctgggtcagattaatctgcagaaacagaacaaacaaagccatcgcttttcttcccagtcatcttacagggaaagggtcactcactgaaggcagcaaacatcaacagcctttattagctatttattcccatgacccctagagattagatttttttggtgttcacttttgtcagggatgtgatagaaataggaagcacgttggcatgttatcaacttcagtgtacggtgaagttattcagtatctgatggtatcttgtagccagtggtgtgaaaatttaaaagactgctgtttcagcccagaaacaaaataatatctcagaatgattttcttgtaagtttttaagtaattctgaatctgtatatttagcaaaaatcactgtatatttagcaaagcaaatcattgtatattagtcaggaagaatgtgttattttgctcacggttcatttcacggggggtttcctggatattttatgcatttgtgaatgaaacaacacaggggaacgtggtcagattttccttggatttccttgcctaccagtgattaagtggtaggaagtgcactgttctctttagggtattttgcattgttttatgagaccttggtgggaagagggtgtaattgccaaacaaaaaaatcgcattgagaatcaagacttgttttgttgagtttaaaggaaaatgtgtaagtatttagcattttgtcaacagagctgttgctatccatgtattaaaaatacaggacaggaaaagcagggacgtctctgatatgaaccacaataccctagagaaacttggcattgataccacttccctgcattttgctcataatttatatttctttagaactggatgaaataattccagtcaaaataaagaattgctgataatatagaatgagtcatttcacaccatttcacactcaggtaagaagtgggacagagctatttatagatcaagataagacattcagccatagcctgctggagcttaagtcatttactgttttcttgtaggagactatcatacataaaatgcagccagccataagtgttgtgagtgagcatcatttgcagccaaaagcttgatttcctttattcattgaaatcctcagaagaaagggaattaacttgagttttgcaaccattcagcctgttgggttgaagacctcattctagaaatgtctttatttatgtcttacttttaaaatatctttaaatgctattctatacttggcattttttttttcaggcatgctgcaaagtactcctttgtgcatctgtttaaaatgaaaataactaaaactttctctccatcatgagatccttatttgaattcataagcacattatttcaaatcccaaatcacacctggccatagcacccacattattgctgagagagctgagagaataattagatatctgagctcaggatgctagtctgacagcagaagctggatagttagagcaaatgcaacccccttctgaaatgtcttgccccacaaaagacaaggaacagtttcttcccagctacttccttgtggtttcctctctttctctgttgactatttgggtttctttccacagtagcctgttcagacctcctatcccaacctcaaatatgatcatctaagagttcaaattctggtgcttgtggaaacctagatttctgctctagttttaccagtagaactccaaagtactccccatgtttcatttttcatttatttaaaccatcatgaaatagggcagtagatgaaaggaaattcctaattggggatccctttctaataagatccttaaggctctccatttccttgtggaactcagatatgagacagacctcgtcccctgcatacctccaggtccagtcctacctgaaggtgccaaagttttgggccaactatggtaggacctgagacacccttcctcaagatcggaaatcagtctcctctgcctatactgggaagcagttggctcactttaaattcattttctcaaaagggaataatcataatttgttaaatagcatttctgcataggctagtagtagttcctaagctgctctatttcaatttcccctcataatgatatactccacttcacttggaacttctaaatggtatgatgattcatctactaaataggagataaccataacagtggcatcccggacacatgaaatggaggagatgtccatgattctggcacagggagggttgctgtgtgcagcaaaaagtgtccattcatgattactgtgttctgagtagacattgcaggcaaacggcaagtctggattatttaactaagagcgaaatgccatctgccctacagcatctgcagcaaagatgacactccatttgctttcttctgtgacagtaggaaaatcagaatggcacagtgctcttcaaagtacatttactctaaacatagagctttaaaaaattagagacgtaagttggcatataattatgtcatatgtgaattcatgcattaaattctgcccctcagataatcagatttcaggaaagcaacaaagattcagttgatgataaatataatttagaacttaaagactggcagaagcaagatgagagggcttccttttgaatggatgagagtaaaaagaaagagacagtgttcaggttgtcacatgctaaaaggagccctgtgtagacgtgaatacttggtgaagatggaacaaaaagttacaggcataagacaaaacaaagagatgcaacttgaacaagcagccatgtaggttgtccatcaagaaaaacttaatcttagtcataggatttgactttgatataaatttacaaaggaagccatgaactatccatgacttaaggcaccaaatcttaactagacaaaatacttcaattaattccacagtctgtggtgctgcgtaggccgataatcaaacagaaaatcctcccggcttgaatccccccattttacttctaagttttctcatctttcagaatattttttgattacttacccttattttttattgtgtcaagtattgttaacatactctgactatgcctggtaaatgagagtaagttttaatccattttgatgcaaaaataaatatatctgtttcactaacttagtttagagctaggattactcctgagaatgatagctagaagtaagttattcaattatattttgtcttctaagttctcacttaagatgcttcttatttacagatcgtaatgaatgtcaagaaatccccaatatatgcagtcatgggcagtgcattgacacagttggaagcttttattgcctttgccacactggttttaaaacaaatgatgaccaaaccatgtgcttgggtaagtatgcaattattattatttttttcatatgctgttgaaagcttcatttgattctaaatatggataaaatttaatactaagtcttttagtagtatttttgctatatacaaaataaaaacacagacagatatgcagcagtgatatcctatttaatctttggcaatctgaacatgataaacctcttcctttgttattcatttggctgtcagtttagaaaaaattgactaaggggtaaattgaaaaagatattaatacaaaaatattaatgttaataggctattattcatatgtaatattgatgtggattttcttttgagtttttgagtgtgagatgaccatttttttggaagggtttatagtgtgtaccagattctcaaaggcaaatttataaatcctacaaaggcaaagaaaagttaatcatttttctagaggaaaaagagctcaggattttaaatctctttcctgatttctctattatcaggatgctgatttagaataaacttcagtgtgtaatgaatcattttcttcttttccttcctttatttttctactttaaagcaataccattaagtctttttgggacattaagaacataaatcagattcacagctgaaagaacaattaatatagtaatgtttaagtccttgactttggctatgactgggttcatccatttgggaacatttctcataaagttgtatcttctccagagtaatgacaagagcactgacagccctactcatcactgggcagctaacctgtgtaaaagctatgatgatcctgcccaactttctttctacatctctcatctgaattttctggagccccctaacatagaaccttcccaaccaaagaacttcaccaatttggctaaaaatgaatcaaggcaaaaattcttgattactagcaatgactcatctgggtgtagtcttcaaccacagacacacattagagtccctttgggttagcaatagcttcctgattcaggaatcacagatcatttatcttcatgtccaaaatgtgaaaagaaagggaatcctagctctaatcattacattttgctattctccgttgttaccttccactctctctctctctcatttcatccttgtccctcttcatggtgcctcattctttcaaaccagcagtaacaactttctttcattaaattttttattacttcctccttaatataatgtgcatctactctttataagaaatatgctagctgctgtgatgagatgcaaagacatataagatgtcagagtagctttacaaaatcatcagagaaaagtacggaccaatcaaaaggcgaataagaatgcaagcatgtatgaaaagaacaaattaagtgccatctctttggggtagtttagaaaagtgagagaagtcatcattggtggaagttgttctatgtttttatgggtgtagggaaaaaggaaaagttgtctgaaatgacaggtgagctagaaagctgagttattttgttgctgattgtggggtaatgccaggtgagtcactgctttttggtaaactggagtgagaatcttgaaggttgaagtttgccaaaggtggcaacacctcaagacccagatgcacacagagttttttccattttcaagtgaaaatatttgagaaaagtggcaagggtggagaattctagaagtaaatagaataaaataattcttgttcaggtctcatgtccttagcttgcctcctttcactggccagccaaggaaaccatttattcccaagatttagagctttgccgctgcctggtatcttgcagggatgactgctgctggagctgataccaacatcaagaagttctcagcctatggatgaggcctggtgaaccctaaaatgctctttagccactgtaaccgtgtaaccactttttctacttataattatgtttctttatggcctttcttcctactagacataaatgaatgtgaaagagatgcctgtgggaatggaacttgccggaacacaattggttccttcaactgccgctgcaatcatggtttcatcctttctcacaacaatgactgtataggtgcgtgtgcaaaattgtgcatcagcaaaggaagtcagttttatatgtgttctttgtaattagcatcatctctagtgttccagctgtcttttaaaaatgtatgctatcttatgcataacaattggttatgggacttgtcaaatacaatgtgctcaacatgaaatatattacagaagtctccccttatccgtgagggatacattctgagacccccagcagatgcctgaaaccacagatagtactgaaccctctatataccatgttttttcctacacatacatacctaaagtttaatttataaattaggcatggtaatagattaacatcaataactaataagaaaatagaacaattataacagtatactgtaataaaagttatatgactgtactttcttgtgcactgtctctctctctctcaaaatattttattgtactatactcacctatttttgggtagcagctgaccttggataactgaacccccagaaagcaaaaccatagataagagggaaccactgtaactatatccattacttttattaaaatgcttattagcagctataatttttatgtctactttgctgtaaattaaataaatttcaaaataaatggaattagattaagccaaaaaatttttaaatatacaaaagtgattctttgtatagaaattatatgattcaggactatgaaccttctggtctagatgtttcatgtagcctctcttaaataaatcattgaatctacagaatctccttctaaaacatactaggcaagagtaataagccaaattctttaaattttattgtgctataggctaatttaaatctaattgcaagaatacaaaggaatgcccttagctgaattgtgtattaggattttattttttaaatcaaaaaatttttaaatctaaaatttaaaaataaaatctaaaggaaaatcaaggaaaaactgataggaaatttgaatgtaaattgtcagtctctaatataataatgtaatcttattgttaaatgtgtataggtgcttaaagccagttctgttgttgcaaactagatcttcattggcatttcttgtttggctaagccagcaaaggccactaaaattcagaaaaagtattttttcttttagaagttttgattattgctgggattatgacatctttggaatatattaaaggattgttggggatttttctgcagatgttgatgaatgtgcaagtggaaatgggaatctttgcagaaatggccaatgcattaatacagtggggtctttccagtgccagtgcaatgaaggctatgaggtggctccagatgggaggacctgtgtgggtaagtacaggacttagaaagacctggaaagaatgcttccagagaccactcaaggaatcatgcagtctctgttctaatgcttctttctggaaacctggaggaaaagtcagagtagaattatattaatcctccctataaaggcttgtttttatttaagtatatatacacatatatatatgtatatatatatacatatatatatgtgtgtatatatatatgtatatatatatgtgtgtgtgtatatatatatatgtgtatatatatatataatcactttttcccttattttaaaaattaagctattgtactcaccaagaatactcaaactattaaacagtgaaattgctaaattgctctgtaagcaattgtgatttcccttcttaaatatttttctttaaaatacttttgtagtaagctctcatatcttttgagtatccttaaaatcttatatactcactgacttttcacatgctacaattttctggaaacatttaatttgatgcaggtaaaataaaatatggttgttatgctatacatttttgaaagctgataaagcttatttttattattgcttatttttctccatggtggaattttatgaactttaatttgctttatgtatttctttgattcattctagtttttttgaattttaattgtttgatggaagtcatgccagtgggaacctcttccttatttttcccttttctttgcagatatcaatgaatgtcttctagaacccagaaaatgtgcaccaggtacctgtcaaaacttggatgggtcctacagatgcatttgcccacctggatacagtcttcaaaatgagaagtgtgaaggtaggaaagctatcagttgtagcaaatgaggagtgtcgggtgtccactggacttagcagaatgagaatttttgtaatgacgtcttcattttggaatactttatcagaaacaaatgcaagggcataggtatgacatggtctcatccttctggcaagacaagaagcactaattatcatgctaatctctaatgaagttattttgttctgtgcatatgactgatcatatgatcctgactcttttccactgtgctttcacacatttgttaggaatgctgtgtcctactcccagtatttccgaactacattttttaagtggcgattctttgcagctaaaaatagctcctgattccatttaaaaactttaaatgaccacattcaaggttggatgaatgtggttatatcgtttgtctattttgtttttacctatagagcagtggaaatgtcttatttcaaataaattctcagcaaattttacagtattacattcctttttgtttgtttgtttttaatggagacagggtcttactctgtcaccaggttgaagtacagtggcacgagtatagctcactgtaagcttgaactcctgggctcaagtgatcatcctgtctcagcctctggagtagctgggactacaggcatgtgccaccatgcctggctgattttttaattctttgtagagatggggcctccctatgttgccaggctggcctcaaactcctggcctcaaatgatcctccttcctcagcctcccaagggccttcctttaacctcaacaaatatgtcatatcattaagtgaaggacattaattgctagaatttcataaataagtagggttgaaaggattttcaagaagtcacctagttcacacccctgactttaaacaggtctgcatctaatccacaatgagaattttctctacttttaatatcgtcaattagaaattttattatatatccaatttaagtaacaatcaagtggtgatatttaaaatggaaacaccttattgaaattgtctagatgcaaattttttaagcatgttattttacttttattaaaaattggctttattatcaatacataagttcgctaaattgaacagaatatatatagaaagaaaaataactgcacagtcaatgaatgtgcccattctacaatatttggccctatcctaataagttggcatgtacaggctaatttctaccataatataaatagtcatagtaataattaaaaacaactgaaaacatttgagcattttcacaaaagttaacttttatattaagaaaaggttggatataggggtggaaggagtgtcagaatggagtaattcaatcggcaatagaagatcagattcattaataaaccacagggaacataacacaggtataaatgcaacccaataacatggcatgatggagaagctgattttgcgttgcacagaaagagaatcacttggcattgcacatttctagaatatttattgtgtggtatttacaatattaagtcaagataataaggttaatttctcaacttttccttagttgggcctcttgagaataaagttgtataatgcaagtacattttggtgtgagtagaaacctttgcacaaatataaaaataaagagcccaggatacaaggatattttgtgttttgttgaaaaaataaaaaagtattctcataaaagtagcatggctcagaattaagacttaccactttgttcactaaaaattcctgctgaaagtcaggaggaaagataagtgagtttgttggaatagagtgggcatatttttccataggtaatcgtatgttttattgaccaacccaagccaattttgaaagtagaaaagggcactattaacaataaagtcaggccaactggcatgagctggggctcccccaggcaaactaggacatatggttactcaagccattcaaacttcttattggctactcttaactaccactgtacaggagctaagatgtataatatactaaagaaaacatgccacaattctaagtgtacagtttcctattgtctatatgatgaaagaaaaagcctgtacaagaaaggtatttttgtgtcttcagaaagattaacccacaaatcaggagtgtcatcttctatgatatcgttagtttgcacttcataggattatacttattttcatgagtcttagtgttcttgtaaaattcacagttttagggctatagcatagggtattgggaaaagttctgtgggtggttggaggggagtaaatttggatcaaaggcctagatctcacattgagtgagtcactagcaatgtgcttaaagtctcagcatttctgcttcctgaacaatggtgcagtgtgactctagaatttcatgcttctttcctggcctagggtactatgaaattactctgacttttctagttagccaagcaactcagtctgggtaagagacgtttgtcactgcaccccttagaaggcagttgcacattccatttttatatcaataactgtcaaaactaattcttttgaagtcatgacaacctagaagtccagtccacagtgttatggtacagaaaaatacctttattattgtaagagtttggaaactcagttgccctttgtgtgtccacattgtgtgtttggtacctgatgatgtctccatcgtgttttgactttgtttgactcatgtgattcttttagatattgatgagtgtgtcgaagagccagaaatttgtgccctgggcacatgcagtaacactgaaggcagcttcaaatgtctgtgtccagaagggttttccttgtcctccagtggaagaaggtgccaaggtaagtgtctttgaaggctttgggctttcaatgctgcatgtttatttgtggtggtcttatttttcaaacatggcaaagctctgtttctttgtgaacaggaagatggagagttttcattcacccagaggtctaatgataaccatatgtcagaaggttcattttcacttttaaggttaaaaactcatccatcaagttatggttgcttatacaattgtactgacacataaacctctctcccactaagaacacaaatgctgataggcccatcagtggggaaacaccttgagccaccgaaacagcaaagcctgggggaagttgagctacatatcccctacctctgaagagataagctgaaaaatgtgggtccaaagttagacttgagactgaaaaactgcacattaacccatttgcccccacaatatggtaaccatcccttatatcacaaattctccaagaaaacaaaaataaatttaaactgatcaggattcttgctgggccattgttcatttttaggaataatacttgtcaactatttgagtaaagattttcaagggtttgccaatgactttcaaattttaaacaaaaatcaaaaggatcctgaactttggcataacacagtatgtacttaagtcccagaaaactgtttagacttttctaaacaatacagttgtgtatggatatctacatacacaaactagtttcatgaattccggggaagggagatgaaacaaacacatgtatttcttttttttccacttgtagcttttgttgtttggttgttactgttgttttgatgttgagttgggttttttttttttttcatggttttttggttttgcttccgtattaccaaatatggaagaggcactggatatcatttaaggttcaaaaaattgagtttggggtcccagccctgccatatttagtctagagcaagtcatttaatcttttggaagctcaatttcctcattttaaacaacaataatatttgcccaaccagccttactgtgacaaagctttgttagtttctgagtcctttgtagactcttgtttttattctaatgatctgattaactttttacttttcaactagttatttgggaagtaagaaggagagggttgagagttctccggttgatttcagcttgttggtagttgtcagtggtctgtgtggatttcagggtggtgcttaattcgaacagatattctgcatggtacagaccagtcagataaattctaactcctactcccttgtttttgtgtgcctttggcttggcctgaatttggaaagaaagcagtgagaaaccaggtgtgaatctgccgatgtggcaggccagaggaaactcctaggctattaattcaatttgcactggcccatcacagagcaagctaacgctgcaggaagaatcagcccagctgtgagcagccctgccacatgctcagctccaggaggcagagccagaactgaggaatgcaagcagggaaagtgacttttgtagttctgatgaaatttcgaggtcattaagggctctttgcagatggactggtaaacaggcatcccagtgagtcctgaagtatgtgggcaagcacagctctcttccccaatgcaagacacccttgattaataagccaattctagagaatcaccacaagctaaagtaagtctcctacagagcacagattttgctggagccaggaaattgagagctgggtttttcttgtaagatgacaaattaggagtcagacttctattgctcatgaaatgagaaaattccacagaaccgtggataatgttttttaaaaagcgaatgccatgggactcaggtggacagagcctggcacaaaagaccacaggtgtaaatgagccactcccacttgcaaagttcaacgaagagaatttgccacttagactgactcaagacttcgtgcatttgagtctctgtctaatgccaagatttttttttttcggggtggagtggtgtgggggagatagagctggggtctgggacgaagtcagctattaaaggaaaagagaatgagaattttaatacaccaatattacaacatacatatttaaagaaacactacaaactggaagacaaagcagagttaagttttcatatatttgttgagacatttttgtgagtagtcactgaattatatctaaaggtagttggaggcataaataacaaaaacaagactgataaatacaaaacattatatgtgacaaagaacttgaagaataaaagagatcaaaagtgttctccaagaaacaagaatttgttcagtcttgaagtttctcagcaaagcaaacatttgggtggcagagatgccgcaggattgacttttattgctcttgaccttcagaaggataattcattgaaaggtgcttgccaggtccttgccacaacagatggggaagtggaatagaaattagagagatgatttatctggatgagttggtagccatgaaaggttgagcaggtttactggggaggctacctgaatttgatttacataacttggtaaatataatagatagatagatagaaactttaattcatgaaaacctttcctttgttatctctggcaactctgttattcctacattgtcttctttgtcatgaaataaaagctggtgagactgtcttaacagaagtgcttaggtggttatgatagtatggttcctgggattgaaaaacagtgatggaagtgaatgaaaaaggcagaggtggtcagatataaagaaagaagaatagtacaatatgggtatgaaagcatttcttttaaacctgcagattgtggcctctgtgtaatgagaggagttttggaaggctttaagaagtcaagttcgagggaaaacacagtccatacctctggttgagctcactttttggagtcaatgtgttgtatgagaaatggaaaagcccgtttccaaaattatgtcaagcaatgttggagaattttataggaagtagatcccatcttctttgttggagtcatcaaagcaataatcaatattgaaatatattctttcaaagaaagactattctgttcccacccacccacagccctgccctcctcttccttccctctctgtgttgagctaaacaagcttcttttaaaaatttaacattgacacagctctgcatatgtgtgtgtgtgtaaaatctacaaaaagccccacttgcattttgtagccagcatctccgggagtatctgcttcagtgaccaacccttgtgttgtatttttgcccatctacaaagttgccacttctgtatttgttctgtgcctgtgatctgggattttattttagttccagagtttaggggacacagaataaaccacaaagtgtgatatcacagtaaatattagaactaagaggattctcttactctagtgtgctcattaaacatgatattgcaagcagagctatcaatgaaggaatcttgtgaatgattccttctgtggactttccaatcctgaagtcactgacagatgtcagttttgaaaactgtcagttttggattttattggattcacatcgggttactttgaaatagtgactaaaatgagaagtaataaatttaagttcatagagttgttcatcagatctcactatacaaaagatacccatgactttaacaatctcagctcagttaccattagaatcacgtaaggagtattgctgtggtcctgagaggagaacatatataacatagtgggttgttctttatttgctatggtgcaatacggactcagtaggaaagcaactgaagggtgtcataaatttatgctgcagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatggtatgtctgtcatctgcatttctctctgggccatgcagggtgcagactggccatgatgtaagtaagactgtaggccttaaagacagtaacacaatttaatttaattgtaagtctaattagaatgttcattaaaaattattttatctcaggagcttggtagttattttctttttaattatgtcatgaatcacagatgcccaaggagtagacacaacatcttagggagtctcgttaaataacttcctctggtttctgggcttgttttttccatcatttatcaatatgcacagcatgtagcaattttctacctcaaaatgcttgtggagaagcttgtaatgaattgctattgttctatctattaatgagtgtctccaccacagaggccttccgccagatatgtccttatggaagtgggatcatcgtgggacctgatgattcagcagttggtcagttgcctgtgctggattctcagcatttctcagtattctcaatctgcttcttctctagttattcttatttttctccatctatcttggaaaattaagtgctacttttttgtcccttcatttagatagcaattatattattgcattattagataatcttttgattaaacactgaaatgatcataatttatcttcacgtttaaaaaataccttgttattcactattttttttctcttgcttaagatatggacgaatgcaaagaacccgatgtctgtaaacatggacagtgcatcaatacagatggttcctatcgctgcgagtgtccctttggttatattctagcagggaatgaatgtgtaggtgagtaataagttttcttccataggaactttacaaattaaaaattaagctatacagtattcactgtatagccatgaatataggtaccaagatggcactgaaataagttttatccatccactcatacatcattcatttagaatactagtgagtcaccatcaggtcccaggcactgtgctaggctctggagctgcagcactgaaccacaaagacaagttccttcctttcatggaccttacagcctaatggtgaaggcagacactggacatatcagaagagatactagaaaggacaacatcataatgaaagtctttgtgaaattttttaaaaattgttaatggtcataatcttattcccttatcaaataaaaattttatctggattcttttacatttagtaagatgaaaggctatataaccagtacacaatcttttttttgtaaccctgtttttaaaatgtcaaataatggctcctctggctggcctttgacccttaatcaacactaactctaacttaaatccaaggatcatatttagttatctaagaattccagagtgattcaatataacataattaatactagcataaatgctgagagtttgtctgtgtgaattagaaagtactttttccatacaagaaatcaggttatgaagatttcagctccagctatggctgtgggagtttaagcagtttttttagcttttctaggccttagaatataatattatgcaagtaaaataacatttctaattacctttgcagctctaaagatcaatggtatcgggatttttattaacttgaaacagaaataatattcttgacagtaattgaatattatagtagaacaaaagcaaatatttcaatgttttctcctcagaatcttcagttagtgctaatatgtgcatatgaaatgagcctcttcgcctaggagctccccaccatagcctcttgcctttacttttgacttaagaacctcagcacaagaaacaactgttgacaagagccattactcttctgtgccttagatagctaaaatatcaatgttatttctcaaaattatttctttcctaaggggagatattctccccaagggatgtgtcagaataagaatggtgagtattctaggtggatgggttagaaggcatatatacacacacacacacacacacacacacacacacacacacatatacacatatatatacacacatatatatacacacatatatatacacatatatatacacacatatatatacacacacacatgcacacacacacacacacacacacattttaggtctctggtcaaagatttgttctctccgcctgtgttttagagcggtcataacctaaacatatttttttctagcctttcctcttcctaatgtaaaccatctggtttcaacagaatcaacacaatctacttgaatcttgattttatttgatgtattaattttacttaacctctggtcttttattttacgtaagtttagtcttttattttatatctggcaaaaatccatcatgtttaaggcttcttggggagtgatgtaatgtaaggccaaactgtggatgtatttctgctttaaacaagcagaaacttttgacgagtgataggggcctttttttttttaacccttagagcatctactccaagtagaagatttagtttataatgtgggaggctggagaaactcatggagaagagcactgtaagggctatatgtccaggcactgtcattctcactgtcattgccactgccactgagcaagtcgaatttcacggctataaacctgagataataagacatgcacactccctttttgcaagaacagaatgagaattaaacattacagatcaggctgggcttggtggctcacacctttaatctcagcactttgggatgccgaggtgggcagattgcttgaggtcaagagttcaagaccagcctggccaacatggcgaaaccctgtctctactaaaaatacaaaaattacctgagcgtggtgatgtgcacccataattccagctactcaggaggctgaggcatgagattcacttgaacctgagaggcagagtttgcatgagctgaaatcgcgccacagcactgcagtctggatgtcaaagtgagactctgtctcaaaacaacaacaacaacaaaattacagtttaaaatcctctgatagaataaaaggtattatctcaattcatcatgttttggacacattcctggtttcttgcagatactgatgaatgttctgttggcaatccttgtggaaatggaacctgcaagaatgtgattggaggttttgaatgcacctgcgaggagggatttgagcccggtccaatgatgacatgtgaaggtacatctcttaaacagagaacagttgattacgtgtactgatcctgggaacaattggttgattacaagtcttaatattaaatacaactcagggtgtatataataaagatcatctaggcctgatgggccatttgatcattcttcttttgtggcctcttctctgtagggaaagagagatatccaagaatgatacagttgtgtgttcatggcacatctacactgtatatcacagagagttctcattggtgtttccctaccacttatatttagatgcttccgtgttgtttaataccttctttcttactctcactttctccttctttctgtctctcatactccctttctttttcttttctctttttctcttcttttctatttctaggagcactgcacactaagatacccaccatcatcctgtagccatttggaggcaatcacagcaaaagcggttgcctgtaatatataagcatctgaaaagtgtccatccgtaagcctggtggaatgtatggaaagaaggaaagggagggagtgtctagagcagtggctctcaaagggtggttcccaggagcagctgtatcagcatcacctgggaacttattagaaatgcacattgtgaggcctcatccaagacctcctaaatcagaaactccgagagtggggtggagcccagcagccctctaggtgatctgatacactctcaagtagggattcactggcctaaggaaagaatgaaggagaggtgaaggcagagaataaagttggtagcaaagagagctcttcatcagatatgatctatcaaatgcccattgtcagagttgtggtaaatctttaaaggttgtgactaagtcatgatctgggctctcactcgtgttcttagtcagcactggccttggggagcaacatgatagttgagatggtctattttaatcctgcttttccaaaacacattctgatggttccaaactctgcagtctgcagaaatgactttttttccattaacagtaaactcattcccatctatttaaggtttgaacatgggcatctgtgtaaactgagtgtctctgtcagtataaaatgatctggaacactatttgcttgggcagaagaattgctgttatttcacaggagcctctttgtttgggggaaagagaggtggttaacaatattggaggagttggtttctgttctgaccacaattgttttggcggaatggggcaaaactgattcccacgccatgtaactgttgggagtgacaaatggtcaacctgagccttctaagccaaaatttcagaagagcccctcaaatgttgggtggcctgtaatttcccatccacctaaataatcattaataattataccaggacaacaaacataaactgggactgtgctgggagaaccgggatggagagtcactctgtttataccaaatataaaataatcaacccattttataatttccgggaaatgggagaccacttgatccatccatgtttatgacaatgaagcattgcaacttttggtaaagttttagagttttagttcaattggtaggttcccttttgttgctgtccatgatcccttatttacttactctcctctgctgcagatataaatgaatgtgcccagaatcctctgctctgtgccttccgatgtgtgaacacttatgggtcatatgaatgcaaatgtcccgtgggatatgtgctcagagaagaccgtaggatgtgcaaaggtgagtcatcgtgttcaaggtcatctaagccaggaagctttatctgtgaggggagatgtccctcaaagcttcccttagtaggagaaggctgggaattggaatataaatagtccgtggacaatacgggggttgtcactgccacgtttccccctaaattgtagctggaagcatcatcaagccaagttgaggactgcactgcacatcctttattaggtctcactgtgcatcgcatgctcacaacacgccagtatttctacaagatatgggaatagaaagaaaaagacatttccccacgttcaaaaaacccaatatgaagagattgagacagatataaatacgttctcataatacagtgtgataaatgctatggtgattatatatacaaaatgctctgagaacaccaaaggatattctatttcaagaatggggtaacacgtggaatctactttagctaaaccatctccattaaaaatacctcctgaacacctgcaatttcctaagcactgaactaggctctatttcacaaactgcagtaatcatagagtttgctcttgaagagctctgatttgctcctgtcaatatcttaaatgaacagacacctgttctctcaagatggcgtaaatataattttgcttaagggtggggaaatttcctaaatgaaaggtcctaatcatatgcagaataaatttcaaatttctcagctcagagcatgtaaacgggaaagatagaaaaataaagaagtacaataggacagaaagtaaagactgaggaaggcccaaccaagtccagaaaaggaaatgaaggagggaagaaccagtagagaataagatatttgagatatataatataaaatagtcatttactattatatcctgtttactaatattatcatataaaaataatgtcatattggccaggcacggtggcttatgcctgtaatcccagcactttgggaggccgaggtgggtggataaccagaggtcaggagtttgagaccagcctgaccaacatagtgaaaccctgtctctactaaaaatacaaaaaattagctggcgtgatggcgcattcttgtaatctcacctacttgggaggctgaggcagaagaattgcttgaaccccggaggtggaggttgcagtgagctgagatcatgccactgcactccagactggatgacggagtgagactccatctcaaaaaaataataatatcatattataatatattgtgttattattataattattgcataatgtaagctttggtttgttactcttacaatccattatgattgtagtactattataattattgccttatcatatattgtgattataatgctgttataattattgttatattaagatatatccattatattataattacatgaggcccttttagttcaattagtcaacaagaattagaaatcatgcttcaacaaaggagtataaaacataaagggacagccaggcacgatggctcatgcctgtaatcccagcactttgggaggctgaggtgggtggatcacttgaggccaggagtttgagaccagactggacaacatggtgaaaccccatctctactaaaaatacaaaaaaaattagccaggcgtggtggtgcatgcctgtaatcccagatacttgggagactgaggtatgagaatcacttgaacccgggaggcagaggttgaagtgagctgagatcgggccactgcactccagcctgggcaacagagagagactctttcaaaaacataaataaataaaaataaaaataaataaaaaataagggaaggagaagagagaaaaggcatgatcagaatcatgcttcttgaagaggtcatcagttgattagggagcaatttcttcaagttcaaaggtggttagaagattcctttccattctttagagatcatactcaacagagcagaaggaaatacagccagtagtgaaataacagatgaaaattggttacttactaacattttatgtttaaaagtcaggtaattaaggcagatatatgcattttctttgacaaatttgtgattgtacattttttacagatgaggatgagtgtgaagagggaaaacatgactgtactgaaaaacaaatggaatgcaagaacctcattggcacatatatgtgcatctgtggacccgggtatcagcggagacctgatggagaaggctgtgtaggtaagaggatccctgtggaaggagctttgagtgcatcagaagtgacagtggacagaaggaacctgggctctgagttcttgggatactgttcttggcgagacccattttgttctcttaaccgcatgtcaggactctccatggtggttcccttgcctcgtgatcatttgtgaattccaagagcactgtcattgtccctctgatctggcctttgtctgctttcttgacccatttgctgccaggatttgaacagcatgccttttctctattctcctcctttactttccatactcttttgttgatttgggggtcaattctccccatcacattggaatgcttccctattgacttagctttgctacaaatgccaggtacctctgaatcaggaatatctcaaaaccattgggatctacctccagaaaatctggtcttgtctagagtagcatccaggcactgatatttttttaaagctcctcagctgattctaatagggatccaacattgaggacttcagccttagaccaggagttggcaaactgcctacaggctaattccagcctgccagcccactgtgtgtttttataaataaggttttattaaacataggtataaccattcatttgcatattgtccatggctactttcatgccacaatggcagagctaagtggttgcaactgagaccatatgacccacaaagcctaaaatatttcctatttgaccctaacaaaaagtttcctgacctctgcttagataataattacaggagaaaattattaaaaccttctcacacgcattctctttctttttaataataaatggtattataaagatatattttatgttgtcattcaagaagattaagaatcccattgcccttttactctgtacaatacagattgaagcaggaattaaagaacagattctaaaagcacagaatcagaaaatatgtagattaattgtcacacactggatcctcctggatcagtaattctcaacctctgctgcactttggaatcatttggggagctcaagtccaacctcagatattctgattgaattgttctgggggtggctggggcattgcattggggttttgaacctgttttaacactgttctggattcaccttccaactttctctctttcctagtgagagctccatctgagggaccctgaactattctcaaaggaagggaagcacctcagcaaattatttttgatctttctaaataatcatcagataattctaagaatctgtagatattttaatgtttttttaaacctgggaaactgagttgtagtttatgatttcttaataatattgttgaaatattacaataaatgcaacctatattggagatataatctaggttaatctgaagattaatctagacaaactcccccagatcaatattgaccattacagatattattctaacatgtattaaaatatttctttcatatgctgatattcacatttttccctccttcacttgaaataacactttgagagtcctttttatgtcctaatatgaaaagatttaaattttactaagtgaaaaatgtaagtgtgcataaaatgctaccatctatgtttaagtatataaaatgctatcagttaggcttttaaaagatctgaagtgcacacacacatacacatattatgtatgtatttgcttttatatgcataatccagctctggaaggatacattagaaatcggccccagaattggttgcttttcaggaggggagtttggtgtctgggaaataggaaatgaagggggtacttttgctgaatctccttttgtacctttttaattttgaaccatgtgaagagataagctatttacaaactatataggaaagaagaaaatctattcttctataaaagattcagatggctctttctgttttcagtctttcaatgaaaccaaacagttaagaatgaattgaagtctcttttataccttttaaattttgagccatgtgaacagattagtgattcaaaagctaagttaagaaggaaagatgtgagagagggaaggaaggtgagagggagggaagggaggaaggaaaggagaaaggaacaaagggagggaaggagggagggaggaaggaaggaacgaaggaaggagctccatcctctataaaatggtcagatgactcttcttgtttttggtccttcaataaaatcaaacagatgagaatgaatgtcagacgaagccagggatctgtgagaatgggcgctgcctcaacacccgtgggagctacacctgtgagtgtaatgatgggtttaccgccagccccaaccaggacgagtgccttggtgagtacagttggcaccgcactttcctaacctcagcctccacactgggatgctggaaacccagacttcttatttaaaatacaagaaaatgtcaaaatctgaggaaggataaaaaatgttcatattttggagatgccgtaatgactgtgattgtccattgggctcagcaccaccctgcagctaaattcttcctttgctaattggatcctgaatcacttgtttggaatttcttggctgcctttgaagcccttggtgatcaggatccacttccgtatgtttctctgcccctctgtctgtaagcatggctattcccctgtatttctgggagcagagagagttataagcttgtctaggccaatgtctttctgcctacttactgaatgtcttatttgtttccctcagacgtcatcctttctcttttactgctgtctccagctttcccctcttgcttcttctcacccagggtaaagtgttacatccttttttggtttttatatctgaccaaatttttaatattttgtttgctcttaaaatttcctgacatcccctttgccatataatgtcccttccagacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcaggtacttcatttatagtccaaaaatacttgcagggaatctatttatttgttttttgtgtgaaacacagatgaaaatatggagtttgcaatatgtgcctaggttgaattgcacagctgaggccaacaaaaattcttcattatggagttttagacatttgaggtcatgctgccaaagtggccttggtccacttgattaagctgtgtgtgcttaggaccctccctctgcattccagcgagtcttcaactttttaaaccgtttactataagtcaattggctactcagaatataatttttaaattttttagataaactttgaaataaatgattattaaatgtgcaaaccagtccaccaagatgtggaactcctaaaactggccaaactgtattgcataaaagaagtataaatcatgctgatatcctggcaattagacacaattgcatctggaaaagcacaagctccttaactagagcaggatgaggaagtgtcagactgtctaaggcaactctagagatatctaggcctgtcaccaatatgattcctgtgtttatcaactgtaactacaattggtttttagttcataaaaggactgagaaaaggtgagagcttttttgagcttcttgggagggaattagaagtgaaaggggaagaaggaggttaagaaggatttgtgtttgtattggaaagatgtggctgaaggcagaataatggaactggatgtgatttaaaaaaaaagaaaaaacagacctagaaaggtaagatggagtgaccaaaagcaatttatgattctttggaggatgtagcaataagatagccgaaaaaactcacttctggagaccaataagagtgtgctaaattgcacttcagagtagacttgtaaaggtcagatacacccagctgttggtataaaatggttatttggcagtcaagggctgagaacccatgtagaaagtgcttgtatcggcacttcgccaagcagtaaggaggtaaaatgggtcaagatgtggaagacagtggttttaatgctcaacagtgcatattgacccagtctttctctctgtggtacagccatgagtgagggtctcccttccttagcaggctgcaaaaacccagcactgtcatccacctcagagccctggttagtttcccccctcaccagaggacagaagttcatctcatttccccaatattatgtaatttgaactttttcaggattaaccacaaagacaacaaaaataatgtaaaaacaaaaaacaaaaaaccttacttattttgagcatgcaatactagggggtggaaatggggtttcctcatcaaaaggatctgcttctgtgattcatttattagatgtcagcaggaggcaagcttaatggcatgagatgacacaaaaagccaaatatgtctagatggggtggctgttctatggatccagaagagaaaaatatacatttagaagaccagttgtttttaaagtttttctgtggctgaattattttatcaattgtagtctaatgaagttatttgtttaccttttgatatagctactgttacatattaaatttatgctgtcatcttactggtttaatttcttaggcccaaaatatagtaacacaatttattagtatttacactgaagtgaccccctacatattaatgttgtcaattttatgatatatttcttaatttatatttgttaaattacagatatcgatgaatgcaaggttattcacgatgtttgccgaaatggggaatgtgtcaatgacagaggatcatatcattgcatttgtaaaactgggtacactccagatataactgggacttcctgtgtaggtaagtgtctatttctgatggcttatcctcaagtggaaattttagattatggaaaaaaaaaaacccaaagctaaaaatctaaaaagtctgtgcagtttcataggaaagcacaggacaatcatcaaagtctacacagagtttcctttttctttccccgaaactaaaattcttcgttagaccctgtggaaattgagcgtgtacacatcatttttagatgcacagtcacgctgtatttctttgatcatagatctgaacgagtgcaaccaggctcccaaaccctgcaattttatctgcaaaaacacagaagggagttaccagtgttcatgcccgaaaggctacattctgcaagaggatggaaggagctgcaaaggtaaagtagaattgaccattgcccctcacctagctcctgacacatggctgcattcctttgcctgtaagaactccacaggcaagccgaaagacctgctctacaggcaggaggtgcttccctggggttaatgcctccatgggacctacctcctgtgctggagggaaggaggctaaagccagggagattgtggaggaagcagctgtccttgctgcatgccccctgggcatccatggtggccatccatgactgtctcagagatagcagggccagcttcaatggctctggtggggcagattcttaattggtgacctcctctctgctttctgttttttgtatttattctttatagctatatagttcaggtttccaggaaggtcctgcctcggaataatcagtgccatgatcgtagaggacattgtgcctaatgaattagatgctgtgtccagatttttgttctgcagaaaaagtctatttctgccctgtaggagcttccctgagacataaatatcacacagaattaagaaccagaaaagctctgggcagaaatcccttctcaaccagaagttatcctttgcaaaatttttttggtttaattttactcctgtaaacatcttcctccacaataagaacattatatttagtgaatagcactagtgagtcatacttaacaataatttgggaaatcagagatttggagaagaaaagatagaccaagtggtagagcaagagatatcatgtcatgccatgaaactttgaaggaaatttatagaaacatacagaagtaaggaaggtaaaggatagagtggagtctttttcctattttttctcataaagcttaagttcttccacttacttggtatatataactaaatatcaaatgaatgatgcagctgtgtgtaccactgaactgagaagaggctagaagggtggagggtgggaccagcacatccccacggaggatccagattggaggagaggagaggagagaagtggagagcagagagaagttgggctcttgacctctttcctgtgtctgctgaaagggagagttaagagacatgtaatagtggatgacatcatgggcaagtgcctgaggccttcctgtgcagcacaaagcctgtataatcctgtagtttggggagaggaagttgagagacctacttacacattctaaacatcttaaatgaagtcgctcatagctttgttcttctcaaatgtggaacttattttacatctggggtcactgtgagttctaggcaatgtgaagctataactcagagccataaatttattcatataaatgaagaaccaaattcaaggggaaaatatctctcattgtatatattatctgtaacaagcaaaacaaatttatagcattttttctaacctctgggggcagaaaattctcaaaagtttccagcaattaaaagatgaaaaatgaaaatgcatcaataaagttctctttatggctttaggagtgcaaagagcaactgtaatttttacatgtccactcacaacttgtcccttttcctgttttttcccataaggttcaaattcttccacttacttggtatatataactaaatatcaaatgaatagtgcagatagttgcaccacagtcactgagaaggaggaagccagaagggtggccgtgggagcagcacatccccagtgagagatgggtagaatgcagattagaggggagaagaggaggaagggcatcttggaggcaagagcagcaagtgctgctgttcttcatgtgttgtactcatgaaatggtgttaggagaaatcactgagtcatcttcctcacctgttgcaggtgagcttcagcaaatgtgtcatgatgctccagccaagctccttgggccatagacaggggaaaccagtccacagactctgagaaagctgaacagagagtgcatatcagtcaagatctcagcagtggaaagagcacaggacaggcagcattataagagaagccggaactaggacaggtctcgggagggtctctcagtgtaggtccactccagatgttactctagccaggaactggccctgtggagtggaagcagtcactggcaaagctggcactgatctgcagctccaaagcagttgtgcagatggtgagggcatagtggttgaatttgtgataaaataaagtcactaatgttttttcctgaatatgcgacaattttaaaattatcattaaagtttagctagaagctagaacacaacatttcatctcttggtattttgaaataacattggagttgagaatgcaacttagaagttgaggcgttgagaaaagaggcctggtcaaagcagagggttttattgagatgtgggaaacaatgttggataaacactgcaggcagttgtcagttttggatttttgttttttttgttttttgttttttgtttttgtttttgtttttgttttgagacgaagtttcactctgttgcccaggctggagtgcagtggtgcgatctcagctcactgcaacctctgcctcccaggtagctgggattacatgcacacaccaccacacccagctaatttttgtatattcactagagacaggttttgccatgttgcccaggctggtctcaaactcgtgagctcaaagtgatcagcctgccttggcctcccaaagtgctgggaatacaggcatgagccaccacgcttggcctggaggcagttttattaaaagtgcctttagctattaaaatgaatttttcctttgctttgtttccttcctgattgctcaattttggtttatcctaagaagaatcacgactaaagaaatcagattttgtttttgatgacttcatttgagtagattaaaaacagcaaacagaagagaactaagccagcaaattcatttccagcttcaacatttctctttatgttttaacttaaatagatcttttcaaagctctggaaaatttgcagaatcattcatctttcgcttcatttaaaaatttgtttaaaatgtcatgatttatttgaaattcctttgttgaggaattcctgcatttctccaattagaattgtgttttcttggatcccctaaagatctctttatatttttttgaggggaggagggtctaaattgacaccttgttttatctttcagatctttaccccctgtgtctctccttgccttttgctgtggcttctttctagtcagggtcatttgagacctccaaatcaaacgtggagctgcttcatagggtcagcttccctgatcctgttttgttggcttgactcaaatgcctctcttgcattttcttgtagatcttgatgagtgtgcaaccaagcaacacaactgccagttcctatgtgttaacaccattggcggcttcacatgcaaatgtcctcccggatttacccaacaccatacgtcctgcattggtgagtaggagaggaaaaaatcctacatggattgtagcgattcttttaagggattattttctatttcctctgctgttgggataagaaaataaaagctcaaagaaatatatgagtgcatgtatgtgtgagcacacctgtacatgtatgtgaagagttgttggccttatttggccttttccgagttatccttctaattttcttttaaatgatacaaagagagctttggggaattttaacccctctttgcccccactgcttctcatagataacaatgaatgcacctctgacatcaatctgtgcgggtctaagggcatttgccagaacactcctggaagcttcacctgtgaatgccagcggggattctcacttgatcagaccggctccagctgtgaaggtgggtggagacttcagctgcgatccagctggtgaatccttgtggaggtggcctgtgtggctattggcaccttcatcatcagcctctatgagatagcagatctgagcccaggggggcactcagctaaaatagtgtgcacaggtcctgtatcttagagagtcgtgttttgtttcatgcttgattgtgtctaacacacatgcctttcctaagtatatcaagactttttctgctaagtttttaatttaacctaatagggaataactcagtcaagaaaaatatacttgattttgattcattaattttctggtcactgggtccagagccataaagggatttcccccatgtggactaaacatatgaggaatagctcttctgatgacatttaattagaagtttaaatgatatttttagaagttgactgtggctttgacacgttttggtttctaattgtggcaccaaaaataaaaaaaaaaaagagcaaacacaaataacttataacttacagagctgtcccagagagtgctttgggctttgcactaatttcctgacaatttttatttgtagactttgccagggctctctgaatgattttctccttggacttagcagcagttccagaagagagattcttgaagtttttggtggtagaataatgtgtaggatgtgtaggggccagatttcttattagaatccatctggcttcagagagagatgttgagttggcatcatggtggctctgcttctttttcagacgtggacgagtgtgagggtaaccaccgctgccagcatggctgccagaacatcattgggggctacaggtgcagctgcccccagggctacctccagcactaccagtggaaccagtgtgttggcaagtaacttttcctcactctcaagatgcatggctatcaggtcctatgaagcaaaacactgcttgctttctgaagctgtaaatgtgttattgaagcaacaaatactcatttaaaattgccctaacctggttgaaacccgaggtaagtaacagtctttgcaaaacagcaaactaagaaaaaaaattataattgagggtgctttgagagcatctgaaatgaaatgcccccagaatttcttgaagcgcaatatcctccaccctcccgctgcactgctagtcatcagcccacacttgagttatgttcatatcaggggtcaaaaaatcttacttatgactgaaaaatatcagccagccaaaggctattttgagtggcttttggcctgaagatgccaaagtagttctgttcagctctacacattttgagacagagcgcaagcaggaaacacagcaaggttgtgtttttttgtgtgttttgttttgttttgttttgtttttcaagattgctaaattcttttgataattaagggagatctactgactctctcattaaattgaaatgatgtcatctttgattctacaatgtcatgggaaaataactcttaatgcacatcagagaatcaaaacattgtgagtttggagggataccagaagccacttagctcaggcactttgttttacagataaggacctagaagtccagaaagggacggtaatatttccttgcccagttcttttgtgacatgcttggaactagaacccacaactcttaactttctgatgtagagctgcctttcaagtgtcacattcacttgtttatgttcattcagcaagcgtctgtgaagtgccactgcaagcttggtgctttggtaacctgttctagttgccacattattctgtacagagccctccttagcaaaaactcaaagaattactgcttcccgggtgcaggctctgcattgcaggggttcactttcatgcagatgaagacatatttggtgtgttttcatttatcaaaatcatctctgtcatctagtttgattctacacaagacagttttgcagtggcatgtagggttgactgaagtgacccctgtgctataggagtttcgactgcgtgagtctctggctagctatctggttttaataaaaatgtctttgttcattagcagctcagggaggtctttgattttaatcaccagtttctgacattgttcacagaacttccagagtgaactttgttgattcaacacccagtttatgagcctgtctgttctcattatttaggtcattttaataacactggagctaagtgaaaaaaacataagagaggaaaggtatgtcgctcctgtaccttatcctcctcctcctaccatcagtctgaggatggtagaggcgaccaggccatgcactagtgtcctggagattctgctctggtctcgtgaagatcatctcctggctggacactctaaaaaaacaagttgatttagaagtcagaagaagtttggggttcttaatgtctccaaatgccaaattgctctcatcaatcttgagaattagagttatctagaatgagcattgccgtgggctaaaatagcttccccagaaccacaagaaacagagcagatctcttagaccagccctccctggatcctcactcccaggtggctggaagttcactctttggggtaagagggccactaatttcattgctttctagaagtaaatttcaaaaaattcagcttgcagatagatagagttgacccattttcccctagagaaaatgagtaaaagaaagcccatcctgcatttgtgaagtttcctatcggtactcccttaaggccacagctaacatgaacagtgcaagctggatgctgaaacctttgattttagaggacagagtggtgggtttcaatccacttttaaggagtagttttcagactttaatgctattttggtaaaattcgaattgtctctttttataaaacaaacaaaaccctcaccaatctaagtaccaactggaagaataaaacaaatattttggagtgtaaaaaaattccttgtggagtcatttgctccagagtgcagaggatgaaaaaggtcaggaaaagtgcaaaacatgttaaccaaatcgtggtgtttgtatattgataaaaagggcgagtgcacaaacatgctgttttcaaactgtaaacactgaatatttgccaatttcttattttaatctgtgctctactccatcctacctctccaacctagataagcaagtttaatttaaactttattaaattctcagggaagggagaaaatgtaaaataaaatttaaaagaatgtgaaaggagagggggagaactcttgatagttgtagtaacacagatagatgctcaaagttaaaaagaaccttagagatctagccttctctctttcctaatatataaatccttctctaacttccttgcttatcccagtttggcttaaataccaccttgaagggtgcccactttctcccaagatagcccaatctatgtatagacagcttttaatacttagaaatgtctttttttgctataaaaaaaatcatttctcctccctctaatttctcaccattggtcctacttctgctctttggaggaaaaaacacagaataaatctaagctatagaatgacaagtcttccccctcatatacccacgccttgcaggttttattagtcagggtcccagcaagaagcagatggctgaggccaaccaaaagtgagggacaggggagcagagcttgctcatgctccatagatcagccacctggggccaagagcaagtggagaggatggaggatggacgtggaggagcaagaagacatcagcccaggggtgttctctccaatgaagtaaatatgcttcgttcttcattctttgtttgacatggagcttggtgccagtggtttctgttgctctctattgcacacttcgtcctcaatttaaaataaggagaaagaacacagataacgtgttgagcacagaaagagaaagggaagaatgagaaagataaaattattatttatattttaagagccctggagcctaagtgaccttgggtgaagacttgaaggtctttggatacaaaagattttcagacaggcagttaagatcaaagacctgtagctgaagggaaggagggaaagagagaaggaaggaggggaggagagaaggaaggaaggaaggaaaggaaggaaggaaggaaggaaaggagggaggggagggggggaggggaaggaaggaaggaagaaagggaaggagagaaggaaagaaggtaggagggaaggagacatggaaggagggaaggcaggcaggcaggcaggtaggaaatgtgaatatatactaagtatatacaagtgagcatccttccccaccacttttatccacctgttttctaatttaaaaaaaaagaaaaaatagatttgttgagaaacattatttttctttataaatgaatgtgccttagcaaagaaggtaaactaattacaggagaaaggaagcaccagcttaaatgtggagcgtctcttgagaggcactgtggtataaaggaaagcgcatggatggcctttgcagtccaacagacctggctgtgaatttctgccctgctgctgctggctgtgagatcttggaagagctttctgagcctcactttcttcagctgtaaaacagagaatataatacctctttctcaggattgttaggaaagctaaggaaatggtcaatacctgtatcctatctatcataaaataggtatctaataaacattcattcccttccccttcctctcttccataggaagtggttattcgctaagtgaagagaaggccaatctatctacattcaaatgaacgtatgcctgaaaatggactatggcagttaagaaatgtcttaccagcaactttccaacctgccctgcaaaggcagatctacaaaaatatattagagacttccaaaaattataaatcagaaataatgagaaactcatggttttcccccttctagctgatttttttaaagtaagatttctttttcctgcttcttagcatcagacttggcaggtccctgtgggtagccagccctgcagcttctgtctcacttgtgggttttccccaattactgcttgtgaagtctgcaccaaatctcttccagccacacttagttttagacagggctcagacactctgggcaggaggctggtttgaataaggagggggccgattcggtgatgggagcagacataccagaaggcattattcatctcccagaacaggtacctgggggcttttgcagaattttgaaaaggaagtccaagtggggcagacacgtggggcagacacttggggcaggatatcagcctttgccagatcagcatatcctgaaataggctgacagggaaagcagcctgcgggaaaatggttggtctctgcttttgagagatttgtctcctcgctgggcacttgtgaagcaagtacgcagagaactgcaagattcctttcctccccccttgaaccctaaatcttagctacggaccagccccatgttggttcatgaccggatgtttacatggagcagaagataccagtgttgacttctgatgagaactggagtctgctggtcctcagaatgccatcctctaatgccctctgcctggtgcatttgacttcatcttccatgtttcatcttccatgtttactcacaacatagcaagaagccacatccatgcccgcatctttctctgctgttgctctccccacccagccacctctgcctgtcttaccttcctgagagcctagctgagggccagctggccggcagcaagtggccagatccaatgtcctcaatagaaatctctggctgctgccacacatgccgcttcttattttgcctgcagatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggtaagcagtgctcttcctggtcatggttggagattctttcattcgtaatataattaagtatactgaactcaaaattacctgtcctagcagaggagaaccatgctttttgtaatcctaaaattaattccagttagcttggcaaaagttttaggttattttatttggaaggaagcatctggatttctggaaacgtcaaacaaagtaatgaaactacattgtaaatatctcgctatatgacttctctatcttattctcttgatcttcacatcttgttgggaagtgattcatctctctgtaaatacacctctctgccaacccatgacagaactgggctcaccctgcacacgactgatccactcttctcctggggcagggaggattctatctggacttaaaatgcctttgtatctagctcctgttagaataagtcaaagacatccctttgggttgaaaattatttagggttttaaattatattttacatttcagacttgaatttacattaaattttaccaaaggtgcattgaaacacttactgtattttcctggttaaaaaaagaaaaacaaaaaaaacacttcaccaaattataggtgtgtctgtgtgagagttggggcagggaaggcctttttttttttttttagacggagtcttgctctgtcgcccaggctggagtgcagtggtgcaatctcagctcactgcaagctctgcctcccgggttcacgcgattctcctgcctcagcctctggagtagctgggactacaggtgcccgccaccacgcccggctaattttttgtatttttaatagaaacggggtttcaccgtgttagccaggatggtctcgatctccggacctcgtgatctgcccgtcttgacctcccaaagtgctgagattacaggcgagagccactgtacccggccgggaaggcctatttttattttacccagtgatttaaaagtttagtgttaagttttcaaagtttggatcttttttcctgctgaattaatctggactcgggtgtccacctagttttagctatcctgagaggaagtgcacattttaactttttaattaggaacacatagacattaaatatatatatacattatgtactcctccacatgcgtgtacacacacacccccacacacatccacacttacaccaaattattaatgtagcagtctttgatttcttgacatacaaacatcaagtgattcattttggatctgggtaggtagaagaatgtttcgtgggaagcacacagaatgccagcaatcagacacaaattcccagatgtttgtgtctggctctcagtagactcattctttatagtttaatgccagaaccatttcttcccagcaaaaattgtgacactctaaactggcttttggccagtgggattttgtagtcacacttcttataagtggtgctcccgggatatgaaaatactggaaaggagttctgagaaaggaaccaaagcctgcaaatttgcagtttacctcctaataatttaatcattgtgtgaatgtatacgcatgcgcacacacccacaggatgagcatttatcacttcatccattgtattgtttctacatatttcatgttgcaagataaagaggaaaggaaatgtattggactctggcaagattgggggaaacagtaggaacctataaactgctttgaaatacaacagatattctgttcattggcaacatattttgaatcctaagggtatataggaaaattagttctaaagagcagatcagctattacagaaaaacagataaataatttttggtctatattatgacccattgttagaaatctacccatttaaaacagttttggcctctccgaatcactagaatggactctgcccccaaataaagattcttttaaggaccattcaaatgtttcaacacatttggaaagaggagcttgataaatacacattccaagtggcctctgaaatagtaagcagaataacaaaacaaggtacttgtgaaacattcgagcctccctccgtaacttggctttgataactgaaaggcaaagaaaaacagctgaacgagttctctcttgggcatgggtttgtttatccatcttcacatgagtcggagccagtggccctagtggttttgaatgacttgaaacagtttcccacagttgggcaaactctgatacatgcattttatatacggcatatcttcatagtttattattaaattaaccttcattatcaaccggagctttcttcttatcctcagtagcataagcaaaagtgaaacgtcaaggaataggagcaattgctccaaagcttgagtgaggaaaagtaatgatggaagtgggagaatgcaagaaactcaacagtgatgtctcacaccttgctcactcccatggagcctgtttcataaaaagaagccatttttatttagcctcccaagttacatggcctccctcatctactattctcttgtttccactctgtgtctcctccccagtataagtactgcaaaatgctttccatgttaggtttgggaatgaagagataaataaatatccaagacagggtcttgataggcagtagaaggaaatcaatacattcagggaactgggaattagaggccaaacagaggacctcaatgtagttctcagaactagctgatcctccagtggacaagcaagggctgtatctcacaactgcaaggaacaggcttcaccagaactcttgtaccacctaccttgtcttcccattctaatgaaaaacatctatgctccccttctgctgcaggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggtgggtcagaagttagtttctcctgatgtctcctgtggtggaaagcccttccagattcctgtggtttcctccaaggatgctccaaagtgtgaaaaagctccccagggagaaactccagacattccctgagctctaggctgtattttacaagaggctgtggggctttctggagtttcttgctgcttttcgggagtggccatttgaaggttttcacatacttgctcatttcctctgtctcgccaaaaaaaagtcaaatacccacccaaagtctgctgaaaggataaggtctgagatccaggacagcaagtgggcagaatagcgaagtgacatagtgctccctacataggaatgccaagttctgaaagctagaggctcctctactgaaaagagccatgtggagtgtgagggaacttggattgtagacaaaaataacgtggagctgaagcagcctggtttcctttgcctacggctgctgcagcctttcagtcaactcagaagtgcacagatattcacccagacctctggctctgggcccatagaatccagcacatgtggtcccagagaggcaagtaagaagccaggtgaaaagcattgaatattagcagatcatcacagtcaggaagtaggctcataggtgtgtccttaggagaagatggttttacgtcaatgaatcaaattgaaatagtctggttcttcgtattggtgctgcaacccatctgctgtcatttaagaaatgagataagtctttggaaagaacataatctattaaaacagtggttctcaaactttagcatgcatctgaatcacctactaggtcttgttaaaattgattgttgggagacatcccagggtttctgattcagtagttctggggtgatgccgagaatttgcatttctaacagattcccaggtgatgctgatgcagcttgttcagggactacattttgagacctccagatacaaatgatttcaacctgcctttcttcctgacatcagttaatattttcaaatattacaaatatgtgccaatttaatacacttgtggtctaaacaaaatgctttcaatattgtgtatgcagcataaggcagaaaattgtattagtgtgaaatttgagtcattttttctttaatatgagagctaagtggcatatgtacattgtatttaacatattgccatgtgtctttccaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtacgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttcggtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagtttaccccttggctttgtgttcttgcatggatttggggttggaggggccattccggaggctaaataaagtctcctggatttaaattatcctgggtctcttacttatggcttatgaaagtaccaaatgtataaccactagaagaaaatttaacatatgagtcgatcccttgttttatccattgaaagtagcagagtctggtgtcattaacctgacttgcttgtgagaaatttagattgtagagtcatttctgaaacatgacctaattcatcttgtgacttttaaatagtcttaaataccaagttcagtcattgtcttagagcacatgaatttcattataatagatttatcatgcccccctctcaaatatacacagttttggcaagccttaggtgttctgttccatttttttttcccctaaacatctttcgttagtcaatgctcatctaattacaaagggataatcccagactgtatccaattgctgtaacttttggtttcttaatgtcataatttttaaagtctgttttattttaagtgcaatattgagtatttagctgttaggctcaatccgtcgatatgaaataattttttaaatccctaagggcaggaaagcatttcgtggtagtgaaaataagaggaaataagatggcatgaaggtggtgggcggagaaactaggtaggacacaggaaagtgctctcaaaaatctttgaagagctcagctgaaaaaaatggagtagatttggctcatactattccggaaggcaaaaccagggtcagctgatgtcagccccagtttaatacacacggtcccaattatagagctactcactgaaagaatgggtttccttgcattgtggtgagctccctgtcacaagatagaagagtttcagtctaggcttaatggcaaccattggacaaagatgctttcttccacctaacaggccattaacatcttaaaggtatttttgtatctctaattttgtttataataggtgctcaacagaatgagctgaatggctgttacaaagggggtttgtaccttgggtaagagattaaaatataactcaaaatttccttctaacgctgcacctatggaaccatgtgatagaggtgtattaaaattgttatcgaagaatatatagcatatggtaaacaacagtttgcatatggaaaatgtctttgataatttaaccagaactgcattatattcaataacggattttctttataacaaacaacaggggaaaatggagttggcacacagtggatcactttgatatttttaatagtccaagtctggattttatttattcctgagccaacaattttgaacagcatattttccatgtttctgactgtaacaaaacattttcctcattgttccattgtaaatattcctcttgttggaactctttttaatcctgagatttaaacctgtacctttcaattgtctgtgacctttcaatttcactttcaatagttgaagaacttggctttgtaaatctctcagaagcttgaaaatatcttgtctctaccccctcagcccatttcatttgccaataattattttgtaagtagggttgaaatgaactcagctggccttgtgaaatgtttaaacttgcacaaacaactacatttttgttcaacaaatagcagtttactcagccaaaatcactttggatattgccattacaaatactgttaaacttcagaaatcatgtctgtaaattagatgagccaaaataaaggacaattgggttgatgctgcattagtatccttaaaagttatatacccataaatgttagggattttaaaattaccatcaacttggtccacagaatatattttattctggttttaactgtagttcttagagaactgtattagaaatgtaattattaggaatgtaattattaaatgatttaaggacattgtttttaaagttagaagatcattactggcagaaatattagtttcacatttatagctgaagacagata

SEQ ID NO: 16275 - DNA, 79351 bp, Human
  misc_feature (1)...(79351): n = A,T,C or G
cgtgttagccaggatggtctcgatctcctgacctcgtgatccgtccgccttggcctcccaaagtgctgggattacaggcatgaaccaccgcgcctggccacattttggactttcagtcatgttttctttccccaatgaaatagaaaagttttatttcaaagaggaaaagggtgcaacagctgcaacatacataaaacctatttagttttacttgggagtgggaatcaggaaacctgggttctgtttttgacttagtttggataaagaagggtagttaagctgtccttatgtctcttaccaaatggagaaaatactgctgtagttcacagcaatttggggagttttagattctatggaaaatggaaatcctatttgtaacttagattttttctttggagaaggagtctcgctctgttgcccaggctggagtgcagtggcacgatctcggctcactgcaacctccaccttccaggttcaagcgattcactgactcagcctcctcagtagctgggattacaggcacgcgccaccatgcccagctaatgtttgtatttttagtagagaccaggttttgccattttggccaggctggtctcaaactcctgacctcaagtgatctgcccaccttggcctcccaaagtgctgggattacaggcgtgagctaccgctcccggtctaatttttaaatttttgttttgtagagatgagggtctccctttgttgctcaagctggtctctgtctcttgggatcaagggatcctcctgcctcagcctcccaaagtgctgggattacaggcctgggccactgcaacctggccttcatcacaaattcattgaacacactttctttattttatccttttttatttttaaaaatttttatttcagtagttttggaggaacaggttgcatggaaaagttctttagtggtcatttctgagattttggtgcacccatcacccgagcagtgtacactgtaccatgtggcacacactttcacttaaagcatttactagacctcgctagccagatttcccatccctgagacacctggaatgttcctgaggacttagtgactactgcctaaagctccacccaagtcaattttatgtttacaggcaaccggagcatccaatcacctttctctaagagagtacaaagatcagctcgcgagaaagttcagacgtctcatttcgtttctattacacggggccttcgcccaaccagacggagtcttgctctgctgcccaggctggagtgcagtagcgcgatctcggctcattgcaaccttcgctccccgggtttaagcaattctcctgcctcagccactggagtagctaggattacaggcgcacgccaccacgccaagctaattttttgtattcttaatagagacgggggtttcaccatgttggccaggctggtctcgaactcctgacctcatcatttgcccgcctcggcctcccaaagcgctgggattacaggcgtgagccaccgtgcccagcctcgccggggccttttaagtgacgttaaaaattgtacataaaatatgttttaggataatacttgtttttctttgaccaaaggcttggcttcagagaatgtttagccagaaatagaggggcgttaaatccccttttttctaatttccaatctgaggaggaaaataacgtagtaaagggacgcaagagcaaccttgcttcttccacaacaaggcccaggcgccgccttgcaacccggaaatgcagggtgcagtgcggggggtaagggaccggccaactatgttgacccgactcagagaaaccccgcccttgccgccaccgcccacccataacgtcctcctcgaccctccctcgaccatccctcgccccgcggccctcaccgaaaaggggagggcggtggaagagagaggagtcaagggagcgcacgcgaagccccgcccctgccgtgacgtctggagacgcgacgcgtcgcctcgcaatgcaaatcgggaaaagggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggtagaatcagcttgtggagaggaaaggcccaaccttgagtcttttacgccatctacctaggattgccaagcgagtttcgtgtgtttttttggttttaaaaggtggctttgaccaatcttccgttctcttggacacttatacccgactttgacctctttcctcttgcttccggtttttttttttttctgcaatctgcctacaatcccaggccttactatagctcctaaaactgtttcccagtttctcttcttccccagtcacacttgattttagtgaagtttgagtttaaagaccctataagcttgtcagagttaaaactatgacttcctcaaatagaagattttttttttttcccctaaaaagtgccttccatcctagagttgtgggacaagttaatttcaccgccactccaccttggaaattatcagaatccttactagcagtgatgtgcattataaagctgcagaccaccctcctgggtttatttcttgcctccagttcattctgtgaccttgaacaagtcacttaatcactaacaaaaaatttacctgacacggaggtgttgcagagcctaaggaatttagtatttgttaagagacctgagggtttcagatgaaagggatttatatctaaaggatgttaccttttctgaatctgcaaagcatcgttagttttgtaaatatcttgctgcagccattaaaaatgccaagtggtatttgttaaggaagtattcctgttttaggcttgctctgctgcggctttgctatgtaagcagatttttgcatttcagccgattctgtttaagattcgttggtgaatgtcattcatgatggatttgggtagtttctccttacagcatatccctggactattaagcatatctggaaggtgatatcggttgtgttatgtctttatcatgttgatatggctgctttgaaatatgtattccttttcttgtgacacattggatgcatctttaatattagtgaagaccctgtagtagtttaaaaaaaaaatacacctctcattaatgaaattttgcacatagacatctgtttttttaagaaaacaatgtataagaaaaactaacaaaaatgttttaaaggtgccttttttagcatttcgttttttaatatatttacttggactttaatctttatgggcatttgtttattaatgtggacgtggctgggcgcagtggctcacatctgtaatcctagcactttgggaggcggaggtgggcggatcactgaggtcaggagttcgagatcagcctggccaacatggcgaaacccggtctctactaaaaatacaaaattagctgggcgtggtggtgcacgcctgtagtcccagctactctggaggctgaggcaggagaatcgcttgaacctggaaagcgaaggttgcagtgagccgagattgcgtcattgcactccagcctgggtgacaagagcaaaactccgtctcaaaaaataaaaaataaaaagcgtggacataatggaaaataatcaaaatgacttttgggtaagacagttggaaaataaagccagtacattaaatttttttcataagtctagcactatattacgaacttttctccatgaaaatgcactcatatttatggaagtgaaaggaaaaaaatgtcttcaggtatgtgttgctaataaaattagatataattaaggaaacatttaaaaaataccttgttgttgtcccagttacctattgctgcataacaaatcactccaaaacatagtgacttaaaactgtaatttagtatctctcctgtttctctggcctgcctggacttagctaagtggttttcacctagagtttaatgcgtttgtattcagataagcagctgagtttggagtcaaccgagagctcagctggtctggacatccaaaatggctaattcacgtgaaggcgtttgatgttggctaggagttcagctggaaatgtcaactggaatgcccacacatagcctcttcacgtgacttgaacagtatggcggctaggttccgagaatacatgtttgaggagtcaggaagtagaagctgccagtctcccaaaaagcctgagcccagaaattcgcacaacattacttccaacatactctgttggttagagcaaagaccagcgtacaaccctcacctttgaaaggaaaaatgtcaaagaatttgtggccgtgctttgcctactataattttgatgacaaagttgtattggactcttgtttgcatttatatagcagatgaagaatcaggtacacttccaatttccagtttctttctttcttcttcttctttttttttttttgagatggagtcttgctctgttgtcagcctggagtgcagtgtacgatctcagctcactgcaacctctgcctcctgggttcacgccattctcctgcctcagcctcccgagtagcatgtcaccaagcccagctaatttttgtatttttagtagagatggggtttcaccatgttggccaggatgatcttgatctcttgacctgtgatccacctgcctcaacctccgaaagtgctggaattacaggcgtgagccaccgcgcctgacccatttccaatttctttaaccgtaatactttatgttgtaatggcatattacagttttcaaagcatgtttttgtatattttttcacttgatacctatggtcaccctatagaagcagacaaatagttcctatttcattttgcagatgaaagtaaactgaagagtggtggtggtattgggagtgatttacggaatttgttcaaagtcatatgattaataaatggaaagtaaggcctgcaacagttccataatattaaatttattagtactgaatgatgaaatattatattaaacttatttggaattctacatttatagccgtactaatttttttttttttttttttttgagacggagtcttgctctgtcttctaggctggagtgcagtggtgagttctcggctcactgaaatgtccgcctcctgggtttaagcaattctgcttcagcctcccgagtagctgggactataggcacctgccaccatgcccggctaatttttgtattttagtagagatggggttttgccatgttggccaggctggtcttgaactcctgacctcaggtgatctgcccgcctcagcctcccaaagtgctgggattatagccgtgagccaccatacctggccctttttttttttaaactgagacaaggtcttgctctgtcacccaggctggagtgcagtggcatgaccttggctcactgtaacctctgcttcctgggctcaagtgatcctcctgcctcagcctcccaagtagctaggactgcaggcacacgccagcacacctgactaataccatactaattcaagtaaaacagttctcatgtatagtgaataagggttaactaagccttgtctcttttgactaacacattacaatttagttttttgtttgtttgtttttgagagggagtcttgctctgtcacctaggctggatgcagtggcatgatctcggctcactgcaccctccgtctgatgggttcaagcaattctcctgcctcagcctcccaagtagctgggatcacaggcatatgccgccacgcccagctaattttttgtgttttagtagagatggggtttcactgtgttgcccaggctggtcacgaactcctgagctcaggcaatccacctgcctcggcctcccaaagtgctgggattacaggcgttagctaccacgccgggcctacaatttagtttttaataatgcagcagtcttcctcttatctgcaggggatatgtttcaagacctccaatgaatgcctgaaaccacagatagtactgaaccctatatatactatgttttccctatatatacatttttatgataaagtttaacttataaattagtaacaagagattaacaacaataactaataataaaatagaataattacaacaatatagtgtaataaaagttatgccctgtggccataacttgtgcaacttgaggtgtgacagcaaaactagcacaaatttctttttccttcataattttgcagataaaagatcttaccatagatcttagcaacctcagcatgaggtttttggttttttttcttattaggttgagaactttcacctttttgcttaaaggaagcagtttacaacttctttttgacatacgtgaatctctgcttttacactttgaagccatgattaagtaaaatgagggttacttgaacacaagcactgtaatactgctatagtcagtctggtaactgagacggccacttagtgattaacaggcaggtagcatctacagtgtggatacactggacaaagggatgattcatgtcacagactgggcgaagtgaggtggtgcacaatttaaaacttatgaattgtttatttctggaattttttatttaatattcttggactgtggttgactgcaagtagctgaaaccatggaaagcgaaaccatggataaggggggactactacactaaattctgaaacataccaataatggtgtaaacccacatgtctttttaatagagtaaaatgaaataattacacattataataccaatttcagaacaagagttatgggcataagcatcctggaggtgtttttttttttttttttggaggtgttattttaatttctcaattacagagttttaaaaatgaaaatgattttttaaaattttggtaggttgaatgatttaagatgctgatttcagctggaaacaaattgttgccttcatattattttgttgctcctagcagcatgtttatattcattcttatattgatggttcccagtcttgactggtgttagaattcatttgggaagctttttaaaaatacctatgtgggcaaggcgaggttggctcatgcctgtaatcccagcactttgggagacctaggcaggaggatcacttgagcccaagagtttgagactatcctggacaacatagtgagactctgtatttttttaaatatataaataagaaaataaatacctgtgtgtatgtctcatccatagagattctgatttaattgtttaggagtgggatctgagcatcaatatttttttaaagttctctaggtaactgattctaacatacagctgggattgagaactatgtttttggtgcatgttaagtacgatctggctccctacttaatgattttgcatctgttaaaaaattaatgaggtagaagacaaaagaaatggattaaagttataaatgtagatagacatctattctggaaaacagttacccttttgttagtttctgggaatggtccttaataaaacaaacagacattggcctggtttgctaagtgcctatatcacagcattaagccacactttactttgttaccgttatgtacttaactttcattttaagaggcagaaactttattaagagttgtatttttttagtatcccctgtatcacaacactgcaccttgtgtatagtaggtatctattgtttacctaattgaagccagtttagacagtcactctttagaactagggctagttcagctccttgggaggctgaggcaagagaatcgcttgaaccggggaggtggaggttttggtgagccgagattgcgccactgctctccagcctggacagcagagtgagacgtcatctcaaaaaaataaagaactagggctagtttattcttttcttttctttttttctcatggcattctaagactcccccaattagacagggtctccctctattgctcaggctggagtgcaatggtgtaatcatggttcattgcaagctcaacctcccaggctcaaggaaggcctcagccttccgagaagctgggaccacaggcgcatgccaccatgccctgctaattttttatttttttattttttttttgtagtgataaggtctcactgtgttgcccagcagttcaccaaatcctagataacataattttggtgtcaatacttaattatcttccaaaacaatagggattatcaaagtcaacattgatgccttattagttgataaacagatttaatatctgtctgctctcacatataactgatttctagttaatatttacatcttaagatgttcctttggcatacactcaacattttccacatcgaattacctactttgctgtaaaccagtggttcttgttgggggtaattttgccttccaggacacattcggcaatgactgtagacagttttggttgttacaactggaagggaaggatgatagtaaactggcgtctagtagaggttagggatgctgctaaacatcctgcagtgcacattgcacagagcagcctctcacaacaaatgtttatctggtccaaaatgtgagtgatggcaaggttgagaaacgctgctgtaaactgatcagttttaaactgcagtattactttttttgttaatagcactactgctcttcatattttgcagggtacagtgtgtgtgcctctgtgtgtgtgtgtgtgtgtgtgtgtgtgtgtgtgtgtgtgtgtaagcaagagaaaatactgtttcgatcaaccagttaccaaagcatgtttctaccattttgtgttcttttctgcagtgaccttgtagttactcttttccatagtatcattcccttgttctcatctcctttcaatcttacttacatatccctaatttgaccatcttgagataatatttttcccatcaggaactggcttttattgcctgctgaatcaaatataaagaattctggatggcttccaaagtcttccataatgtgactccatctcctacataatataatttagttattcttgttagtcaacatttttgtttccttttagttaaattcagctgacagggagaaacatttattaaagtggtgactatgtgaggactattgagataggtgccagggatccaaagacatgtcaacattttccctctatccgattgattatttcccaataacttctgtaatattccttattattactattttttccgagatggagtttcactcttgttgcccaggctggagtgcagtggtgcgatcttggctcactgcaacctctgccccctgggttcaagagattctcctgcctcagcctcctgagtaggtggaattacaggcgtccaccaccatgcccagctaatttggtatttttagtagagacggggtttctccatattggtcaggctggtcttgaacttctgacctcaggtgatctgcctgcctcagcctcccaaagtgctgggattacaggtgtcagccaccatgcccagccagatgtcctcctttcttaccctgttcttagctaaattctgtcctcaaggccaggttctctctctcatcacatcatcatgagcactgcgtgtgtatgaggattttaaagccttatagtaattgtctgttgatcccattactgtatttaaggaatgatatagatcacaagcattgtaggattcacatgaagaaacaaattccaagaactgggaccataaaggatggaagagatggaacttaagtttgtttcttcttgtagctgagacctcagatgtgcaccactacgcccagctaatttttaaattttttgtaaaattttttgtctttactttgttgcccactttgttggctacctaccatttctccctatctctgccctttaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggtcagtgtgcttaattgatctacattctgtcacaaacttcttattttatcacaaactgataacaaacagttccccaatcagcactggtcattggaccatacttggagttacattgctgtagtgtgagactttcatactttttttaaaattgtcacctgtattaagaaatacattttacattttcatccagtgttatatcatatacacatgtacataactgaaacaattttacgaagcagtacctaaccttactatgtgtgacatagtctgatgtttgctatttttttaatgctgatcatgaccttctaatggattttaaaaacactgccctcaagcatttagcacagtgctagagacatagtagttgctcagaaaataccatacattttagcagtgattaaatcttgagagggttgagccttcttaatacttgaggattactttaaaatgttatttcattggccgggcacgatggctcacgcctgtaatcccaccactttgggaggccgaggcgggcggatcacctgaggtcaggagttcgagaccagcctggccaacatggagaaaccctgtctctactaaaatacaaaaattagtggggcatggtggcggggcgcctgtaatctcagttacttgggaggctgaggctgcttgaatctgggaagtggaggttgcagtgagccaagttcatgccactgcactccagcttgggcgacagagtgagactccgtctccaaaaaaaaaaaaagttatttaatcaatacttagttgtttgtggcaccttatacagaacgagtgtagagtggattatgagatttaagacagcgagaagatacttatgttgagtattgttgctgcctaagggcagaaatagagagagatggtgggtgaccaacaaagacaacttttgctttcctttcaatattgccaaagaccttaggagtggctggtgtgaatccctgcttaaaatcaggaccagtttgaatgactgcaaacctcatttttcactttttaccttttagtcttcactttgtggttccagtcatcaaatccctactctttgtcttagaaaggagcagaaggatgtcagagaaagaacattttctctttatttatttatttttttttgagatggagtctctgttgcccaggctgcagtgcagtggcgcgatctcagctcactgcaagctccacctcccaggttcgtgccattctcctgcctcagcctcctgagtagctgggactacaggtgcccgccaccgtgcccggctaattttttgtctttttagtagagacggggtttcaccgtgttagccgggatggtcttgatctcctgacctcgtgatccgcccgccttggcctcccaaagtgttgggattacaggcgtgagccactgtgcacggctgcattttctctttgttaactcattttcaacacttttgggtttcacttttggagcactgctgtttgactaaggctgaagttctttgtcaggtttacacatcttaagaatttttattttttgttgttagaagcatgttaatttttcttgcatatacttagttatttttttttcacttgcaatccttcttgaagcataaggttttttgttttgttttgttttgttttgttttgttttgttttaaaagacagagtcttgctctgtcgcccagactccgctcactgcaatctccacctcctgggttcaagcgatttttctgcctcagcctcctgaatagctgggattacaggtgtgcgccaccacgtccggctaatttttgtatttttagtagagatgaggtttcaccatgttggccaggctggtctcaaactcccgacctcaagcagtccacctgcctcagcctcccgaagtgctaggattacaggcctgagccaccacgcccggctgcattttctctttgttaactcattttcaacacttttggatttcacttttggagcactgctgtttgactaaggctgaagttctttatctttgtcaggtttacacgtcttaagaatttttattttttgttgttagaagcacgttaatttttcttacatatacttagttattttttttttccacttgcaatcctttttgaagcataagttttgctttgttttgttttgttttaaaagacagggtcttgctgtgtcgcccaggttgaagttgtagtgctgcaatctccactcactgcaacctccacctcctgggttcaagtgatttttctgcctcagcctcctgaatagctggaattacaggcatgtgccaccaccacgcctggctaatttttgtatttttaatagagatgaggtttcaccatgttggccaggctggtctcaaactcccaacctcaaggaatccacctgcctcggcctcccaaagtgctaggattacaggtgtgagccactgcacccggccacataagataatttcaatgtgttgtatcttatggtttgtcctagatctaaacaaataaattctgcaaattatttgacttctgtagttaatgaacacttctgtataagtatcaatgggtttgttgttgctgctgctgttttattttttttaaacgattgtagccaaaataaggcaattgagttcattcagtcattctagtcaatatattttatgtcagtctattttcagatttctttaatggcaaaatgcagcagaatgacttatcaaaaatgtaacatgttaaattcacatagattgaggttggatacacagtcagccttctgtatctgtgaattcaaccaatggccgattggaaatattttaaaaaaataattggatctgtactgaaccatgtacagagttttttcttgtctttattccctaaccaatacaatgtaacaactgtttatataacatttacattgtattaggtattataagtaatcttgagatgatttaaagtaaggttatatgcaaatcttacaccattttatatcagggatttgaacatctgcagatttttggtacttgtgggaaaagtcctggaaccactctcctacagatactgaggaattactatatatgttttgctttctcacttgatgagcggaaaataccctttaccttctgtttgacttctgcagaaacgtgtgtgattgtagaggctcaaatagcaattaaaacaatactgaaagtatttttaacactaggcatccttaagtgacggtataacttacatgattttgttaataaaaatagaaacaactatggtttttaatggactttagacattatcagagaagattgttacttatttgaactgtttccaaaaatcaaatggggacagaaaaggaagcttttaaaaagtacagtctttctcctagaaacccttcctaaaatctttggtgacatcgtaatcttatccctgtactttccctccttgtgtctaatcatttgccaagtcctgtcattctacctttgcagcatctcttattatatctgcttcctctattccatctctactgccctagttctgacctttgtcatctttccctaggatcattataatagataactagtgttttccctatctagtttgtcacttaccgcctaactttatactcttcttagttttaatcacttacctccctacttcagaaccctgctacctttagaaaacaaagtaaatgctttagtaacattcaaggccttccccgttccctgttccaagtctgtttttttttccactgccatgtagatctttgttcattctatgtagtggctaattcctaaagatgttctttactttcttttcttcatcctgcttttcatctctttgaaaaaccttcccccaccaagactcaaatcaaatgttgtctctttgatgatgacttccaagatccttctagtcatacttaatcttctctcttaatttttcttatactgtaatatttgtaactctatagtttgatatcatactatgctgtattactactgcttaaaactttctcttccacattagttttttaaactttgttggtttttttgttttgtttttgagacggaatctcactttgttgcccaggctggagtgcagtggtgcgatctcggctcactgcaacctcacctcccgggttcaagtgagtctcctacttcagcctcctgagtagctgggattacaggtgcctgacatcatgcccagctaattttttttgtttgttttttgttttttgagacagtcttgttctgtcacccaggctggagtgcagggtgtgatctcagctcactgcaacctccaccctctgggttcaagcaattctcctgccttagcctcccaagtagctgggattataggcatgcactaccatgcctggctaatttttgtatttttagtagagatagggtttcaccatgttgaccaggctggacttgaactcatgacctcaagtgatctgtccactttggcctcccaaagtgctgggattacaggtgtgagccaccatgcccagccccaatgttccaagtcttttttttttaaatcaatatgtttttttaaatgtgtattttttgttacttgcttgtttaacccataacttcctaacttttacatctctctggatactctcttcatatttatgtatgttgcattgctttactcacgtttgcgttgttatgctcatattatttctttccttccttaaaactttaagtacatttcatatattcttttatatgttataaagcatgatactaaaatgatcacctgtgcacatactacccaatttgagaactagaaccttgctgtacccctgaagctccttatatgtatctccctgattacaactctccctctcccaagaaatataatgttgcgtttaacattttctgctttctttatagttttacctcatttatatctttaagcaatatattgttcaattcaatttgatttttaaactttatatagagtatcgtattacacatattcttggtttttcattcaacattgcgggggatgggcagaagatgatgaggtgagaaggcgggcagggtatgttttctggttaaactatttattcttggagaatcagagaccatatcttatatacccctttaataacctctgtttaacacgaggcctactgttgcaagctaagtctcctgatgatttgcactgacattgaaacattgctgttgtctctataagtatgaggaaacccaggggaaccctgtcatactctttcctcaatggatgcttttagcaagtttgatgaattgttgatgaattagatacctcgctagaaggacatatttgatatcagttgatccatttgggagtgatagtgtggtctagagaccttttctcccctatcactacagctttagacacaggacccagggtggatggtaaagtgtagaaaatgtttgtatattagatcgttgtttctaaatgcatagatctgaaagtacaaattaaagtgtttggttcaacatgtgtttatagatacctggagcaagtatagatagaaaaaaagtgaaaatgataaaaatgaaatactcagaacaaaatggtttggtgactaagacagtggactaatgtgcacagggttagaagggatgagtaccaataaatcacaaagtattaatatttaatataaaatgttactagaattaaagcaaattggggtgcttttggaattttcataggtgagcagcagccttcccatcccctgctccaagttgtactttacttagctttttaggattagatgttcattgatgtccatttgtttaatgatagtgaactggtagaatgaagattattaagagattggaaagaagtagccagacgtggtggcttacgcctgtaatcccagcactttgggaggccaaggcaggtggatcacttaaggccaggagtttgagaccagcctggccaatatgacgaaaccccgtatctactgaaaacacaaaaactagctgggggcatggtggcgaacgcctggaattccagctacttggaggcttaggtaggaggattgcttgagctcgggaggtgaaggttacagtaagccgagattgtgccattgcactacagccagggtgacagggtgagaccctatctcaaataaataaataaataagaggaagaagtcacttaaaaaataaatggatatcaatgagaaaagagaaatatttctagataaaaattccatctacttatgatctaaacattaatgctattttaacaaaagaaacatgtaaacgctttgattattcttactgctagttcctttgacaggtaagattcccaactcttaaggcaaaatgatacaaaaagtaattcatttggttaatgaaaatttgaaaaaaattattacattcttcactcatattctgcatatcttaaactcctgaaatagatattctaaacaatttaaaattaaccctgttagcaaaggatatggtttaggaatttttttttttaaactgctcacttgttttattgtgaatgaggaaaattagtataattatttgtatttgtttcaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagaggtatgatgtatccttcgctagtttgattgaatcaaatattaatttttagttcgtttccatattaaagttagatgaatgttaaagtttatttgaaaaataacaccatcacacgaataaagtaggacctccttagagaaagttgtaatgtaatcgtagcacaatacatatatattctgctcatatgcatattatctactctccagacagatcatacagatatgatctctaggtcataaagtttaagaggcaaagattatgaggcttctaaaaaaaaattcagccagaagtcattgtcttttcataaaacgatacaaaaataattcctttttggccgggtgcggtggctcacgcttgtaatcccagcactttgggaggccaaggtgggcggatcacctaaggtcaggagtttgagacaagcctggctaacatggtgaaaccccatttctactaaaaatacaaaaaattagccgggcgtggtggcgcacatctgtaatcccagctactcgggaggctgaggcaagagaattgcttgaacccgggaggcggaggtttcggtgagccgagattgtgcgattgcactgcagcttgggcaataagagcgaaactctgtctcaataataataataataataataataataataattttttttttccactttgggaggccaaggtgggcggatcacctgaggtcaggagttcgataccagcctcggcaacatggtgaaaccccgtctctactaaaaatacaaaaattaacttggcatggtggcataggcctataatcccagctagtggggggctgagggatccctgagtccaggaagtggaggttgcagtgagtcaagattgcaccgttgcactccagcctgggtgacagagtgagactctgcctcaaaataaaattaaaaagatcttttgaagggcagaaagtaagagagggattgggctatttatcttgcgaagttgggaagttgatgaggtgacagaaaacaactctaactcctgttgaatgattttcagatgggaaacaatgggaaagataaagccacctttagataagacaaggtcaggcctaagaccgtttattcctttctagtaatgtctggtttacctctagcactacccttatcccagaggaagtggtatatgtaagttggttgtatccaaacttgcatctaactttgtatcagttctgaagtagtggaacctaaataatgaaatttgctttatcaagatcagtggtccccagcctttttggcaccagggactggttttgtggaagacagtttttcaatggaccagggttagggaggatagttttgggatgagtcaagtgcactacatttattgtgcactttatttctattattattactctgtaatgtataatgaaattattatataactcaccataatgtagaaccagtggtatccctgagcttgttttcctgcaactggaccatcacatctgggggtgatggtcgacagtgacagatcatcaggccttagattctcataaagaatgcgcaaccttggctaggcgcggtggctcatgcctgtaatccgagcactttgggaggctgagatgggaggatcacttgaggtcaggagttcaagaccagcctgactaacatggtgaaacctcgtctctactaaaactaaaaaattagccaggcatggtggtacactcctgtaatcccagctacttgggaggctgaggcaggagaatcacttgaatccgggaggcagaggttgcagtgagccaagatagcccattgcactccagcctgggcaagaagagctagaccccatctcaaaaaaaaaaaaaaggagtgcacaacctagatccctcacatgtgcagttcacaatagggttcgtgctcctatgggaatctaatgccaccatgatctgacaggaggtggagctcaggtggtaatgcgagcaatggggagtgactgtaaatacagatgacactttgctggctaacccaccactcatcgtctgctgtgcgtcctggttcataacaggccgtgaaccagtaccaatctgtggccctggggttggggatccctgataaagattatctgtggactttgtatatgacctgtattttttcccagatgtcaattgctttaattattattttttctctaattttaagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggtaccttttatttttgcattgttatttcctaagttattttgcataatggagctattgatttttttctaaaaattttaagtaataatgaaatgtagctcaaattatatgcagcatgatctcatgtagatagaaaaagggaactaaagatacagtgttattatttacaaatgtgtataatgtgtgaactcgtacacattcttggatttgccatggattagtacaagtttatagcaacatacagattcataatttttttctgaggtaattaataattgccaggtcaagtagaaggattgagtttgctcattaagtaagaaaacatgactgtgtttttttttatagtacttttattgcgctttcttaagagtcaaggtttagtctcttgtttttatgtgacagctttttatatatgactgacattgtacccatattacaaatgtcagtttgcaaaattgatactgatcactccctaaatcttttttttttttttttttttttttgagacggagtttcactcttgttgtccaggctggagtgcagtggcgtgatatcggctcactgcaacctgtctcctgggttcaagcaattctcctgcctcagcctcccgagtaactgggattacaggcatgtgccaccaagcctggctaattttgtatttttggtagagatggggtttctccatgttggtcaggctggtctcaaactcccagcctcagttgatctgcctgcctcggcctcccaaagtgctgggattagaggcataagcctctgcatccagcccactcaccaaatctttaaacttctttttgcttttaatcctttgaacaggtgcttgtcttccatttgattgaagccatggatagggagggcaggggcaatataaatgaatagaaaaaattgatgactaggataagtgttgatagagaaaatagatgtatttcaattgtattagaaactagcaaaagaatgctgggcacggtggttcacacctgtaatcccagcacttttaggaggccaaggtgggtggatcacctgaggtcaggagttcgagaccagcctggccaacatggtgaaaccccatctgtactaaaagtaaaaaaaactagctgggcgtagtggcgggcgcctgtaatccaagctgcttgggaggctgagacaggagaaccacttgaatctgggaggcagaggttgcagtgagccgagattgcaccactgcactccagctccagcccaggtgggcgatagactccatctcaaaaaacaaacaaaaacaaactagcaaaaaaagaatatgaagaatgtagaggttcattaaacaaaagtgaagaatgttgtgttgctgggtttacctttacttagaaacaatcttattacctgtcagtagtaacaaaatactgcctatagaattttcacctggtagagaagccaccctcaattaataatgagattttattttgttctctggtggtagaattggcttctattgtttaaattgacttactgaaataacaaaatttcgtttgttctttgatgatctttttaaatttttttaatttatttactttgagagagtctcgccctgtcacccaggctggagtgcggtggcacattctcagctcactgcaacctccacctttcgggttcaagcgattctcctgcctcagcctcctgagtaggtgggattacaggctcttgccaccatgcctagctaatttttttgtatctttagtagagacggagtttcaccatgttggcccagctggtatcgaactcctgaccttgtgatccgcccctctcgttctcccaaagtgctgggattacaggcgtgatcctgtgagccactgtgcctggccacttatttttatttttagaggagtgtgacttttggttgttaaggaatgactttaatattttacttaatggtgataaatcattgctggtatttcttctcattagcaaagttattctaataatagttactaggttttttttgttttttgtttttttaaagacggagtctcactctgtcgcccagactggagtgcggtagctcaatctcggctcactgcaacctctgcctcccaggttcaagcggttctcctgcctcagcctcccgagtagctgggactacaggtgtgcaccaccacgtccagctaatttttgtgtttttagtagagatgggctttcaccatattggccaggctggtcttgaactcctgacctcatgatccgcctgcctctgccttccaaagtgctgggattccaggcttgagccatcatgcctggccaattactaggttttaaatctgtctttgaagagggggccccttgcatttggaggttcattcatctgtccacaatggatgaattagtcctgccctgggaaaaatactgtttaatatttttggccatacttatctgcaggtaagagacagaggccttcctaaattcaaacaagtttttgcacgctctgtgaaatatgttaaagtggaattgcttaaaacgcagtgtaagtggtgctcactaaagtaaatatttttgaaagtcttaaaatttggataactttggtagttttgttgtttgctgttttgtttgtgtggtaggtttttttttttttttttttttttaaggtgacagtcttgttctgtcacccaggctggagcgcgatggcatgattttggctcactgcaacctccacctcccaagttcaagtgattctcctgcttcagcctcccgagtagctgggattacaggcacccgccaccacgcctggcctaatttttgtatttttagtagagacagggtttcaccgtgttggtcaggctgatctcgaactcctgaccctcggtgatccacctaccttggcctcccaaagtgctgggattacaggcatgagccaccatgcccaaccagttttttttttttaatggtcttgtttactttttgctttattttggaagttaatagttattttttttctatgacaaaattgggaatatttttgtagccgcctttttttttctcttcttgagaaggtagtgagtacatttaaacagatgagatttttccatttccagagtctctattgcatttccaaagggagtatgtaggcagagaagtccaggctgagacgctccctgcaaaggctcaggtaacttaggccattatttcatatgattcagtagttcatttcctgtttttcagtaaaaggatcattttcatttgctctgtccagaggatctcatctgcttctgtcttagaactgttttttgtttgttctgagacagaatctcacttccgtcacccaggttggagtgcggtgggcacagtcatggttcactgcagcctcgacttcctgggctcagctgattctctcacctcagcctccagagtagctgggagtacagacacgcaccaccacacctggctaattttttaatttttagtggaaacgaggtcttaccctgttgcccaggttagtcttgaactcctgggctcaggtggtctgcctgcctcggcctcccaaagtgctgggattacaggtgtgagccaccttgcccagttgcagaactgttttctgttttttgttatatttttctgtagcccagcctctctagtgtacttcagctatgtgaggtgctaaatttactaacaagatattttctattttttaccctttagatgaggtagggactgaatgtatgtcattgaacttccttagaaacttgtattttcactcttattttatactagaaaatgttagagatttaggctgggcgcaatggctcacccctgtaatcccagcactttgggaggctgaggcaggtggatcacttgcggtcaggagtttgagaccagcctggccaacatggtgaaaccccatctctactaaaaatacaaaaattagcagggtgtggtggtatgcatctgtagttccagctactcgggaggctgaggcaggggaatcgcttgaacctgggaggcggaggttgcagtgagccgagatcgcaccactgcactccagcctgggcgacagagcaagagtctgtctcaaaaaaaaaaaaaaaaaaaaaaaagcctgggcacagtggctcacgcctgtagtcccagcactttgggaggcagaggcaggtggatcacaaggtcaggagttcaagaccagcctggccaacatggtgaaaccccatctctactaaaaatacgtaaaaaaaaaattagctaggtgtggtggcaggcgcctgtaatcccagctacttggaaggccgaggcaggcgaattgcttgaacctgagaggtggaggttgcagtgagctgagattgcaccactgcactccagcctgggcaacagagcaagactccgtctcaaaaaaaaaaaaaaaaattgagatttagataaaacattaatttagcaagctctctcaatagtagagaaggacactacattttattacttatcaaaaagtcatcttatgaataattctttcagggttatctgaaaaagtggggaaagaaaatgtattgaaaatattagtgtagcgaattctagataaaattagaattgtattttaaaatttttatggtattcttgataattcttcattggtaaacctatttttgtttaggaaatcatgaaagttgtttgaattcatatattcaggaatcaggaaagttctggtaaacctcagaagcaaacatttttagttatgtaataattggatgttatctttttcttctgtcaattatcatactattgaaattttggaagtatttatatttactttaactgtgctcctttaagagcacagagataaataattgacaggaaatctcactaatattaggggaatgtctgatagtgtgtaacagacatgcccaaccataaacaattttttgtgtttaaataggtttaagctgggcttacaggctggctttttggtgagttcatgtgtaaaaatgaataaaacaagttatagcatttttggttttactttgtattttgtatttattcagaatgattacattatgatttctgttaaatggttctgttaatgtaatgattacattgtattttctgttgagagaattgcatcagtagtcaggacatggtgtgctaactgaaattattgtaatgttcaattgatacgatattgaacaaactgtacacttttattggaattacatagtgaagggtccttctagtatatttaggctttagaagaatcagccaaacaaagcatgatctacttttaggctagatagacatatgataactcttatcaacagactttttttgagacagggtctcactctgttgctcaggctgaagtacagtggcactatcatggctccctaaagccttgacctcctgggtacaagctatccacctgctttggcctcccaaagtgctgggattacaagcgtgagccacctggcctggccatcaacagatttttcttcttaaaaataagtcttatgttaactgggacacaaaaattaaatcttttgctatatcactcatattctgttcttgtgttaccacatacttttttgaaattaaaaagtgtttagaatgatagattattgagcactggtatattgaattagagctcaggtccagtttttctaagttatttataataatatttgtaaatgtctggcagttttctttagaaaaatttaattcttcatatgctccaggttgtattgtgctactggacgctggtcttatgggaatgaattatttactgttagtttttgttgttgttttcaaacggagtcttgctctgttgcccagactggagttcagtggcactgtctctgctcactgcaacctccacttcttgggttcaagcaattctcttgcctcagccttccaagttgctgggactacaggcacgtgcctccacgcctggctaattttcatatttttagtagaaacgggggtttgccatgttggccaggctggtcttgaactcctgacctcaggtgatccacccacctcagcctcccaatgtgctgggattacatgtgtgagcccctgcacccagcctactgttagttttttttttcttttctttttttcccctccgagacagagtttgactcttgttgcccggggtagagtacaatggcgtgatctcagctcactgcaacctctgcctcccgggttcaggtgattctcctgcctcagcctcccgagtagctgggattacaggcgcacgccaccatgcctggctaatttttgcatttttacgcttattttttttttgtcttttttttttcttcctttttgtggggaacggggtctcactatatgcccaggcaggtctcaaactcctgggctcaagctatcctcctgcctctgcctccctgagagctgggattacaggcgtgagctaccgtgcccagcctaatttttgcatttttagtggagacagggtttcaccatgttgctcaggctggtgtcaaactcctgacatcagatagatgatccagccgccccagcctcccaaagtgctgggattacagatgtgagccaccgcacatggcctactgttagttttgatctgcctagttacagaagttatgtttgtttatttgtatcatcagtaatctagaagttatatatatttatatgggctgttagatatgtttatatggctccaccattgcagctcttcatgactgagagccaaagataggtacttctgacctacaacccttctttttacaaattatgattattataatttgtaatgaactgtgctagtaggctctatttgcaaagtcatattgacatgttgtggcaaattggatccagtaatcatttaactgacttaactaactactgcaatgtcataccaaccttgatttgaaaatatctgattgtagtatctaatgattgacctcttgtatctaatgattgacctcttggagtagtgatttaaaaaacaacaacaacaacttcattgtacttgttagtaaattatatgccaaatcttttaccttttgcattttttaaaggtggaattttttttttttttttaagacagagtttcgttctgtcgcccaggctggagtgcagtggcgcaatctcggctcactgcaacctccgcctcctgggttcaagtgattctcctgcgtcagcttcctgagtagctgggattacaggcacataccaccacacccagctggtttttctatttttagtagacatggggtttcaccatgttggccgggctggtcttgacctcctgtcctcaagtgatgtgcccgcctcggcctcccaaagttctgggattacaggtttgagccactgcacccggcctagattatactattaattatttattttctatcatttggtttttagttgcttagagtttcctaatgtgtaaaacttgttttatgtatcaaaagtgttttgactccagttgggatgtgagtagctattctaaagtacaggtggaagcaaaaatatctgtttagaacaagtaaacaaaacacattccatgttgtgtctgtacacaatttgctttattgtgagactggagaaaaaactaggtacatatttttaataagaaaatatactttattcttgaaagctttgctctttggcgcttactcaaaaataacaatgttatttatactttttaacagagacttacaaataagtcaaatttatgaactagtggatctttttaacttactaatggtatgaagacatacttttgagacatttggagaataaattatacatttacataggttaaaagtttttaaaaatcttccattgtaataaaacaaacttccctttatataagcaccatgattttaatgattttaacactagtgtcacatgcaatgccgagaactaacaatatgggatgggtttcctataattttaggattatttccattcaatacttggacctggaaacatcaaaaaagctgtcgaagaagctgaaagactctctgaaagccttaaattaaggtgaagatattatgaaatatttaaaataatgtaaatttagaagataaaaataatatttaagatttaccgatttatatctgacgattcatataatattccaatttttttttgagacagagtctcgcgctgtctgtcgcccatgctggagtgcagtggcgcgatctcggctccctgcaagctccacttcctgggttcacgccattctcctgcctcaacctcccaagtagctgggactataggcacccaccaccacgcccggctaattttttgtatttttagtagagacagggtttcaccatgttagccaggatggtctcgatctcctgaccttctgatcctcctgcctcggcctcccaaagtgctgggattacaggtgtgggccaccatgcctggccccaatatttctttttttttttttttttttttctgagacggagtctcactgttgcccaggctggagtgcagtggcgcgatctcagctcactgcagactccgcccctggggttcacgccattctcctgcctcagcctcccgagtagctgggactacaggcgcccgccacctcgcccggctaattttttgtatttttagtagagacggggtttcactgtgttagccaggatggtctcgagctcctgacctcaagtgatccgcccgcctcagcctcccaaagtgctgagattacaggcgtgagccacccggccccaatatttctaatttataatatttgtaagtttctggcattattctttagaaaaattcaattcttcatatgttctttggtggattctgctcctggatactgtgcgtataggaatgaagtatttactgttacttttgatctgcttagttacagaagttatttaaatttggaaaaaaaaactgattctggtatttgccatgacttgcttaccaggtttacaaaaataattacaaaacaaaaacagtatgtttcagtttttagtcgttagtcattcttttttttttttttttttttttttggagacggagttttgcctcttgtttcccaggctggagtacaatggcctgatctcagctcactgcaacatttgcctctcaggttcaagtcattctcctgcctcagcctcctgagtagctggtattacaggcatgtgccaccatgcctggctaattttgtatttttagtcgagacggggtttctccatgttggtcaggctggtcttgaactcctgacctccgatgatctgcctgcctcggcctcccaaagtgctgggattatagccatgagccactgtacccggccattagtcatgctttaaaatttaaattgtttcccttatcaacaacataatgctgttatgtagatcctagtagataaatttctgcctgtatctgtagcataaaaaatgttaatagataaaaccaaaagcattctcagcaatatgatacagaaggagagaacaatggaactggttttaagtgatacaaggtgccaaagcctggttagtgaaaaacagcaaactgagagctgtttgatgcaaataataaatagaaggaggaaactgaaagatttaaccagggtgacatatttctttactggcttgaatttttttttttcactaagaatgtatcatgttacttgtatttaaaaatattctgaccaggagcaatggctcagtcctgtaatgcctgcactttggtaggcccaggcgggcggattacttgaggccaggagtttgtgaccagcctggccaacatggtaaagccccgtctctactgaaaatgcaaaaaaagttagccgggtggggtggcaggcagctgtagtcccagctactcaggaggctgaggcaggagaatcgcttcagcctgggaggcagaggttgcagtgaactgagatcttgccactgcactctagcctgggcgacagagtgagactctgtctcaaaaaaagaaaataactctcaacttataaaggaagtcattaagaaaatgattcattatttagatatttacttcttatggcctgatagaatggcccatctttcagtgtaataaagtccctgttgctaaataacctctgggtcctttccaattctaaggctttttaaatgtactttgaattttcctctgtataggttattttgcagctagatgtggagaaccttttcactgtttttctccctgtctgtcctctcccagcctcctgccccatgttggtgtctttcatggacatttagagcaaccctgtgtgaacatatcttcatatctgtcctgtcctaattctgtaataagtcaaccacaaagctcttttcctcctttaagtctctgaaatctgcatgactagaatttctcttgtcaggccggcagtctgagaatgggcatgagggagggtatatgctctctaggtttggagaatagattataactttaaagtgaaagcccttaacatcttggggtagattttctgctaaattctgcctaatcatctgatgtcatggtctatgaccacggaggcgtgtgtgccgagtggggtccgtggcctgctggcccctgtcctaggggtggccgcatggtcccaggtgcggccgctatagacatagccccagattctgaaaaaaatgctttagcaaaaagacctagtgagtggctagaaaatagatttcagtatcacctgccattaaggaatacttgttaagcatttatttgcctgtcccgtttcttattattatcttttttcatggacacctctcataacatagacttaatccatttctgttacattcatgttaggggaggtcttagaggtaattttgaccaaatctggaagtatcagaatcctagtaaaagggattaagtgggtaaaaggatcagaagttagtttcagagagcatgcctcgctctcacttcagcttaccaactgaaattggaaagtaggagagacatcagctctatttaattagatttatggagactgtagaacaaatccaaggtagggggtaaggtgtggataagagaagaaaataggaaaaaagagaatcttaaagttttttcatttctgccctcaaattggatttaggctgactgtgcttacttcttagggcagacagttcacatactgttccagcatagagcactactagagaagaaatatagagcagtaggtaagtgtacggagccagactccctgggtatggatcccagtttttttcttattaattgtgtgagcttgggcaaattacttagcctccctctgcctcagtttcctcatctgtaactaggataatcataaaacctacctcatagtgcattaagaaaattaacatttacaaacacttagatggtgtctggcacataccaaataataagtttttgtgctattattttcgttgttattaacagtggaagcattcttgttctgtaacacctttcgtcctggcactctagtgatttgcattgaggaggcaaggtaaaacagttgcataattttgctcttgttccaaatctttcacttctgtttctaacagtgaaatgatgctagcatatgagataggcaggaaagtggtgttgatgtttccatagagataataggaatacatgcttgctattctgtgaccaagttcttaacacagtgcagtagagaagtgggggaagtgagcataccagtaagcaaggtcctgctggagatttgagaatccattatccctggttattgcctaagcagatggaatatgatgaaacatctgtttttgtaaaattctatctgaagttactctgtttttcttttctcctctcacatctattgatgggttcatcattcacttttgttccatttattttattttaacacactgattttcataaatctattgttttcccagtagaactttataatttattttgaaatattttctaatttccctttcttccttgacccatgggtcatttagaaatgtgttgtttaatttccacatatgtgggattcttcttatatcttattgatttctaatttaatttcattgtggctaaagatgttgcgtccttttaaatgtattcttgttttatggctcagcatatggtctcttggtgaacgtaccatgtgcacttgcaaagaaaatgtggttgttgaatatactgttctctatatgtcatttaggtcagaatggctgataatgttcagatcttctttatctttactgactgtgggatgggggttcaagttgtaacaattactgagagagtcatgttaaaatatttaactgtatctatttatgcctttagttctctcagcttttgtttcatgtattttgaaattctatttttaggcacatagttacagtttcttgatgaattgacctttttatcattatgtccctctttacctctgggaatattctttttttttttttttttttttttgagacagggtctcactgtcctgaaggctggagtgcagtggcatgatcttggctcactgcaactcccgcccccaggttcaagcgatcctcccacctcagcctccccaagtagctgggactacaggcgcacaccaccatgcctggctaatttttgtattttttggtagagatggggttttaccatgttggccaggctggtcttgaattcctgacttcaggtgatccgcctgccttggcctcccaaagtgctgcgatcacaggcgtgagctaccacaccccgccctcatcttcattcttaagggattttaactagatacaggattctaggttggcaggttttaattttcccttttgtcacttcagagctgctattccactgtcttctggcctccattgtttctgatattaagcatttttctgcctcatttttattttcttgctggaactccagctctacatacgatagactttttgattttgtccaatgaatccctaaggatttgttctttttattttgttttgttttgttttaatcattttctctttgtttttcagattggataattttcttttcttttttttttttttcagatggagtctcactctgtctcacccaggctggagtgcagtggcacacgatcttggcttgctgcagcctccacctcctgggttcaagcaattctcctatcttagcctcccaagtagctggtactacaggtgtgtgccaccacacctggctaattttgtatttttactagagataggggtttaccatgttggccaggctggtctcaaactcctgacctcaggtgatccacccacctcggcctcccagagtgctgggattacagatgtgagccaccacgcccagcctggattgaataatatttatcactctttcatcctttttttcttttgagacaatgtctcactctgttgcccaggccgaagtgcagtggcatgatcccagctcactgcatcctcaaactcctgggctcaagcaatcccacctcagcctcctgagtaggtgggactaaaggcacacacctctgctcctggctaattttattttttatagagatggggtctttctgtgttgcccaggatggttctcccttcaaatactgactctttactttgtcatctccaattttgtgttgagtgaatttttttcagttatatgtttcaattctagaatttcttcctttttttgagacagagtctcactctgttgtcgaggttggagtacagtggcgtgatcacatctcactgcaacctcagcctcctggcctcaagtgattctcccgccttcacctcctgaacaactggaactacagatgcacaccaccaggcccagttagtttttttgtgtttttttgtagagacagggtttcaccatgttgcccaaactggtctcaagctctgggctcaagcagtcctcctaccagggcctcccaaagagttaggattataggcatgagccactgcgcccagcccaattctagaatttctgtgtggttcttttttatagcgtctattatttttttacagagatttcctatttgttcatttattacaagcacattttcatttacgcccttgagcatagttataacagctgctctaaaatctttgtatgctaaatgcatcatcttagagtcagtgtgcagcaccttttctcttttattgttgtcctatttttctttttttggtactagtaactttggacattgtgaacaataaaattataggctctgcattcttctttagtcctctgaatagttttgttgttgttgttgttgttgttttgtcccactaggcagttaacttggctatactcaaacgttaagttttctgtcttgcctatggtaggtggcaactgacattcttttcaattcttctaaacttagctgggctccttagtatctgctgcaggtgtgcttaattcaggtgtcaggtggcaatttgggcaagtctatacaaagaatttggaactctggttctctgagattggggtctttattggaattttagctgttttcagcagtaaggcctgccttaggtgtgaaaccataaaaaatgggaatcttactaatgcccttcctttctttcaagtgtcaacccccatctactttcttcctgattatggcagttttccaatgccttcaggtagttataggttacccagagtttatagttgtctgtgagaggttcagaacaatggaaactactaagtcattaccagaattagaattctctttcctacctttattttttaaggcgaaaggatagcatttttaaagtagagtgtcgtgatcaccatgttcctgtcaatattagtgatcatttctgtcaatggaatacataattcagaaggaattgctaagcgtaaagatagaaactgcttaggccaggcggggtggctcatgcctgtaatcccagcactttgggaggccgaggcaggtggatcacaaggtcaggagttcaagaccggcctagccaacatagtgaaaccccatctctactaaaaatacaaaaataagtagctggccgtggtggtgggagcttgtcatcccagccactcgagaggcggaggcaaggagaaacgcttgaacctgagatgcagaggtttcagtgagccgagatcccaccactgctctccagcccaggtgacagtgtgagactccgtctcaaaaaaaaaaaaaaaaattaactgcttaatggccgggtgtggtggctcgcccctgtaatcccagcactttgggaggccgacgagggtggatcactttagaccaggagttcgagaccagcctggccaacatggtgagaccccttttctactaaaaatgcaaaaattagctgggcacaatggcatgcgcctgtaatcccagctactcgggaggctgaggcaggagaattgcttgaacctggaaggtggaggttgcagtgagctgagatcatgcctctgcactcctgcctgggcagcagagcgagactctgtgaaaaaaagaaaaagaaaaaaaagaaaagaaattaactgcttaaatatttagaggagaagcactgttttccttatatttcttccacttgaggaatagcacagctttgtgtgacatgctaatttcttctccaagagctaaagatgtaattcttgctaagtgcatgaatgatcttattgatagatggcacgtttttggtcactattaacatgatgttgaaaatgtgtggtacaaaataattttgagttcagaagtcatttttaaagtaaacttaaaattttaaatatgtgaagctggcacagttatttgaatagtcaccatttctattgtatagttttatctgtttatttagaaatttttcattttggaatattcactcaaaagagcatataagaccaggtgcggtggctcacacacctgtaatctcagccttttgggaggccgaggcaggtggatcacctgaggtcaggagttcgagaccagcctggccaacatagtgaaaccccacctctactaaaaatacaaaaattaggtgggtatggtggcacacaccggtagtcccagctacttgggaggttgaggcaggagaatcgcttgaacccaggaggcagaggttgcagtgagctgagatcatgggactgtaccccagcctgggtgacagagtgagactctgtctcaaaaaagaaaaaaaaaaaaaaacagccagccacggtggctcacacctataatcccagcactttggaaggctgaggcaggtgggtcacctgaggttaggagtttgagacaagcctggccacatggtgaaccctgtctctactaaaaatacacaaattagccaggcatggtggtgtgtgcctctagtcccagctactcaggaggctgagtcaggagaattacttgaacctgggagatggaggttgcagtgaaccgagatcatgccagtgcactccagcctgggtgacagagcaagactctgtctcaaaaaaaaaaagaaaagaaaagaaaaaaaaaagaaaaaaagagcatataaaatgtaaagatacaataaagagaataataaaatggaaactattgattcgtcttttactaattattgaccctagtcaattatttatttttttcctttacatctgttttatcttctctctctctgtctttaaatttgaagctcacagacattgccaagcattgataattagggcaaacaagattgcaggtctatgataacgtacagtctgtcctggcaataatagcaaacattgccattcgttcatttatttatttatttagagatggagtctcactctgttacctaggctggagtgcagtcacgtgatctcggctcactgcatcctccgccttcccagttcaagtgattctcctgcctcagcctcccaagtagctgggattacagacatgcaccaccacgcccagctaattttgtatatttagtagagatgggatttcaccatgttggtcaggctggtctcgaactcctgacctcacatgatccgcctgccttggcctcccaaagtcctggattacagatgtgagccaccgcaccccagccacctataatttagtagggaatagttctaaattcctcagatatctgctaactgtagttcagatagctgtttaactgccaacaagttggaaatttcagtgaagtcatcctttaaaaaaatgtaacttgggaccttggtaagactttccacagctttttgaatgtttgttttcacatttttattctaaattatcaacataagtgtgatatttgggctgtttcttttgcagaaaaaattaggatttttcctttgaaaagcaaattgcagcagatttgaatcaatataaaaggttgaaattagtaggagagaaagagcaaaaagcactaaataatttcaacttgagaacatacagtttctttttaatagttctgggcaatttgaagtaaatctacagatggcctcaggtggcagatgtgtgaattgtggtggagggagaaagcatatagccatgaaatacctcaaggcaggatactaattttacagaactgaaactcctttaatttccacgattaacgccaataaaagacaatcttgacttattttttcaactagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaaggtatttcaaatttaatgtgtgagttaaaagactgtttctgcttgttagatgatttgcttaaaaagagttgagataccactataaagttcttttaggcaacaaggatgaaatttaatgttttaattagaaatttatttaaggctgggcacggtggctcacgcctgtaatcccagcactttgggaggccgaggcgggcagatcacttgaggccaggagctcaaaaccagcccggccaacatagcgaaaccccgactctactaaaaatacaaaagttagctggatgtggtggtgcatgcctgtagtcccagctactcgagaggctaaagtaggagaattgcttgaacccaggaggcagaggctgcagtgagctgagatcgtaccactccactccagcctgggcaacagagcaacactcttgtctcaaaaaaaaagaaaagaatttgaattaaatattctagcctcagttgacttcagatttttctgtgaatttctatggcaatattttctctgcattaattcgttttttagcagacattataaacttaattagagcaatagaaaaatcatttgagctgagctgtgatttattatatctgcattctggtcctatgtcaaaacttttttaaccactctgggactcagttttcttgtttcccaaattatagtcttgaaatagacaatttttaagtttcttctttctaatcatgtaatttacattaaaagatttagtatactactttgtttggtaccaagccttttatctgtttctgaggtctcattctttttcctttgctttctccttctttttctcccccagttcccccacccccccccttttttttttttttttttgagacagagtctcattcttgtcgcccaggctggaatgcaatggcgtgatctcggctcactgcaacctctgcctcccaggttcaagcgattctcctgcctcagcttcccaagtagctgggattacaggcgcccgccaccacacccggctaatttttgtatttttagtagagatggggtttcaccatgttggccaggctggtctcgaactcctgacctccagtgatctgcctgcctcagccttccaaagtgctgggattacaggcatgagccaccacacctggctcttctttttttttttttttttttttttgagacagagttttactctgtcgctcaggctggagtgcagtggtgcgatttcagctcgctgcaacctctgcttcccgggttcaactaattctcctaggcttcagccttttgagtagctgggattacaggcacccaccaccatgcccagctaattttcgtatttttagtagagatggggtttcaccatattggccaggctgttcttgaactcctgacctcaagcgatctacccaccttggcctcccaaagtgttgggattataggagtgagccaccactcctggcttctcccattttttcacatctatttagtgactacttgtggtcttttcagctacatcatctctttgctaaaagccatcagtgacttagtctgtagctgccagctatcaccgtacctcccttcctttacctcctcagaaactactcttcctaaaatataagttgaaatccatgggaaaatttctgctttgatttttttcttagacattttgtagctttcagttatcattctgtgtggatcatcattcctttcattaaaaagtcgttgttggctgggtgtggtggctcacacctgtaatcccagctctttgggaggccaaggtgggcaggtcatttgagtccaggaatttgagaccagcctgggcaacatggaaaaaccctgtctctacaaacttttttttttttgagatgcagtttcgcttttgttgcccaggctggagtgcagtggcgcgatctcagctcactgcaacctccacctcccaggttgaagcaattctcctccctcagccttccaagtaactggaattataggaatgcaccaccacgcccggctaattttatatttttagtagagacaaggtttctccatgttggtcaggctggtcttgaactcccaacctcaggtgacccgcccactttggcctcccacagtgctgggattacaggcgtcagcaaccgtgcctggcctctacaaacattttttaaaaaattagccagtcatgatagtgcacacctgtagtcccagctactcaggaggccaaggtgggaggatcacttgagcccaggaggtccaggctgcagtgatcatgcaactgcactccagcttgagcattagagtgagaccctatctccaaaaaaaaaaaaaaaaaagggtctagtggggtctttgtttccccatgggaaaaaggggtaagtaccatacaggggtaatcccaaggtggccttgggtaaaaaaaggaagtaccataaggcccgggcaaaaggggcaaaaggcataaatcccaccactttgggagggctggggaaggannnnnnnnnnnnnnnnnnnngtcaagagatcaagaccagcctggccaacatagcaaaaccccatctctactaaaaatacaaaaattagctgggcgtggtagcacacgcctgtaatcccagctactcaggaggctgaggcaggagaattgcttgaacctgagaggcagaggttgcagtgtgccaagatggcaccattgcaatccagcctggccacggagcaagactccgtctcaaaaaaaaaaaaaaaatgtaaactacataagcaatactttgtattagttcattttgctttaattatgtggtggaggacactgaatgggatagccagaatttttgtttgattgtaagaagtactttctaatcaaattaaatattaaatttctgtagcagtttgtgctgttaaattatatttggtctttaattgaagtaaattttgaggaaatgttctatgattctgaaagattgctagttattttagctgttgtctactgccaaagaaaccttttaatatcattattattcatctgcgtttttataaaaggccagtactctgcacagttcgtttcttagagtttccatttaagagaagtaaatgaagtattaaagttgaattttttgtgtctatgaaagttgaaactttttttttttcctatgcaatagagcaatggtgaaaagaatgaaaaatgtgagaccaaagagaaaggtaagtgtgtacagaaggaggaagttgttttaggttctgactgagatcttttaatcagaataagcatcaggttttatacaatgagattcttagcattgttgtctaatctctatgtaagctttatcatttttcctagtctgtacaattatattgaaaatgtctgaggttatttttatgtatttatcatggggggatattttatgaataattttaaccttacatgttaaactggtcatatgcagttgaaaaaatgtcaaaacccaaagcttgtacttgttttcttttcaacatgcagtttagcaataatggttaagagcatggactctcagaagtcaaactgccggagtttgaatactggttcctcctctccctttcggcctggttttcagaatgttgcttaaacattctacctttgtttccttgtctgtaaagtggagataataatagtacttatttcatagggttgttgtcagggttgaatgagctaatatatgtaaattcttagaatacatggtaaactttaagtaggacttattatcatttatgactaggttgtagatttaattttttctccccccatccatcctgtggtcaaagactaaattatttaacagtcatttacatcccccataaaaaaaaatcgaggccaggcacagtggctcactcctgtaatcccagcactttgggaggctcaggaaggaggattgcttgagcccaggagttcaagaccagcctaggtaacatggtgaaacccctgtctctacaaaaaatacaaaaattagctgggtgtggtggtggatgcccttagtcccatctgctcaggaggttgaggtgggagaattgttcgagcccgggaggttgaggctgcagtgagccacgatcacaccactgtactgcagcctatgacagtgagaccctgtctcaaatccaaaccagtaatatggaaattatccataggtggcgttgatgctctagtgacaaatatgtgacctaaacaagactttggaattcctcttcatctgctagagacgttttcctctctcagaaaaggtttaccttgtctacagccataccacctaacgcgcccgatctcgggagcgaagcagggtcaggcctggttagtacttggatcagagaaaaggttgaacttaaacataattataggtaacagtaaaataaattctctacttaaaatattgccatacaacaattacaaaagtaaactgagtgtgctataaggtacttccctaaaagctgttactgattcattccaagattagtttttatgcatttgttcctttgtatgtcatcctgcttaaatgttgtccttctcagtggtttgttaacaacttttttagtctgttttgttagcatacacttgatggctagagatggaaggaggacgattgttagcagctataggtcttttagcataggagctactgagactacttttcttctcacagctcactgctgaaacagcttattatataatctcaactctcttgtagtgccttttaatctttcacttcagtagagctaaggaaaaatagtaacatagggaatatttattttgacagattgctgccctcccccaaaagtaaataaattaaatattgcattagctttacttagtttcctttttgttagccttcttagaaaacaaaataatcttttttccttctggctgggagctaacaaatgaacatcaagtagaatgacaattggcaaatttttcttaaagggatagatggtaaacattttaggcttggggaaccttatgggcttggagagtcctgtggtctctgacacaactattgatctctgctgttgcagtatgaaaaaatgtgtaaacaaactagtgtggcagtgatccagtaaaaacagatggccatagtttttcaacctctgatgtagaatagcaagcttttgacttgttattctaagaatacttggatatctaagtttttcaaaaagctaccgtaagactgccatcagagaccttttgaatttagaacttttccagaattttagaaccatagatatttctttcttccagttagcatttttctaatgtcttaatttttgaaaacatactattttcctgagacacatatattaatgttctttattttatgttggtaacagagtcaataccaggtgtagctgtaaactcaacagaaagttttgatttttaagtctttgtaaacagagcatcgaactggtttcttgataaatgttaaaaacacaaggtcaggtatgtggtggctcacgcctgtaatcccaacactttgggacgccaaggtgggcagatcgcttgaggtcaggagttccagaccagcctagtcaacatggtgaaaccccatctctactaaaaatacaaaaattagccaggcgtggtaacagcctgtgttcccagctactcaggaggctgaggcaggagaatcacttgaacctgggaggtggaggttgcagtgagctgagatcatgccactgcactccagcctgggttacagaacgagaccctgtctcaagaaaaaaaacaagttgtatttaatgttagtttacaagataataaatggtatgatggagtagtaaatatgtggcatccatatatattcagtatactttgctcttctagaaaaagcggtttgtcctgtgttttgtgatgtcagcacatcttgtgctgtttcttgtcacttacactgtctctctcaattccaaggagcaatcacagcaaaggaactatacacaatgatgacggataaaaacatcagcttgattataatggatgctcgaagaatgcaggattatcaggattcctgtattttacattctctcagtgttcctgaagaagccatcagtccagggtgggttattgtgtagtaaagtagtaaactgtgtagtaagtagtaaactgtggaccttagtaaatgttactacttagcatccaagctaaatgtgataaagtagtcttttcctggtaactttttaaatctttgcctctttttatgtgtgtgggtggtgggggagggggagggggaggtaccattttaggagcagaggtttaataggcaaaagaaagagaaagaagaactgctctctcacttttgagagtgaggggtgcccaagtgggatttccctaaatctttgcttcttaaagacacacctccaccctttttgaaggttgaagttacggatttgccaacttttgatttggctgttttctcctattggtggtatttagaatcttatcaaaagagaaatgaagttgccttttccctctctccccagatgtttgttaactgatttttcctattattttctgtttataagcatgtgaatcgtatgtaccaaattgattaaaataatgaactaattgaattgttttacatactgaaattccctatatttactgtgatacacgctacacaaatactttgtgtgtgcttaagttaaaagagtatagtctctgatgccagactctattcaaataactgtcacttactagttgcattattactaggtagtgacctaacatttctaagctcaggtttccatctgtaaaatggggataatagtagaacatatcttacagaggtttcaggagatttaaatgagaaacattatatacacatacacactttagcacaggtcctggcacgagtaaggacttaatttaaatttttttctttcttttttggtaagaaggcctttaacctatgaaataatttaaagtgacttgcatgggtatattgtatattggaaatcatggcatagtggcagagctaaacctccagataaagggctattttcactatttcgagcattcttatgcagatcctattacctctcttggtcttggtttaaaattatatatttttaaaattaggtaataaaatctgtatagttcttggcatattgcagatgcttgataaatgtttgacctgaagcgtagagtgctttgtaaataagctatttaaaaattagagctcttaggccgggcacactggctcacacctgtaatcccagcacttggggaagccaaggcaggcggatcacttgaggtcaggagttccagaccagcctggccaacatggtgaaaccccatctttactaaaaatacttcagccaggtgaggtggcgcatgcctataatcccagctactcgggaggctgaggcaggagagtggcatgaacccgggaggcggaggttgcagtgagccgagatcacggcactgcactccagcctgggctacagagggagactctgtctcaaaaaaaaaaaaaaaaaaattagagctctttgaggaagacgctgttgaaggtagtgctgagctgtggtcagcccgctcctgctcctgctgtactgctgttgctctcgcagaggaaccggtcggtcaggaagccgcacagcagccgtggcttttaaagatgctggaaaaacacccatggagccggagatagcaattcactgaattcgaatcactctctatgagccacagcataaaatccctggagaaggtgtgtgctgacttgatcagaggagcaaagaaaaagaatctcaaagtgaaaggaccagttcaaatgcctactaagactttgagaatcgctacaagaaaaactccttttggtgacggttctaagacatgggatcatttccatatgagaatccacaaacaactcattgacttgcacatcctttctgagattgttaagcagattacttccatcagtactgagccaggagttgaggtggaagtcaccattggagatgcttaagtcaactattttaataaattgattactggttgttaaaaatatatatattagagtactcagtctaattaaacatgtgaatatattcccaggatttgaacagacgaagttataattagtctttgggtagtctagtctgtattaatagagagctggtggtcgttattactgagtttacatggaagtttcccaaaatgtgagatttggactactatgaaactcaagatgattttaggttgaagattaaagaacaatgaaatgcatactgagaaaattattctcttttaatttatgttacagtccttttgagttagtttaaaggagtttcagtttggtgctagtatatcttttaaatacttgcttatctctcttaactgaagggaacaggtctcagagctttctgtaggttacagtacctacaactagctgatagtgattactgtattttttcattatctatttttatttatttatttttgagacagggtctcactctgtgcctgggttggagtgcagtggcatgattacagctcaccgcagccttgacctcctgggtttagatgatcctctcacctcagcctcctgggtagctgggaatacaggcacatgccaccatgcccagctgatttttgtatttttttgtagagacggggttttgccacattgcccagacagctctcaaactcctgggctcaaacagtcctcccaccgtagcctcccagagtgctgggattatagatgtgagccattgcacccggcctatctgttcttaaaattttaagctttttattttattgtatttattttaattttttaaattttaatttaatttatttatttttatttatttatttttgagacagagtcttgctctgtcgcccaggctggagtgcaatggtgtgatctcggccaactgcagcctccacctcccgggttcaagagatttcttctgcctcagccccctgagtagctgggattacaggcacgtgtcaccttgcccagctaattttttaatttttactagacactgggtttcaccatgttggccaggctggtctcgaactcctgacctcaaatgatccacctgccttggcctcccaaagtgctgggattacaggtgtgagccactgtacctggccttttttttttttttttttgagacagggtcttgctgtgttgctcaggctggagtgcagttgtacaatcttggctcactgcaacctctgccttctgggttcaattgatcctcatgtctcatgtctcagcctcccaagtggctgggattataggtgtgcgccaccacacccggctaatttttgtatttttagtagacacagggtttcactatgttggccaggctggtcttgaactcctggcctcaagtgatccaccggcatcggcttcccaaagtgctgggattacaggtgtgagccacggtgcccagcctatttcttttttaaacttttattttaggtttggtggtacatgtgaaggtttgttacataggtaaacgttttcacgggggtttgttgtacatacatattttatcaccgaggtattaagctcagtacccaatagttatcttttctgctcctctccctcctcttacactcccccctcaagtagaccccagtgtctgttgtttccttctttgtgttcataagttcttaccgtttagctcccatattcttaacttttaatacattatagtatatataccgaagtactcctgtcttaagtgtctagcccaatgaattttcattaactgaatgcacccacttaattggcatccagaccaagaaacaatgttatcatcccccctgaacccgatataccccctgtaagttactacccgtatcccactgcccaaggaaaccaccagtttctgacagaatatattctttttgtctgcttttgtactttatataaatggaatttataatatgtagtcttttatatctgtcttctatacccaacctgtgtttgtgacagtcatctttgttattgtgtgtagttgtagtttgttcattctcattgccatatgatgttctgttgtgtgaatatagcgcaatttacttaaatattttatttatcttcagacataccttttacttactggatatgatttcgttttttcatgtatttagggctatacaatttcctattaaatttatttaagtaaaaaattatttttaattaaattaattaaatttaataaaagacaagtagagcagagttggagcagattgtgaagatggtacataaaagacagaagtttgagaaatgttggctgatactgttgtttcccaaagtgttttctgtagaatactaatcctgaaaacagtatttaggtaaatatacccctagggttggaaatagtctttaagaatatcacattttattttttttccttctttgttgaccaagcatccttctgatctgtgtacatcaggagaggatattagtagacaatattttatatttcttctacttctttacttcctggaagatacagtaaccaacattattatataggaactggatttcaaaattaaaatgatcttatttggttttacttgtggataaaagttgtaccagtccggcccagcttgccagtatcatcagttaaatattgaaatgccacgatatactaagtgctttgctaagaataatatggagctccttacccagaggtgtaaatctgtattattcactcattcaattattaaatccaatttttttttttttttttttgagacagagtctcgctcttcacccaggctggagtgcagtggcgtgatctcggctcactgcaacccccacctcccaggttcaagctattcttctgcctcagcctcctgagtagctgagactccagtcatgcaccaccacttccagctaatttttgtatttttaattagagacagggtttcgccatgttggccaggctggtctcgaactcctgacctcaagggatcagccagccttggcctcccaaagggctgggattacaggtgtgagccaccgcgtccagctgattaaaccaatattcactgaacactttctgtgggctgggttactgtgttctaagtgctgggctaagccattgaacaaacaaaaaattgtctttggagcttttaacagagaggtgagataggtaagacgtacaataaaagcttgaaatgtttagtttgtcttatgttgagtgccttggaaatgggaatatcatgtgtgcgtgtgcatgtgtgtgtgtttagaaaggcctcacagagaagttattagcaaatcttgaagaaataagggaaatgagtgatgcagctatctgagggaagcagattccagacagggaaaaagccagagcagaggcccttagggaagagcatgcctggatgaaccaggaataacaagccagtggctggagcgagtgaagggggccagtagttagagatgaggacattgaggcttgagggtgtatgtctgtggcaggccattgtgaggactttagcttttttttttttttttttgagacagagtcttgctttgtcgcccaggctggagtgcagtggcatgatcttggctcactgcagcctccgcctcccaggttcaagcaattctgcctcagcctcctcagtagctgggattacaggcgcctgccaccatgcccggctaatttttgtatttagtagagatggggttttaccatgttggccaggctggtcttgaactcctgacctcaggtgatccacccgcctcagcctcccaaagtgctgggattacaggcatgagccaccatgcccagccggactttagtttttatgtgagcaaacgatgatgtgaacattgtgctttaatggagagttggtgttattcacagttgacggttttaagaggcagcatagcaaagaacatgtacatgagccagattgcctgaattttaattctggctccacttaccttgagcgagtcacttaatctgttcgtgcctcagtttccccaaaatagaaataataatgttcgtcttacaggattgttgtgaagactcaatgagttcaatgagaataaagcatttagaacagtatctggcacatggtaaatgctatatgtgtttgttgaataaacatcctggtatatggtggactattaattatataggtataagagaactgaaatatgaataatactacccaggtgattccccagtttatatttggctgaaagaggagctcagataattttctctgttttcagttttgctccccccttgactttttttaaaaggtcagaatgaaaagaattcagtcttcttttatagtctctaataactactaaaactatgttccaatattatacagtagtgaaggggttaaacatgttaggctgtttaatatcttaatatataacctcaccttagaaaggaatctacttaaaatttgctatggtgtggtaaagactgtggaacaaaactgagtgtcttctgttagtatattaggacctcttgttgacttttgccccaatttaaatattaatacatttcagagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaaggtttgcaagtttcattgttagtttattgtaattgcagggcatctctggttgttagaaaggcatgttaactagttgtttatcttaaatactaaaagattcatcatgccttttttttttttttttgagactgagtctcactctgttgcccaagctagagtacagtggcgtgatctcagctcactgcaacctccgcgtcccaggttcaagcgattctcctgcctcagcctcctgagtagctgggactgcaggcgtgagccaccacaccaggctaatttttgtatttttagaagagagggggtttcaccatgttggccaggctggtctcgaactcctgacctcagttgatccacctgccttggcatcccaaagtgctgggattacaggcttgagcagctgcgcccagcccatcatgctttgattgtagaattttttataaattcaggtttaaaagatttgttttggctgggtgtggtaaaattaaaacttaggtggaaaaagatcttataagattacaagatggccaggcgcggtggctcaagcctgtaaccccagcactttgggaggctgaggtgggtggatcacgaggtcaggagatcgagaccatcctggctaacacagtgaaaccccatctctactaaaaattacaaaaaaattagccgggcgcagtggcgggggcctgtagtcccagctactcgggaggctgaggcaggagaatggcaggaacccgggaggcagagtttgcagtgagcagagatcgcaccactgcactccagcctgggagacagagcgagactctgtctggaaaaaaaaaaaaaaaaaatattgcaaggcagggccaggcgtggtggctcatgcctgtaatcccaacactttgggaagctgaggcgggcagatcacctgaggtcaggagttcaagaccagcttgaccaacatgcagaaacctcgtctctgctaaaaacaaaaaattagtcgggcatggtggtgtgcacctgtaatcccagctactcagaaggctgaggtaggagaatcgattgaacccgggaggtggaggttgcggtcagccaagatcacaccattgcactccagcctgggcagcaagagcagaactgtgtcttacacacacacaaaaaaagattacaaggcagaagacaggcagaaatatttacaacacatatggcagtggtttaaaatacctaaaatccaaagagcttctacaaataagaaaaatacttaagataaaatagtaaaataagtcgtgggcacagatagccatgaacagaaagtgaaatgcaagtggacgtaaccataaaaatggcaactttactagtatcagataaatgcatattaaaacgagtgccattttcactgatcaagttaacaaaggtttaaaaaataatacggttgtcctcagtatttgtgggggattgatgctaggaccccccacaaataacaaaatccatggatattcaagtttcttacataaaatggtatagtatttgcatataaactacacatattctctcatgtaatttaaatcttctgtagattccttataataactaataaaaagtaagtgctttgtaaatagttgttataccatattgtttggagaatagtgacaagaaaaaagtctgtacatgctcagtacagacataaccatcataggcctaactatatattttttaaatttatttgttttaattttaatttttatttttttaagagacaaggtttttctcagtcacctagacttgagtgcagtggcacaatcatagctcactgcagccttgaactcctggctcaagtgatcctactgcctcagcctcctgagtagctgggactacaggtacgcaccatgcctggctaattttttaaaattttctagtagagacaaggtattgctatgttgcccaggctagtctcaaactcctggcctcaagcattcctcccaccttggccacccaaagtgttgggattacaggcgtgcaccactgtgttgggcatctaagtatatatatatatatatttttttaatttaatttaattttatttatttcgagatggagtctcactctgtcacccaggctggagtgcagtggtgcaatcttggcccactgcaacctctgcctcccaggttcaagcaattctcctgcctcgtcctttccaagtagctgggattacaggcgcccaccatcatgcacagctaattttttacttactgttttttgaagacatatcttactctgttgcccaggccaaagtgcagtggtgccttctcagctcactgcagccttgacatcctgtgctcaggtagtcctcccaactcagcctcctgagtagctgaggcgtgcgtcaccatcctagctaattttattttattttatttttgtagagatgagatttcactatgttgcccaggctggtctcaaaactcctgggctcaaacaatctcctgcctcagcctcccacagtgctggtattacaggtgtgagccaccacacccagtcaatttgttaaattattaacaatgatagcactgaatgctggtgagcatgtggtgagaagaaaactcattctgctggtaggagggtcagctgattgccgttgagaaagtcggtcttaaaagccttagaacaattcatgctatgacatagggaacccagaaatatacctaagtatgggacaattatatgaaactgccagtattcaactggcattgacctacaaatggcagtttggcagtttcataaagttcaaactaagatatgtgaatgattagtgtatgataaaggtgacataaatcaatgaagaaaagatggattgaaatgaatggtttggggacaactgcccagccagtaaataaaagagaatggatccctaccttatttcttagaccaagctacatctcaaatgaatagacgatataaatgtatagattgaaacagcgaactattaggagaaagcattggtattttttagtaccttgatgtcaaatcaagatgtcataaaggaaaatgaagactgtgtttatggctggccgcggtggctcacacctgtgatcccagcactttgggaggctgaggcaggtggatcacttgaggtcagaagttggagaccagcctggccaacatggcgaaaccccatctctactaaaattacaaaaatttgccgggcatgatggcgggcgcctgtgatcccaggtactgaggaggctgaggcaggagaattgctggaacccagtgggcagaggttgcaatgagccgagatcgcaccacttcactccagcctgggcaaaagaacaaaagtccatctcaaaaagaaaagacatttaactatgtttaaaaaacaaaaacataaagtaaaaatcaggaaaaatgtttgcaatatatatgacaaagacctgttttccctaatattcagagtacattcactgtttactaaaaaaattgcaaataactatagaaaaaggggcaaaggatacaattattaaatagttaagtcatagaacaatataaatccatagtaaataaatgaaaaaatgtccaacttcaccaataaagaaatgcttattaaaacaagataccattttatgttcatcagttttgtaaaaattataaagatgtataatgggcattctcatatcctgttggttaagtgtataaattggtatagcctttctgaagggcaactgggcatcatattaaaccagcaattctactcctaggtaattatcctaaagaaatacatatatatacatgtatatatacacacacatatatgtacacacacacatatatatatatttatttacttatttatttttcgagatgaagtctcactcttatcccccaggctggagtgcagtggcgctatcttggctcactgcaacctccgcctctcgggttcaagcgattctcttgcctcagcctcccaagtagctgggattataggcgcctgccaccacgcctggctaatttttgtatgtttagtagagacggggtttcaccatgttggtcaggctggtctcgaactcctgacctcaggtgatcctcccgcctcggccttccaaagtgctgggattacaggcatgagccaccgtgcccgaccaatatatttatatatatttttaagtgatcatttctaagattagcaatatattgaaaaccttaaaatgttcgtgtaccttagcttaagcaactccctttctgggagttttccttaaggaggtgactaggtatgtgcatgtataaggatcttttgtgtttatttcagcattgcttataattaaatggggaaaaaacccaaatgttcaaacgattgactcagttttggggtctgtgtataaagtagaataggccatgtgcagcggctcacgcctataaatcccagcactttgggctgagccaggtcgatcacttaagcccaggagttcgagaccagcctgggcaacatggcgaaaccccagctcacgaaaagtacaaaaattagctggccgtgttggcgcgtgcttgtaagtcccagctactgggaaggctgaggtgggaggatcaatagagcccaagaggtcaaggctgcagtgagtcgtgattatgccgttgcattccaacttgggtgatagagtgagaccttgtcaatcagtcaaccagtagtcgaatattacctagcattgcaaatgatgatatagctctatagtgatgaaagatgttcatagaaaagcaacatcataaaggttttattgaaaactctctataagagtaaactccagaatgtaaagtggtattggggtggtgaggttatgggtcatttttgttttatatttagtaatttattttctaatttttcttctaagatcattgattatttgtatggtttttaaaacctcacctatataaccatttcatttaatgttgaattttgaattcagttctcattttgtcattatttagaagataaattttgtccttaagggaacaactttaaaatttagatttgttgtgtttttagctgttgaaagattgctgccctatttaaaatatgatttccttatttatagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcatgtatgtatgtgaaaatttttgtttaaaattgctttggtaaaatatggtttaaaattgttttcccggtaacattcttggttgtgtgtgtatttgtcctattagagagcagtttgttttcaggcataaaaatataagcctggaagttcacattttctttaagactgttgtaattgttttttcacttagtttacatttaattactgcattaacacgcatgagaaatgtaagtactgtgtatggggtttgctattctaaaaaacatttttatttttggaattttagtggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacaggtatgttcttgattttaacattattctcgcttttgttttaatattaaatatatagtatagctgggcacagtgcctcacgcctgtaatcccagcactttgggaggctgagaggggcagatcacctgaggtcaggagtttgagaccaacctggccaacatggtgaaacccccctctctactaataatacaaaaattagctgggcatggtggtgggtgcctataaatccagctgtttgggaggctgaggcatgagaattgtctgaacccaggaagcggaggttgcagtgagtcgagattgcaccactgcaccccagcctgggtgacagcaagactctgtctcaaaaaaaaaaaaaagaattaaatacatagtatagaaacgaagtttaatatataacctttaacatcttagaaaaaagtatcgatgagaacagtctgtatgttttgataaattttttgtttaaaaatttttcatcataattcagcattaccgccacgcctatattagagtagataattaaggggtttccaagccagttggcgatccatttgctacaaacaatgccaatgaaagattgcattatcacagtgaattagaatagcccttttgggattttttgtattataatttgacccatattattttcataaatagcttggcttacatatgataggtatgtgatgtcagtattttggttttaaaacagtgctttagtttcatttccttagaatttgacacgcaaataacaggcatgtttaacaataatcatgtaaaagtttttaaataaccaagacattacaaataaaaaaattttagtttttatatccttcatttggctttatttaaagaaaggttaactaatgttccccctccatgcatttcccaataacattttttagcattcatttttaattttttccccagatatatttaaaacagtatttcacatttaaagtggatgacgtttgatttgtggagcaggtattgaatagaaaatctggtaattttttgttataaactgaagtggttcatttcttcatttttttaaggtcttttagtattgcagaataaattgcagactaaatagatgtgattaaacaacttttcttaaagggtgaatttaggaaagtctaaaaagagcttctctatgttattgcatttcctttcaacttaatctatttaaacgctaatccttttgtgtcccaacataactttatgagatacgtacaattttcagacatattttgaagatcttctatataaaaaacagcatgagggctgggtgccatggctcgtgcctgtaatcccaacactttaggaggcggaggcaggtgggtcacctgaggtcaggagttccagaccagcctggtcaacatggtgaaaccccatctctactgaaaataccaaaattagccaggcgtggtggtgcgtgcctgcagtcccagctactcaggaggctgaggcaggagaatcacatgaacccaggaagcagagttgtagtgagccgagatcaggccactgcactccagcctgggtgagagtgagactctgtctcaaaaaaaaataaaaataaaaataagacagcatgaaagtttgtatatacaagagatgggttcttctgatgtttggaaggagagatctgtataaaatcagccacagcataaggcagaatatcataattgctctacaaggcactggagcacagagcaaggagaatattctagctgagaagatcaaggacgtcttcatggaggagacagtattttatctgggctttaagagtaggattggaggatagaagaaacaagtagaaaattgtatgaccaaaggcatagggcatgctctggggccagtgaacagttttggcatatgtgggcgctagtctctgttggagagaggaagttatgatagtagataagattagaaggatggacaagagtcatcaagagagacttggatcaaatttgaattttgtcctgtaggcacaaggaaccattaaagaattttaaacttgagagtaacatgatcataactatacttttaaaattagggaaaaatagatcaagccaccaaaatgtaaatggaaacaacatttatttttgtttctgttccacctcttattgttaacctcatccccatagtggttcttcctactttattctcaaatacatgcaaaaaaaaagacaaaggattttttttaagaggcagaaagagaagtgaacaggaaaaaaattattttttctacactaacctcgttttctttttcttttcttttttttttgaaaacggtctcactctctcacccaggctggagtgcagtggcgtgatcacagctcactgcagcctcgacttcctgggttcaagcaatcctcccacctcagcctcctgagtagctgggattataggcacatgccaccacgcccggctaatttttgtattttttttgtagagatggggttttgccatgttgcccaggctggtctcgaactcctggcctcaagtgatctatccggctcggcctcccaaagtgctggtattacaggcgtgagtcactgcgcctggcaacttcttttattttctagtagaaaaacataaattcgttttgtaagaacactatgtagattgttattggcacatgttcttataagtttttatttttctttcagtacacagtattctcaagaaatgatgttagggtcacttctctagtgttaacatgctgttaaattgaggtaataaacatttaactcattaaatcaggaacttaggtagtttattacacaacctgaaggaaactagttagtattttacctcatgtaaaagtttttagggaagattgcatttgttccctcagtaacatagttactaactgtgccaggcacagtctttatccttttagagcttatattctaggagggaagaaaaattttaaataagtaattatagttatttgatcagaattccggtagagaagaataaagtattataagagcatgtatcaggggacttggctagttctaggaaccagggaagtcttttcagagggagagatgtgtaagccaagacctaatgtgggcattatctagatgaacagctgatagacctaagttgggaaggagcatggcatcttggaataattttttttttaaggcaagtatagctggtatacacagccatatgactggagaggtaggcagatgtaagaccatacagggcattacagactatggtaaagattttaggtgtactgagagcatagtgggtagcaaatcaaatttgttttaaaatgagtcctctggctataatgtggagaaacagattggggggcgggggcaagagaagagatgggcaactagttgaaagctatgctgtagtcctggtgagagaggaggttgacatggtcttagcctgtggtagaagagatggagggacagatataggaggaaaattaacagcgtgcagaaggatatgggaagaacatatcatgggactcaggtttttgatttgtgcaactattgggagagtgagagtggttacatccatgagattaggaccatgtttgtcggggtggggggaatcgtgaatccgttttggctgtatggggtttgagatacatgtgttgacactcaaatggaaatattgggtaggcatttggatacctggaagtggaacttaagtctaagtatgcccaggtctaggttttatgttttagaataaaagacatttttaactcttttgtatacaaaacactcaggaagaattggaagtgttgaatcaagaggatgtaagttccagtgatgtttgaatatctaccattcaagttctgttttatgagaaatcttgacactgagtaattaacaaatagatgtgctgatagatgttgtctccacaaagtgacacttcttttatcacaacttgatctcaagaactgaggttatttcctgatttttgacaaaaatgttttgctctggttttgttgctctagattgatcgtactaaaaaaccagcagtcaaattgcctgaagagcatagaataaaatctgaaagtacaaaccatgagcagcaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaaggtaagcagaaacagtacaaattgccaacgaagtgaaagaaaatgtatatgaaaatgtgaaaacaccagtggcattccataaaagggcaggcatttcaaatagtcttttcaggggtgatagaatgtactgatctatccacatttgctcatctattctcctttgaggccagtgccatacatttatgaaatgattggttgggaatgaaattgctttttgtatattacatctataaaatgcaatatatttcaaataattgagataaatagctacattcttcatttttatgtttgatgtatgatcatgggaagactagagtgaaatataatctccttctcagtatggggaaactagatgctaatatttgtatgatagaatttatatctgtttagaatatatccaaaatcagtgacatctaaatggcctaacatttatctttgcatatagtgattttttggtcagatcggtgtcattttgtttcttgctttatctatttaaataatattggcaaataacccaattaattttgcccttggctacacacccaaaattgatagccgtaattttaggggactttttttgttattctttttcaatctctaataatgctatgcttttctttttttcttcattatgtcattaacaatgccttttccttttgaacaccaagtatatgtttataataccaagaacagttatggtcctttttacatatgtataaatggaaaaaacatttttagtagtgtggaaatgacttctaatggaaggcgggataccatctttacagaatgtcaatttctatacttctcaaacacaattcaggcatgttaccaaaattaattcatagtcaagctgctcttatccagggaacacttatctggtaacctctgctattaaaaaagatagcttccatccaaaaaccttctaaacaccccaaattggggatatgaagcccatgtactaaaactctctaattttattcacaggaggagcaaaacatgtgcactccaagatacaatttaagtattattcattgagtagctactatatgccaagtattttcactgcattgtcttatttacccctaatgataaccccataaggtatttaatttacaagtgaaactgaagtttagaggttaagtatttgcctaggatcacatagacagtgagattccaaagccacttcttttccatcttgctatactagaggcatgcagtctttagaacttaaatcattcatatttgtggagtcatttagtatataggtgccaaatattcctacacatctaagattgcattccttgtgtgctccttttaaaagtaggagaaatatgtaatttattctagaataaattttgttaaaattatcactaattttaaaaagtttttagtagagttattttaaaataagatataaaacaaaaatgagtttttaaaaagaatctacgggccgggcgcgttggcccacgcctataatcccagcactttgggaggcctagacgagcggatcacttggtcaggagatcaagatgatcctggctaacacggtaaaaccctgtctccactaaaaatataaaaaattagccaggtgtggtggcgggcgcctgtagtcccagctgcttgggaggctgaagcaggagaatcacttgaacccatgaggcagaggttgcagtgagccaagatcgtgccactgcactccagcctgggtgacagagcgagactcggtctccaaaaaaaaaaaaagaatctgtgatgttataagaagatatgaatatagatttttgcattttttactattggtctgtatcttaatttcttctttctcttgaatacttcaaattttttgaagcacaactcctttcaagataaccaaaatcgtaatagtatttaaataaaagaataatgttcaaattaggtcatggtgaatatacattaatgatcagcattttatacttggccatgtagtgtgaaccagtgcttcacagtccactttgattttcatcttttttttttcttcactgattcatcagagttctttagttttttaagtattttgaatgtgacagtaaaatataataaaattttcagaggccttttttttctccttttacattttcattctcatagattcggttgtgttagctagtagctttatgttgggaggagaattaaagttttctttcacttctgtaattttaataattttacagccatttaagattaaaggacaaccagaaagtggaattctaaggacaggaacttttagagaggatacagacgataccgaaagaaataaagtaagtagtttattgcaggaaaaaactggaaaaaaaagccaaacatggattataactatgtgattatcttaccacactgctatcttttatcatgagatctacagtgtaaggggatcgttgccatctttggtagctggtgttttgcttgtttttgcatgatcaatccatttatatgctaaaggaaatagtttgtcttcctgtttaaagtgtgacagcgtattctatttattttatgaaagtaaaaaatgtttaggccttaccatatgatccagcaattctacttcagggtatatacccaaaagaattgcaaacaagaagtatttgtacacccatgttcttagagtattattcataatagccaaaaaatggaagcaacccaaatgtccatcagcaggtgaatgcataaacaaatatggtatgtacatgtaatggaatattattcagccttaaaaaggaaagaaattctgacacgttacaacatggatgaatcttgaggtcatttgctaagtgaaataagccagtttcaggataaatactgaatgattccatttctatgaggtttgtaaagtaggcaaatgtatagagacagaaagtagaatggtggttgtcagagctggagaaaggggaaatggggagttattgttcagtaggtacagagtttcagttttacaagatgaaaagagttctggagattgttggcacagcaatatacttagtatcactaaccagtgcacctaaaaatggttaagatggtaaattttatgttatgtgtatttcatcacaattttttaaatacataggctttgtataagacatctttgctgggagcggtggctcacgcttgtaatcccaggcaggcagatcacgaggtcaggagatcgagatcatcctggctaacatggtgaaacgccgtctctactaaaaatacaaaaaaaaaaattagccgggcgtggtggcaggcacctgtagttccagctactcgggaggctgaggcaggagaatggcatgaaccagggaggcggagcttgcagtgagtcgagatcgggccactgcactccagcctgggcaacagagtgagactccatttcaaaaaaaaaaaaaggcttctttgcctttgtttttccttcagagcttgagatacaatttgcataccataaaattcacccatttttagcatgcagtttagtgattttttttttttttttttttttttttttttttttagtaatttagtgttgggaaaccattaatacaatccaattttagaacattgccgtcacaccaaaatgaccccatgcccaatttagtctaccctaaagcccaggcaacactgagtctactctgtctccatagatctgccttctctgggatatatatacagtcttcccttggtatctgtagatgactggttccactacctccctctcataccaaaatctgaggatgctcaagtcccttatataaaatggtatagtgtttgcatataacctatacacatcctcctatatactttaaatcatctctagattacatacctaacacaatgtaaatgctatgaaagtagatgttatcctgtattgtttaggggataataaaagcctgcacatgttcagtacacccagagttatttttttcaagtattttcaatctgtggatggttgaattcacagatgcagaaccgatgaatacagaggactgactccatatccaatctaaatctatgtgaatttaacatgttaaatttttgttaggtcattctgctgtattttgccattaaaaaaatctgagaccagccttggcaacatagcaagaccccatttctccacagaaagagggggaaaaaagggtatggttgctcctgcctgtaattccagcactttgggaggctgaggcaggtggatcgcttgagccccaggagttcaagaccagcctgggcaacatggcaaaaccctgtctctagaaaaaaatattaaaaaattagctgggtttggtggcgcctgcctgtagtcccagctagttgagaggctgaggtgggaggatcacctgatcctgggaaggtcaaggatacagtgagccatgatcatgctactgcattccagcctgggcaacaagggtgagaccctgtctcaaacaaaaggggaaaaaatgacataaaatatattaaggctagaatgactgactgaattcacagttttcttatttttgactgcaacagttaaagagccacagcaacaacaaacccattgatatttatacaaaaaaagttcattaactacagaagtcaaataatttatacaatttatttgtttagatctaagattaactaaacataacacataacccattaaaaccatgttgtgtaagaatgatacaatggactttggggacttgggggcaagagataaaagactacaaatagggtgcagtgtatactgctcaggtgatgggtgcactaaaatctcacaaatcaccactaaagaacttactaatggccgggtgcggtggttcacacctgtaatcccaacactttgggaggctgaagtgggaggatcatttgagttcaggagttcgagaccagcctggccaacatgatgaaattctgtctcaacaaaaagtagccgggtgtggtggcgtgtgcctgtagtcccagctacttgggaggctgaggcaggagaaccgcttgaacccaggaggcagaggttgcagtgagcctagatcacgctactgcactccagcctgggcaacagagcaagactccatctggggaaaaaaaaaaaacaacttattaatgtaaccaaatatcacctgtaccccaataacctatggaaaaataaaaacagaaaaaaacacgttttattaaagttcttctaagaacgaaaaataaaatttcttaagatgtgtaagccttacaaaaattaagaacttaagccttagtcaaacagcagtgctccaaaagtgaaacccaaaggagctgaaaatgagttaacaataagagaaaatgaagagagagagagagagagagacacacacacatgccttctcttcttctgacatccttctgttccttttaaagagaaagagtagggattagatgactggaaccacaaagtgaagactaaaaaatagaaagtgaaaattgaggtttgcagttactcccactggtcctgacattctaagcagggcttcacaccagctacagccaaggtctttggcaacattgaaaggaaaactaaagtgtctttgttggccacccaccatcttgccccatctctgcccttcaggaagcaagggtactcaatatatcttctggctgtcttaaatctcatactgtatgatccactctacactcattctgtgtaaaatgccacagacaactaagtattgatgaaatagcattttaaagtaattctcacgcattaagaaggctcaataaaacttactgtatttgctgagcaactactatgtctctagcactgtgctaaatgcttgagggcagtgtttttaaaatccctaaggtcataatcagtataagtataagcctaggtgtggtggcacaagcctgcagacccagctacttgtgagagtgaggcaagagaatcatttgtgccaagggttcaagaacagcctcggcaatgtagtgaaaccccatctctaaactttttttaaatgacatttgcaaacattttctcccaatatgtggcttatcttttcgttttcttgatggagtttcttgaagcacagaagtttttgtggaagtccattctgtcatatttttcacatgtggattgtgctgttggtattgtatctaaggaacattttttctgacccaaagtcctaaagtaatgaagatgttttcttcttaaggtttcagttttggtgcttagatctatgatccatttcaagttaatttttatatacagtgtggtaaggatctaaatccatctttttgcatgtggatatttagttgtgccatttgccttcattttgacagaatttttttccagcacacatattctatttattacatgtttgtattcaacagaatttgtcaccaggcaggagtacagtggcatgatcatagctcacctgaccacctgggctcaagccttgaccacttgcctcaagcgatcctcccacctcggcttcctgagtagctaggaccacaggtgcatgccatcacatcaaggttggctttttttttttttttttttttttttttggagatggagtctcgctctgccacccaggcgggagtgcagtgacacaaactcagctcactgcaacctccgcctcccaggttcaagcaattctcctgccacagtctcccaagtagctggaattataggtgcataccaccatggctggctaatttttggatttttttttttttagtagagatggggtttcaccatgttgcccaggctggtctcgaactcctgacctcaggtgatccacctgcctcggcctcccaaagcgctgggattacaggcgtgagccactgtgcccggccaaacctggctaattttaaaaatttttttatagagacggggtctgtgttgcccaggccgatctcaaaactcctgggctcaagagatcctcctgtcttggcctcgcaaagtgctggattacaggcatgagccaccctgcctggcctagaatgtatgtatcttaagacatgaagaatataaaaatagaaatgggtggttcatcaggcgtttttgttttctattaattttttaaaggaagtggaagtatcacattcaattatattgaggttgatgcctcaatatattggcttgtttttacttatataacatttcatcagtattttgtgggatgaatgaatatagaagaagaaatgttaggagagcaagatgactttaggtagatttagaataagccaagataatgaagttttgtagcctttcttgtgaatattcatttgctaggatactataacgtctattctctacttacacctcttagcatatagagaaaaggcacacttagtcctaaagaatacattaggtttatattttacgtaatcgtttgctgtggaaaactaaaaaaaaaattttgactaaaataccttgagatgcaaaattaaaaaaaaaaatgtggcctttcttatttgcttggatccactgtcttcctccccgtgaactaccacagaaggccatctacctccaccttgccacctgctatcattacaggcttagacatactcctctacaccttggtatagtaatatttgtactttgagaaaaagataatttttttcatctctgaatctgttttttaaaatatgaagggcagccaaggcaaggttttttgattctttggtacaagtagcttaagtttttatatgacaaaatttaattgaaaaatcagatttaaaaaaaaattttttttaattttttttattttattttaattaggctcaacgagaacctttgacaagagcacgaagtgaagaaatggggaggatcgtaccaggactgccttcaggctgggccaaggtaaaagtcagaattagcagtaaaatagccactgtgttcctaaaaaatgttttatttgtttattttacatcttctgtaatgcagagtcaattccatttctccattatagagaacatagcttattcccctaattataacagggtgagatttctcaatacccaacctgagatgctggctacaatatatgagcattctggcatttatcatttagaaatagtgtattactttaaaacctaaatttcttttgaagtttatcgccattttattcgaattattttaatccaaaagtaaatttagcagaatactttggagtgatttctttgtttatataatgctaattttgggttttgaacctgtttttttttttcttttccatctaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagtatgtttatcttaactcctagaactaaaataatgtgctgtatttcaaagtttctactctgaatctgtcagtatgttagtgtcagggagttggaaatttctgtggatggctataccagccgttattatttaccacagagaacaaaacaaatgaatagagaaaatgttgttggtttttctcccaagtgctcacttaatatcataccagagaggattattttaagtgttaatgtagatataaaatcattgttatgttttacagtttcatgccagagtaccctcacgtttttcatagaccgcctgtggtcccggaatctccctttgaggaccataattttcagcaatattgagcttgccttgttgcagcactcaagttccaaactttttttccccttagccaataatgtaagcgaagttttcctatagtattaaaataacaagcactttagtatatcatcctctaatccttattctgttcccttttccttcgttgtagttttgctattctgtttacaaatattgaccaataggttaggtttcccaaaatagtttcatttagctatacttctggcttcgtcccttttggaatcctcttagcttatgactgatagggctatgaggagatgatttaagtctgtgtaccacttctaatctttacttacttttttgggaggaggggggcaataggtggaagtataaataaatgatttttttcccatttattatacacttgtatttgctaaggaattttaattaggctcttttaagcctaatcctaagtaagttgaacacatcctaagaaagttgaaattttttcttcctgagaacttaccctgccaggtgcagacttattcgaaggagcttttaaaaattctattaatcttgttatagattttagagttcattataataactagtgagatttaatttcttcttgaatcattcttaagtgtgttaatttgataatgttttaaggactgtatgctgtttgtgtatttttttatatattgaacagaaaaagcacacgagtacatgcacctgagtacaggtaaagaggagctgattgaaatatagtttaatctgttctcagtattacttttaggggtggaagaacgttaaggattaattaaaaaagaaaaaagacctatcagttaagattttccttatgcttcagcagttctagtagttccacatataaatcaaacacaccatattacagaagtctagaaggcattctctgccccagcactgtccagcagatctttccatggtgatagaaatgtactgtatctgtgctgtccagtatggtttgtgtctactttgaaacgtgattagtgcaactaaggaattttttttttttgagacggaatctcaccctgttgcccaggctgaagtgcagtggcatgatctcagttcactgcaacgtctgcctcctcaagcgattctcctgcctcagcctcctgagtagctgggactatagacgtccactatcatgcccagctactttttgtatttttagtagagacggggtttcaccatgttggccaggctggtctcaaactcctgacctcaggtgatctgcccacctcggcctcccaaagtggtgggattatagacagccattgagcccagctggaactgtatttttttactgtgattgtgtatccatccgtgaatagtcaacacactctagaatttaagtaatagtacccaaataacctctgcttcccttgatatctactccacggtatggttttttttgtttttgtttttatttttttattattcctcatttggcattctgggtgagttcaaacatttgataatgccaaacttccagggatcatttaaaggagtttaaaagagccttctctactagagctcctagttcatgagaagtgagataatctatctcaaggtgtctctaagaaccatgacccacattaagaggttaaaggtatgtgtttcatgggaaggtctgagaccttagtcgtatgactaatgttaacctaaatattaaatgtcctggaaggcccagcatcttatgagttaacatattaactgtttacaagatgcctgtggtacaggtgctacagtttgctgccatttatagtatagaaccttaatttcatatgctcagcattttaagacatcttgtatcctttttcttcctcaggccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtaaatacatgtcatactttttgcattataatgctaaaaggatgatctaaccatatttactgtcttagtccattagttttctgctgctataacaaaatacctaagactagataatttgtaaagaacaaaaatttattttctcttagttcttgactgggaaggccatcgtctaggtgccggcatctggtgcgcttttttgctgcatcctcacagggtagaaggtggaagcgaaagaggacagactcgtcctgtcgagccctaaacggcacctaatcctgttcacccgggaggggagccctcatggccttatcacctctttaaaggccccatctcttaatcctgtcacattggcaacacctgaattttggaatatttgacgtgaatctggtggtaacctatgaataagtaagcattttggtgtagggctacagtatgtgaataatttcatgttgacatcaagaacccattttacctttcaaaccatagtacttaccactcagctccagaaaagtcaaattaggaaaggggaaaatatctttatccttaggaataatgaaggctgggcatggtggctcacactggtaatcctagcactttgggaggctgacgtgggcagatcacttggggcccaggagtttgagaccagtctgggcaacaaggcaaaactccgtctctacaaaaattagctaggtgtggtgatacatgcctatagtccctgctacttgggaggctaaggtgggaggatcacctgagcccagaaggtcaaggctgcagtgagccgtgattgtgccgctatactccaccagcctgggtgacagaatgagaccctatctcaaaaaagagtaaagccttctctgattagtaaaggacagacaggatgagagcagtgccagaaggcagaacctcgctgtcatgaactggagcctgttgatgatgaggagaccatgcagggcttgcagccaaaagaaggaagctgaagggatgtaagcaagtcagattcagatgagaatctggtggtgagcctgcaaataaataagtagtttaatgtagtgctacagtatgtgaataatttcatgttgacatcaagaatctactgtaccttgcttaacttttaaatttcctttattgtcttttgtaacaacttttatttgcacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagtaagaaatttgatttttctaagttgcagagactctttagggttgctcagtagcactgtatttttatagcagtttaaaattctagttggtgatagttcagtgcttgtttattcaaatagtgactgtataagagaattataaaacatcaggtaagtgtaatatttgaagcatatacagttggtatttactaattaacaagcagtattgctgagaaatttgcaaatgttaaaatagttattggcgtttgtgacccacatgtatgtgaaagtaaaatcataaacaaatgatcttataaaagattatagacagtttgagcatttttattgtatgttatgtttatataatatgtatatgttattgtacatatccttattcttttctttttcccagtcccttgctgaaagtggaacatgcctttattcttacacatccttctaaaataagaattacttggctgggcacagtggcttatgcctgtaatcccagtactttgggaggccaaggctggtggatcacctgaggtcaggagtttgagcccagcctggccaacatggcaaaacctcgtctctactaaaaatacaaaaattggctgggtgtagtggcatgtgcctgtaatcccagctactcaggtggctgaagcaggagaatcgcttgaacctgggaggcagaagttgcagtgagccgagattgcagtgaccactgcactccagcctgggcgacagagtgagactctttctaaaaaaaaaaaaaaaaaaaattactccatgtaaccaaatgactcatgtgactagttattataaaggcatgtatgtatacataaatgaccaccctccatttacatactacaacttctttttagcactttttgtctcacatattttggggtcaccattcttaaccactgaacagatatatatatatatacacacacacctacacaaaaatatttgtgtgtatatatatatacgtgtatatatacatacatatatacacatatatatacacatacatatatacatatagagagagagagaggctagggcaacaaaattatatatgtccagttgtagccctaattcccagctatatgtgggatatcttttctaaaaaccaaactttttagctttttctttttttagtagagattggaggggggggtctcactatgttgcacaagttggtctcgaactcctggccccaagcagtcctcctgccttggcttcccagaatgctgggattacaagcatgaaccaccacatctggcccttttcagctttttaaataaaaatttgggaaatttcaacaagtcacattccttcaataaagtgagtgagttttttttggtatttttggctagaattattttttgccacactcagtgagatcagaactcctttatgagaactacaggtgtttctaaatctggcaagtgtttgtattcacttttattctttcaatttaaatgttttctttgagatattaatatagagcttaaatcattttatttccaggctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggtaagtttaagaagtagagagaaaatgatttattggataaaaatgctgtttttatggatatagagatgtaaatttctggtctttacccttacaaacattttatcagtaaaactcggccgggcgcagtggctcataccttgtactcccagcactttgggaggccgaggtgggcggatcacgaggtcaggagatcgagaccatcctggataacacggtgaaaccccatctctactaaaaatacaaaaaattagccgggcgtggtggtgggcacctgtagtccccgctactcaggaggctgaggcaggagaatggcgtgaaccctggaggcggagtttacagtgagctgagatctcgccactgcactccagcctaggggacagaacaagactccgtcttaaaaaaaaaaaaaaaaaaaaccttttatcagtaaaactcaatataaattctgttttataattaggcctatgtagattagaaagaattagaaatttcttttttaaagatacctttattaaatattctttcaggatttcaggattgttagtatgtttttaaaaagttttataagttaatttggaaagttgtctgttgactaacttaggcctacttttcataagcatttgctttacatggggatatcaaataaatatcctgttttccatgtatcaacaatgtttcttatataaaagcttgttgatacctttagtcttaaagtacctccagaatgtcatttcctccaacagggtttctctgattgaccaggttaggggctttcctgtgtcctgtcacaacacactgtaggtagcactcaccacactctgtgctgtcattgttcacttgtctatgcttctcactagatcacaagctttgggaaggcaggaactcttttgtgtagattgctgttgaatcactggtgcctgcagagtgactaactaaataggtgctctctgacattattgaagaatcgaattaacgagtatctgctacttgtttttttctgccaggattgccttagattattttccaaagaagaaaaactcacagataacaacagattttactgcagtcattgcagagctcgacgggattctctaaaaaagatagaaatctggaagttaccacctgtgcttttagtgcatctaaaacggtaaaggggaaagtttgtcctcctgttcagtgaaattaaatgagggaattttaagttctgtgtaatttatacttgttgtactgcctgccatgggcacataacaaagggcgattatctggttacagtagatctagggaaataaagcagaaatgagactgttagttcacctcagtgttttcagtaccacagcaaaatgacaataccactatttcatgtaattccttataattttaaataattacaaagcatcaagtgaaaatgtataaaaatattacagtataattcaaacaaattagcacatgaaatgtaacattcaaacagcagactaaagcataacagacttagttatgtgttaaataaaatttataatttttaaagtattttaatgataaaatatgttaacgataccattaagtgcagaaataatttcatccagatttttccaattgatggaaaagatctagtcctataatagaaggaataatgacaagagttataaaacacgaaccagatcttttgctgattctttggtcttcacataatcacataatccatgtaactcaagaactttgagttgattatttgaaaaactttttaaaggaagttgcacttttttattgagagctgtaatttttgtgtcaaaaaagcatttctgttaaaaatgttttatcttgtattgagattcttagttccatatattaatttccaaatttacatgttcagatttctcttgtgtaaatttttctaacaaaagctagttttttccattgtcctagttgaggattctggaagtataaacattctataagtgattacacatttgctaaaatttttaatgctgaatattttcaaaattatgaaataaccatattacaccaaccaagatatcattgttttgatgtttaaaggagcagaatatgccagaataatggaatgaatgacattattttagtcagtagtctcctactctcaatttctggctctagttttctctgaagtacaagcttgactcgagagcagctgtcattctttcttttgtggtggtcagcattataaacatgtgggtcttaccttcctagaagactcatgtagcagttgtagctggaccagagtatagtcctacctctaccattctggctgtttgaccttaggcacatcattaaatatccatatgcctcagttttcttgtttgtaaaatggaaatgaagccaaatgtctttaacaggttcctctactactaaaattccaagtctttgtatttgaaatggattttacagtcctggctaaaaatctagatgttaatgaatgaggattcatcctggtatcttcctctgtcagtgtaattgtaatgttttgttctgcagtttttcctacgatggcaggtggaaacaaaaattacagacatctgtggacttcccgttagaaaatcttgacttgtcacagtatgttattggtccaaagaacaatttgaagaaatataatttgttttctgtttcagtaagtatctctttgaactgaagactttttgtttcaaagcaagtttaaaaaaagttttaagtggtttcctacctcatggaagagtaagaacaacataaagctttgaaactattggcgtattttaaataacaattttaactgaattgatttttttttctatcttgtttggcacagaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatctttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagtaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataacaacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccacttcttggctaaattattatatcaaatatattcaaatcatattcttaaactcatcgagccatttgaacaaaaattatttttgtttagcttcatgagtatctttggaaaataatttgttgaatatatatgattatgagatattttctgataaacactgaattttgaaacctgaactcactatataattgcagtgttttgaaggcctgcatccattagcattgcattatattcacactgccttttttagtgaaccaagacccatcttctggacgacagatttatcttaagatgaaaggttgtataacatgcccacaaggcataaaaatgttaatgatgcaagtaagttctaagagtttaatgaccaagcaaaactctaccaccagatgctgactgcttgttttgcagtgttcaggaaacaccattttcctggctcttaacgcttttgtattggtatggaaaagggctggcagctatagaacaggagatccatagcattttgaacagaagtatctggaatctcactgactcgtgtgttatcaaagctatatcaggcctgggtgactgaattcttgcagaaagcagtgtagtggccaccatccaaatcaccaaaatggttctatgggagaaaggaatgtcaaacttagtattcacatatgaacactaactactggaacagaaatgatagggccaagagatgctttttaaattgtcccttattctaaattaaaaggaagtgataattttgttgttaaatcatgcatatagcctgactgctatattgcttctcatttcattgtaactacttatatgttgtgcccattgactatcatctgtgaataaagaaagacaatatttagcagcatctgattaatgtttatcagtgaacatttagttagcacttaatatacatcaactattaagcattaaaggaaattttacaataagaagataattcaggccgggcacagtggctcacacctgtaatcccaacactctgggaggctgaggcaggtggattgcttgagtccaggagttcaagaccagcctgggcaaaatagcgagactccatatcttttaaaggaaaaaaaaaaaaaaaaaaaagatgagctaggcatagtggtgcacacctgtagtcccagctacttgggaagttggggtgggaggatctctcgagcctgagaggtcgaggctgcaatgagccgtgattgtaccactgcactccagcctgggtgacagagtgagaccctgtcttaaaattgtaagttcatttacgtaagatggcttcttttttttttttttaaagttaggataagccacagaagagacatttaacattagaataaggatcttaactgcatattgctacagcacaaattgagggggctatgtagcaacaacccctcaatcccccatagggtacaaaaaataatgtatctcattttcctttttccatgtctttcctaacccagtattgtttggaacaaaggcattagagaggtgtacttccaaggaggtgttatggtgtatgataagggtcagcaaaccacggcccgt

SEQ ID NO: 16276 - DNA, 42376 bp, Human
tactaggctataggactagcagtgactagtgtcttacttgtctttgtacacccagcaactatctcaatacctggtacatttcagatgctcaataaacacctgttaagtgaattgatgaataaatacaatttaggattactccattcacagacctatactaagtccagtggtatcatccataaggctgaataatgtaaactaattcatgcctatgttttactcaatgctccaccactcatttgatcagaaacataacatgatcctagatttagtgtccatttaacataatcactttaagtccaaatggcagaaagagacaaaataccctttttcttttgggcaagcaatgcaatgtactcaacagacatccctgaccttcatcccatcctgaatctctcccaattgcaaacatgtattgaggagataaatgagtcaggaatgggacaaaggacaaagtgaagctgagggattaggtcagtgagtctcaggatcagtgaatggctatttcagatagcgttgggtaatgtttcataaaagctgaaaacgtttcatgacttattttcttaggctgtatcaaaatattcttggtatcaaaatgactagttcaaaacatgtacccatttgatcttcataataacagtgtgaggtaaacagagcctgtcatttccatcataaagaaaaggaaactaaggaaatatacccttcattcagctgggattttaaaatatgacttaattttttaatgcagtatactgggataataatgctatgttattactgccaataaagagttttttgttttgaaggagctgttagatttagaatactctttagatcctcaaaggaagtatttgagtgacttccaaactcaaaaacctccggagctagggagatttgtttgtcagcttggttgtttgtttgtttttaggtacttgaataacttcctccttgaaaaggagggtgcagaaatcaaaggcctgattgtgctgaatccttctctttggtcattattcagactggttcccagcatgccgcagtccagaggaaaaggtccaagttctgtttaaaaatcagagactaaagagcttactcagcatcctgctcacattaatgttgcttgttttcatcatttaaagtcttttgatagttccttgtatacaataaccttaggcttctgggaatattctcagaacataggaagcacctccctgacttagtaaagatgaaaaatgcttttcatgactatcccctctcttgaaggaccccctggaacagccaggtctttgggcataattaaattctgggcaagattttacagaaatgcagcttcttttttctaatttagttgtgtggtgtgtgtgtgtaaagtgggggaggttccacttggtggggaaaggagaatttgccattgctgctcgtctactcaggactgtttctgttgttgttgtgtttcagcatcagagagtgagagtgtattgcagcaatctgactatttggaagactgttccttgaatttcccaattcaaaagcctcggtagagctgagggatgcttgatacgtcaacacagaccacaaaaggcagggcttttctaaagagattataattatatctaccttttgggtacaggaggtgaatggaaggaagggattctggagcagatatcccaaaagaagaatcccgaagcagaactcctcgcacaaggttatctaaatctccttgacaggtgcacaggcagagaaggcatttggcccttgaagtaacatttacttgagaggttgggacaattctgtcacgcttaggacaagccagctgaccctgagcccaggagcaccctaggactgcagcacagaaaatacaccagctggccggtcgcccctcctttgttccattcccgggggattggagtagcgttggagtcaccgacgccatcccctcccgcctctggcgtgcatggagcatgcgcttccttcctcacttcctctgcaggagggagcgagagtaaagctacgccctggcgcgcagtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaaggtatgtgaacacttttcttcttcctaccttccttttatttcgccacgaaaaggtaaagtttggcataatacgtgagctgtaaatcaccctgacgcgttttctgatcaaatcatatccatgaatacggacagagaaatcagttcgaatttagagacagaagacagattttttttcttcacttttaaaatgatagagcaataatatgggttgtttttaaagatcttattttgaaaagggaagggaacctttttcacctaaagtggcttggattgttttctagttgccttacaacctttctcagacagtctattcattatatatgcagtatatgatgaaagagcttttagtgtgccaataataccaatccaaattatgctctctctagctgagaatagctgataaccctagtgttagaactatatgttaaatttctggtcagaaaaaaaaaaaagtgtgattctgtcagctcaagaaatacaccaagataataaacaaggcaatattgataattactattattgtataatcttgataatctttgttaatatgcatttgtttcatagtcatccaaaattatttctcctaatatttttcctttttataaaaattttatttaataagaggcatattttgtccttcaacgcacaattaaatttatattcacatgtgtttattctagacaaatctctacataatagagaattaagtgcagaaagacctttgaatgaacaggtaggtcaaaagtaacattatgaatgctatttcattttgatttagttattattatttaatgtaattatgctgtgacattttggtcattttgaatttacaaacatcaggaacttaatagttaattgacagaaattaggacgggaaatctagttttggtaaattctatgccctagcagttatttacattgagttctgtataatgaatacatagagtaactatataataacccagtaagctcagcatcacatccactctgttgtaagattgcctaatttaccagagatttctctttcaacaatattataggagaaagaaattaacactgactgagcatctacccttaattttatctcatttaattattataacagtgctctgaaataggaattatccacattttacaaacaagacaattaaatcccatggagattaaatcatttggctcttgtacttggtaagtagtggagcaatgattttaaaccaagtctatctcctgtttgcttcacagattgctgaagcagaagaagacaagattaaaaaaacatatcctccaggtaaaaagaaatcatattgatgttaatttaaataatgtaggctatgagaatctgaactaaaatggctgtgttgggtttggggctattcttccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaaggtaaatgagaaaaaaagaactttttgttaacgtggagtttcctataatgggttaagagaaagtccaatattttaaaaatatcttttaaacattcataatcctttattagtcaagtccaaaattgagataaagcatatatttactgataacatgtagagccccagctccacagagtgccatattttattttccctttaaaaattcctttagtgatgctctgaaaacattttttaatctagtatttgtattttatggtattaaattcatttgaacattcagatttattttaacaatgagtacacacaaaatatcataattttcaaataattagatcagtaaagtaccctcccaccctgcacaaaaaaggtgaaatatccactatttccttttcagtgtttcctcctagccatatcttttctccttaggtcatcctaacctttacgtggcttcaattacatctatatcctaacatcccatatcactaggccagacttctcttagctatagacctatttatctgtttacctattcgacattttcccttggcagtgtcagaagcacctcaaatttagcatgcccatgattaaactcataatctgtgtccacttcacaacctagacctcttagagtactgtttctttaggaaaggcactactatccatccagttttttaaagacagaaatctaggatcaaactatttatcttttccctcacctctcaaattctaatctgccaaaacttactaattttatgtctgtgtatctctcaattgtttttctctgtacttgtccaaactccaatccttgtccaagctccaattatgtctcatgtaaactatagcaaaatctacagttctcccagcaaccactccgcctctccccaactcattcttcatttggcagccaatgtggtagtttccttacccgaagtcaggagttcaagaccaacctggccaacatggtgaaaccccatctctactaaaaatacaaaaattagccaggagtggtggtgggcacctgtagtcacagctacttgggaggctgaggcaggagaatcacttgaacccaggagacaagggctgcagtgagccaagaccacgccactgcactccagcctgggcgacagagccagactccatcttaaacaaacaaacaaaacaggaaaaccaaagtccttaatgaagcttgcacagtcctgcatggactgcttcctgactacatttctaggttcatcctgcacacataatctgatagaaaccttgttcttgcccttcatggcacttcatgcagtttgtaattttaccttcataagtgtgattatttatgattaatgcctttctccaaaactaaactgaaaacttcataagaatagagacattgtaaccccagtgcctggaagcccatgaattcattgaataaatttatgaatgaatgaatgaatgaacaaatgaaataatatatgagggaataaatgaactgccatacctaggcattaagaaggaaagtgtgtttttcatttttgagaaccagtgcttaggagtaagtacaggttttcttccctgtccttattctgttccatagctacaggagatttatgttgattatctctgccagaaaacaactgactattaaattggactttcataggacataataacctaggagtgttctgaagtgtcacgtgtacctatgaagtgggatggaggcaatgggtttatattttgacatatatcatatgccatgctactcagggaaatttactttttaaaatcttgaattcgacttttttacctaaaatattgggactacaaatagacactgattataactgcatacaaaacagattcaaccacttcaactgaagtgatcatttgatttaataaaatagcctaatattgagttggctggattggtcaaacttgttgtacatgcaggcagagacatagatctgtttttgatctgaccgctaatttgagcaactaattttttaactgttcaacattttattaccatcccaagtatgtttggaactacaaagtgctagtcctaatgacttcaggtttaccgtaggaggtattaactccacttgagatcacagagaagacaggccaaggttcttggagaaaatgatttgtgagtaagcttctggtctccccttgtgctctggaaatcctgaaaccagagggtttttggccactaagttgaatagaacctcagatgcatgtagacttcatcccagaggggaaggtaaaggaagctaacttctgccggatgtgttcccagacctactctcgcctttaggaagcttccaaacaggcttgtactataggacccatcaattctccttttcagtgttttctatagtatgcacaatttaggatctttccaaatttctcttataaagtagtgctttggggctcctgtatgcattcgaatatttattgagcaattgctatgtattggactatgaggtagacaataaaccctgtgtagtcagggagcatgcctaacctttacatcactctatttccagtgtctgacacataataagactttaattaaaatatattgaacaaatgaatgtcaagtgctatgttagatgctagggattcaaaacataactgggcagatgatgacttgggacatgaccctttgacattcacttagaatgttgtggctacttaacaaaagttatgtgttaaacccatgtttggctcccctctgggagtctatacatggagggtgaaataccccttcatgagcaggagggaagccattctgagtcatactatccattttagaatagtgaaggaaatcagggaaaggtgaggagcaatggtcacacgttccactgtttacaccatccagcaaagcactgctaggggagacctaagttcctggctcaagagagtacagcagtgcagcagagcaaagactcttcagtgggttactaacatcctccctgttgtgaagtaaatggactgaaaaacagtcatctcagttattttccaggtctaggaggcaaccaatattcctccttttacggatcctgagggatagataagtgggaagggaaataaattcttccacctctgcatagactggggcagtttctgctctatgtattcctgacagcctgacttgcaatccgcaaatggaaaaatcagacacataatagtgagtctctgctcctgaaaaatagatgacgatccaaattttcagccagccaggaggagaactgattttatgtttgtttgtttgtttgtttgtatgtttgtttgtttgtttttcttaggggcttttctgcttttttgtctctctggtactcagctcaaagggctcatggctcatgggctggccaacagctcagcaattttgtactgacagagaacttccagtcctccatgtataattacccccactcattttcctaagcttctttccaaacaagaaagagatattctgcctgaggctgcatatacctctattttcatagagtctgaaagaaaagccacgggataaattccctgtccaaatccccaaaacccatggaagaaaagagcagaatcagaatagaaatactaggctcttctttctttgagtgaatatgatgaggattgtctgggcagaatctggccggagattcaatttccattttctctaggagataattgctgttcctttgtttcaaaatacaaatccactgtgcataataacaataatacattagctttcatatattaggttggtgcaaaagtaatcgcggtttttgccattacttttaatggcacaacaatcccatgaaatagataccttgttagactcctttacagtgatccaaggatatagctaaccagagatatcactggggctaaaattctgatctttccaatctttccagaggaaacagggagaattaagtgcattgtaaatttgatccattcaatgtagtatagattggagatgactaataattgattcctggaagatctccatggatgtgctacaatgcttcattgccaccagccctttccctcaggatgggcccttactttagtctgaagttgtattgccaaatgtattcctaggagagccaagggagcatatgagcatgcttctctgcaaagatttacatattgctttgtgcagatctgttgccatattttaaaagtttaaattccgggcacataaactacagtaagatccctgttctctaaggatgagttttgtcaccttaagctgccttttttacataaagacactctaatacaagttcaattagaagtaaatatttattttaggtgagtcataaaatcttcagtacacactgtctgattctgggtgtgaggtagaagtccctgcccctaccccaggaatttgcctgcaaaggtagtacatgtggggatattaccaaactatctattccctgtatggaactggaatatcaaatcatacaatatatagaagggtacattgaataatatgacatgctatataaatatggcatactatgttaataaaaagtataatatggtttgtattattggtgataacaataaatggagactacttttctgttgcctttagcttttccttcctcttatagtcacctaagaaagtttcagaatgtccattatcatactaagtttttaacatgaagaccaattttatttcaaaccgagggtttctgtggaccgagaaccaccataaatacatttcaaacatatctgaatatacaaaagcgaagtacagattataagtataatatgatgcatgaaatagatctatgatcactatggtgtgaagttgtggtcgttctgtctagatgatccagatggtcttcatcaactagacgggactcctttaaccgctgaagacattgtccataaaatcgctgccaggatttatgaagaaaatgacagagccgtgtttgacaagattgtttctaaactacttaatctcggccttgtaagtcatttggtaggaaataaaccaaattcctagtgcagtttagagtatgccaagaagccaagtcacttgcctcaagtagccaagtgtttataatgtgtcttccttctactaggacccgtaggttttaaggacaagcaaagcaccattcttttttttctaggagtttatcatccatcagaagaactaggcaagtagacacacgcccaaaatgccagctgcttaaaaaccataagagccagagaatagcttatatccaactggcagtaaggaaaggcttcagaggaagaggcgtatgaaggaagcttagagggatggttaggatataaccagcagaggtaaaagacatgtatgtgacaaaaaaagaaataacatgagcaaaagcatgtgatgtgtatttttgaaactccaggtgatctaatttgaatccacctcagcttggctcttctgccctgacctggccctgacaggctttattaagatgctaattttgtaggatgtcaaaggttatctgactatgacccaaagctgtggaggggcaatgctcagggtgtttctcaaaatatgtggtccatgggtttcaacagatagaactaacagcttgcatggtgggcccgaagatacttcttccaggagtgctgagcaatccctataacagccagcatgtggtgcaggcgtaagtgagggctgtctgaaagatggttcagaagattcctctttaaaaaatacatgtttgactacagtttagtccacattattttttaataacaagactgggaatatagcagttatatatgttttgcctttttatgatagatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtggtatgtatgtgtatatatgcatatgcatgggggtgtgtgtgtgtgtgtgtgtgtgtgtgtgtgtacttctatctgtataataattgccttacttgataccaaagaagatttgaggtatgtggcatttttagcccatttatattcaggccagacatgttggctcaaacctgtaatcccagcactttgagaggctgaggtgggagttgagaccaggagttcaagactagacctggcaacataatgagacccccatctctacaaataaaaataattagctgggtgtggtggcacaagcttatagtctcagctactcaggaggctgagaggaagatcgcctgaggccaggtgtttgaggttgcagtgaactatgattgcaccactgcataccggtctgggtgacagagtgagaccctgtctcaaaaaattaattaattaattaatttaaaaatatgtatatacataaaataccaaaaagttaaaagatataaatgatctctactctgaaaataatgtaaagattatgttatattctattatttggtaaagattacatcttataccccacagtaaaataatacataataatatgtgaagtaacaatatcacataataacatctgtgtgtacagtcccagtgaactgcaagcaaacatctcacagttcttttggtatccaacatctgttcacagcagatgtcatcatctgtgcccaatccccccacaaagaagtgggttgactagatcttctgctacaccagcttttgtgttccccagagctagctgcctaatgctgcctctctgttcttggcaatgctcttccacctgctccttccccttttcattggtttagatgcctatttacccaggctaatttcatccttccttccctttgttggactccttgcgtcttcattttttccttagcaccaaccaagctgttgagatctttctccccaccttgaattctctttaaaactttagatgaaactgaccataaggggatatcaaattcctcatctgtcctttgattttcctctgtaaagcacccagacccatggctcctcatctcctccagcatcttatctcaaatacaaagactatagaggctgatggttctgttttagagaggagagaaaatagaaattgggtctggatttcttttttttttttactggatagcctaaaaactttcctctgctctccttacttccaatcctcaccagctgccatcttttaaagcagcttttgaagattcacccactcaaaaaaaaagttctagatttatcaaaaaaaaaaacccttatgacttttgctcaagcttaccagtctgagctaaaatggacacagctatttccataattcttcattcccattacatactcctattcacctatctctaaaatgttcatatgcttgacctgtttactcatgttacctgaatgcatcaatgcaaataaaacacaaatgaaatattatttcaacaaatatttattgaatactaactctgtaccaagcactggaaataccatgcctatttaaaaagacataatccctgactcatgaagctcaaagtctagtggaagaggtagatcatgtttaaatcatcatgtattttcattacaattgcattaagtgctctgaggaaagaaacatggttctatgagacctcaaaaaaggaggctgacctggacttaggctcaggaaatgcttccctaaggaagtaacttgagctgagaaccgaagatcaaataggagttaacttgtgaacatgagaggcagcacatagagaaggatgtgtggagtatccaagcaactgaaacaagcacagtgttgctggcacagaaagaaagagcaaaaagagaagagactggggaggtggacccaggccagaccatgcagcgccttatgagccatggatggactctgatctttattgtaagaaccatgagaattttctggtcccctgaagaattttaagcaaaggagttacatgatcagattgttaaaaagataactctggctataatgtggaaacgcagtattgggcatagatttggggagggtgatgttgcagttagcaggtgagaaatgaaggctgcttggactagagtggcatagtggagggagaaatgtgcaaatttgggataaattttgaaagtggggccaacaaggctactgatggattggatgggggaaaaggaagaagaggcaagaaaggctgttaaatttctatctagttcactgaatggagaatgaaccatttactaagatgcaagtcactgaacaaaaaccaggtctgagagaaagattttgtacactcatccagacagcacttaaactttacccaaaaattcccaggtgtgactgctctgctagggatagacattctaacaggctttcctgtatcctggcaccagccctcctggtggattctgtgaactcaaagcttccctcttcattaaaaggcagtttttcctggggagactcatgataatttatggaggtaaacatggccagagaaagagcccagaaattcccgtttttcccctgagcaggagctggggtcttcagggggttttccctgaggtagagcacctttccctgagcttcaatgaccttttcaaatgacaagagcacacatatctagaaatgggtttgaacctgcaggagcttgcaaacgagggggaattcttgcacttcacatttaagggcatcacaaaggaaggaatcaagctggagtttcactagttctaacaaaatgttcattttttattgatttttccccactggagactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcaggtaaccactgtgtggttgtgattatgtggaacagaaagagtgattccaggaaatgtatgggtgtgttcttttcttcctgttttcagtttccaaatgtaatctccaatgacatacactgtgggcttggggaaaagggttcacatcgatttttttttccaaaggagcatgccagttatgaaaatatttaggaaaggtgatgtttctggataatttaatcttcttgttaacagaaggttcatttatttgttcagcaaacaaatactgaacgtgtgctatgtacaaggtgctggaaaagacctagcacaaagatggatatgaaccaggcagtgtccttgctctgacccagttcaacctcaactcttattgcaactctttttttctcagcttgattgaggtataattggcaaacaaatattgtatatatttaaggtgtacaatttgatgttttggtacatttatacattgtgaaatgattatcacaatgaatctaactagtgtatctatcaccttatagttaacatttttttcttttttttcttttattctttttgtgtgtgtgatgagaacacttaagacctaccctcttagctaatttcaagtacacagtacagtattgttaactatcaccaccatgctgtacattctccagaatgtattcatcttgcataactgaaatttcataccctttgaccaacacctccccatttttccctccccttagcccttggcaactaccattctactctcttcttcgatgagtttgactatttgagattctacatataagtgagatcatacagtatttgtctttctttgcctgcctttttttattagcatacatgttgtcatacacacacacaaaagtaggaaggaaatccttccatttgtaacaaatctttctttaaaaggctctactcactttccttaatggaaacagtgtatgaaacctaattcatcctttttatattattcaagagatctttatgaacagtttcagtttcagcctttatgaacattttaacttcagagttaaaatggagaacattagactgaaggaatctgggaacctcaaacacacttgggaaattatttgtttttgtttttgtttttttaaagctaagtatttcatgcatcctgatctctttgctcatatgtgcagtgagttaactgaggattcagtccatgtttattttggttaatctgcaaggaggataataatgtgcaatgtttctgttgttattgttcaaacagatgctctggactgccttcatggctttttctttccctgttcaaggattcagccccagattgaacatttatataaagacttctataattgtaatctatttctcccaagaagtgaccttaaaataagctttcatttctggagaacatcctttgtgcttcaattccagacattggccagatggcaccggccactctgctggctctgcagggcttgtacatcttgagggtccattctgagccatcttgccccattggttggcagatgccctactcagaacctctgtcatcctggtgagtcacttctcatcagtgaagagcagcagcgtgatgccaaatacttctacggatgtgtccttgagcaaataatgtgatagctgaagttactatttatcagttcttttccaagacctcttcccctgactcttctcccatttttcctccctctcaacccatgactttatggcatttttaaaaattctactgtataaaatgttccttacttgtttttatctttccatttccctcacctcatttcttattgtctttatttttccataattttaatttaaatatttatactgagttctttgctagcatctgtctttcttgcccagggtctcaaccaattaagaatgaataaagcaggtaggaaaccaaaatatcatctctgttgctgataaacacagggctgcagaacatagcttcatgtgagagccaacagtggccttgtttgctccctactcctccgtctagatcttggaacagccagtctcagggatgatttgggtctgcagaacaggctcgtttctcaggttcttgccttgcactgttccaggcaagtggaaaaaaagaaagattccaaatccccaccagttgagaaacataggctaatggctgttgcttaccaaccatatctgcgggggaggatgaagaggaagggggaaaggctaggagtatttagagaaaatctttcagtggcagctcaaagaatagggaaaatgggttccccctctagcatcttagtttttcttttcttcaaaaatggaaacagatttttttttctgattttagaattaatattttttctgagctattatggcatcattatccattttgttccatcaagatgcagaacagaatgtcaaatacaaagggttcccaagaggccgagcgcggtggctcacgcctgtaatccccacactttgggaggccaaggagggcggatcgcctgaggtcaggagatcgagaccatcctggccaacatggtgaaacccagtctctactaaaaatacaaaaattagccaggcatggtggcgcacgcctataatcccagctactcgggaggctgaggtaggagaatctcctgaacccaggaggcagaggttgcagtaagccgagatggtgccactgcactccagcctgggtgacagagtgagactctatctcaaaaaaaaaaaaaaagaaaaaaggttcccaagaaactgctagtaatcgttacttaaagggagttagaggggatgaggaagagaatattactttccatttttatttacttttcagcagttggaatatttttaccatatgcatatattctttcaaatgaaataaagattaaaagtaacatcttgttcaaaaatcaattttgtgtttataaactagaactatatatgttcttattttcaattaagaaaattaagcttaattaatgaataaagattgttcttgccctcagagacttaccacctgagtagagaaaagttgttggcttgccagtcttctacccttccttttgagttcatgttacctcaggttgaaaactgtgtctttatcatctaccctattagcaaatattttaaatgaaattaaactcttttggagaagttatcattgcccatgtccgaaaaagttcagtatagctgtatcttaccctatatttccaatcaagcttagattttttgtaagttaaatatatatggttttagctataaatatagagaaaaatatttcagtaaaatactgtaattagtgctgggtgtggtggtgtttacctatagttccaacttcatggaaggatctcttgagtgcaggagattagtctgagactgtagtgagccatgatcagaccggagaatagccactgcattccagcctgggccacacagtgagacctcgtctttgaaaaaaaaaaaaaacccaaacaaacaaacaaaaagatgctgtactttataaattgacattgaaagaggaagctatcccccacagttttaagttattttgttctttcatatagaaaaagaagcaaaagagaaagaaacactgattactatcatgaaaacactgattgactttgtgaagatgatggtgaaatatggaacaatatctccagaagaaggtgtttcctaccttggtgagattctatgtgttttgtttctactgtggtggttttcattgttcaaagtaaattagggacttggcaataatgacctcattaatttgataatttatgccaaagctttccaaatcaccaagaatcgaccagtttgataatatatacaaataaaattaactttttcaacttgtctttatagaaccagcttaagtacaaatatttcacatttattaattgtctcattagcattttctaataatcttatggagacaattttataaaaatttgactctaggccaggtgcggtggctcacacctgtaatcccagcactttgggaagctgaggcaggcagattgcctgaggccaagagttcgagaccagcttggccaacatggtgaaatgctatctctacaaaaaatacagaaattagctgggtatggtggtgcatccctgtagttccagctactcaggaggctgaggcatgagaatcactttgggcccaggaggctgaggttgcagtgagccaagatagggccatggcactccagcctgggccacaaagcaagaccctgtctcagataaataaataggaaataaataaaataaaaaggaaagaaaagaggtttaattggctcacagttctgcaggctgtacagaaagcatggcaccagcatctgctcggtgaagcaactacttgtggcagaaggtgaagtgggagcaggcatgtcacagcataaaagcaaaggcaagggtgggggaggtgccacacgcttttaaacaatcagatctcgtgagaattcactcactatcggaggacagcaccaaggagatggtgctaaaccattggtgagaaatcgcccccatgatccaatcacctcccaccaggccccacctccaacactggggactgtatttcaacattagtgttgggggaacaaatatcaaaactataccagatagggcaatccagaattactctggatgaacctcattttttttctaaatgaaagtagttttactggtttttccttgactgtaaaagagcatatttatttttaaaagtcattcaatgcaaaaaatcctaaaaagaaagtgaaaatcactcacaacatcaacactctggtaacattttggtttatattcttccagatgttattctgtgtgtgtgtgtgtgtgtgtgtgtgtgtgtgtacctatgtcatttctttctcttatataacaaaaaataagctcatattacacatagtgctttggggtctactttattgttttcacagtagaccaaagacactgttttcatatcaataactttcatatcaacaccctgtgagtcagaaattccacacttagtcaattatcctatggaaataaatcaaaaatgcctcaaaggcttatgtgcaaggcagatattcccactatcacttatagcagtgctgcgcaatatggtaaccactaaccacaagttcgtatttaaattaagagtaacttaagcagaatttaaaatctagtttctcagttgcactaggcacatttcaagtgcccagttgccacatgtagctagtagctaccatatgaacagtgcagaaatgaatacactcatcattgcagaaagttctgttggacaacattggcttgtaggagcaaagcagtgaaaataggctagatactccacaagaggagactaaagtaaattatttatttatttttatgatagactatttaaattttattctaagtgtttgtgtttttaaataattatatctgctccttacatatgcaatgtaaatattgtttatcaagacttacatacatattaatgtatatgtacatgtttatatacatatatgtattatgtgtgtatatgtaacttttacaactagagtttttgttatgtctttaagaatttttctgtataagcacattggcttttgacttctgctgccatggagagccacccttagatcccaaggggctcagggcagcatgggtagaagacgattgaccagcctcctctcctcccatctgagctagtgacaagcagtgatctgcctttctattctggcctcaacagtgtaccatgattacaaatgttgccaggtatggccactatttccaaaaagaaagcaatgcattacacattagaatatattaattatcttcttaaaatagaggtagggcaagaggagtttacttggggagaaaatatacaaagtaataataagatccttacaaactaactgcaaagacatgcttttttgagaatggcagaaaaggctcgtcctaaaatagtgtagtgagatagctatgtggctggtttaatagctgagtacaaagagtgtggtttctaattcatcgtctaccttgaggaagtcacagtctagactcctgtctagtaacacttaatatgatgctactccaaagagtagaattaggacaaagacaaggatacagagtgcagcttaatttaagtagggaaatgctccttaatataagtagggaaatgacccctaagactacctaacagtaggactggcttccttatgaattagtgaaagccctgaaagacagaaatcaaactgtttggcttaagcaagaaaggaatttattgccacgtataactggagaagtccatggagggatgggatagtctggctttgggtttgcgaattccaccaacagtgtgaggaattgacctcatcccatctcacagctctgactttttgtgtcttgatttattccagacagactgctccctgtgggaacaagatagctgggacagtcccaatttcacctcctcacagcacatcaatcccagtggaaagagagcctctttctaccagtggtcctaccattgagtctcactgacctggataggtcctaggctcctccttgaattatagcccaggtcatggaagaccctgtttagtcattcttgagttattctaccaccagtggagtcaaatgttctgagagtgagccagggttaggttccctagggaaaaatcaaggtgcagttaccacaaggtgttgaataggtcaaaccccaagtatccactgtaattcccaatcctggaagtgttctagcagtggccacagagatgcagaagcgacttctgcaattagctgagtaggaggctgaacttgaggatctcaaactatatgtctttccatcctgagagtctatgattcttagaaataaaatccaggtcaaaacatcttaccaggagtgttaatattttggagttgctattgtgatatttctggtgagatttaaacatttttcgtaaaaatttgatgtcatctctcagggaataaaattaaatttctttccttcctccctccagaaaacttggatgaaatgattgctcttcagaccaaaaacaagctagaaaaaaatgctactgacaatataagcaagcttttcccaggtatgattatttaactatttttttagcctttagaataataacccttttgagtggtaaataatgaactttaataaacattaatttaaaaattacagattttgaaaagtgttaaaatctgaaacgcagccataggattaattagatgtgaccttggctattttgtggccaatcacagcacataaatctgacctcaaaaaacattgaaaaataatgtaggtctttactgaagattcctggaggtggctaggaatcttaggtggaaaggaaaaggctacatcacaaaactgagcaatccatcctaaaattctcctttaggtatcttctctccctagataatcacttctccagactactgtccctggtcatctgttcactccccactgcccgcctcccgctctcccctcccaggttttctctctcccctgggatggtctgtgcccctaggtagtgtgctttacccccgctcttggtttcgtcagttccatacctccacctatcaccctactcagcccatcaaaccccagggaactgagctatggaaaggagcctcctttcaaggaggagggtggaacaaaaagagaaaagtttgcaaatggcagattcttttttaaatttgtttagctattaatgacaaccaaaaattgcaaattgttatactttgactctttgtcactatcacagaaattatatacatattcttgatggcatagtatacagccctttaaaatatgttttcaagcagtttttaattacctggaaacatccttccataataatgtaatgacacaagcgaagaacaaaattgtaccacaactgtgaaaaaaaatgcatctctctacataccgcatcacactagcgaatgttttatatcagacactaactgatttctttcttttcttcctatttttctacaataaaaaaacactttattttaaaagtttactgttagactgcttgaggttccaaatattttattggctacagaaatgtattacaattgttttcaaatggttacctactttaaggtttatgatttttaattcaacaaaggattactacatggaaatatggttattttaaagtgagaagggagcaagagtttctctcttttgatagcaagagttcaagtctcttcttcgaatttagggttcctaggggtaaaggagtgtgaagaaaggagcagaaggagagaagtcctgccatagccccagatccttaggtgtgactgagtaatagactgtctttcaaaaatgcaatgtcaaggagagattgggcagctatagagttattatcatttggaatcaagacccaccaaatgtacttcagaacatgacatatcctggcttgatcacctacactgattaaagtaagacaaagaatatgccctctaatggcaaggtgtggcagaatggaaaaaataccaaatcagaattcagaaagctggggtggggtggggtgggggggatatatctaaagtcaactcatgggatgactttagacatatctctcccctttctgggcctcaatttcctcttctgtgatatggggttaaagggttggattagataagcactaagatccctttcaactcaaaatatgatctgagctcaaactgtaccttgtcaataaagttgatttctactttaggaaccaattaatagataggaaacagggctatgacaacaatgctcaatctgattacagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggtatgggattgacagctctaggttagcaatgaaattgggaaagcaaaagctttcaccacacaagggagggtgatccaaagagcaagctccatcacatctgagaaattgacacaatctgtatagaacaggcttggcatgtggtatctttatttgaatagcaatcttttttaatggtcttgagtctcctgggatggcaaactgatttcatcttttgatagtctttagtgttcaatggacttttgtgtttggagaggaatatgtatgaccattagtgcattgtttaacatataatttataatcttatgaatttattgagcaatattttttaaacttattgaatattcctctaaataatcacatactgcttattcaacaagatcatcaaaatttattatttggtcaggcgcagtggctcatgcctgcagtcccagcagtttggattgcttgagctgagggtttgagaccagcctgggcaacatggaaaaacctcatttctacaaaaaatgcaaaaattagccaggcatggtggcacatgcctatagttttagctgctcaggaggctgaggtgggaggatctcttgagttcaggacgtggaggctgccccactatactccagcctaggtgacacagcaagggcaatgaaaacacttggacacaggaaggggaacatcacacaccggggcctgtcgtggggtcgggggatgggggaggattagattaggagatatacctcatgtaaatgatgagttaatgggtgcagcacaccagcatggcacatgtatacatatgtaacaaacctgcacattgtgcacatgtaccctagaacttaaagtataataaaaaaaatttgaatttaacaaagcaaaattttaaaatgatttaaccagtgattgtaacttttaacacttttaaggacttgataaaaatgacaaattcaatatatcaaatttccttaaatagcataaatatatctatgcaatatataacacaatttacatctttttaggattttattttattttattttttgcagtggagtctccttctgttgcccaggctagagtacagtggcacgatctcagctcactgcaacctccacctcctgggttcaagtgattcttctgcctcagcctcccaagtagctgggactacaggcacgcgccaccctgccctctaattttttgtatttttcatagagatggggtttcatcaagttggccaggctggttttgaactcctgacctcaagtgatccccccgcctaggcctcccaaagtgctgggtttacaggtgtgagccaccgtgctcggccatcttcctaggattttagaaactttaccatacccccaaagaaaaagactcaatgaggttataagttctaaattgttatccctttgatttcaggtccgaatgtgggatctagttgtacagttcagtggttcaagtccccttattacaaagttgtgctagttacatcatggaaatttacatctctatgtctcagatagatattatttttctgaaactcaatgtctttaccagaagttgtgaacaaacggtttgaacctaccttatttttctgtcattatgatatattggcatctttgatataattggaaccttatttatgtcttatcacttgagctcaggaggtggaggctgcaccactgtacttcagcctgggtgacacagcaagattaatgtctcattagtagattcatctgcagagtttattctttaagagctgagagagtgggtcagtgctctcttgggtggggggtggtggaggaacccagccaatttatcatctgaaaacacaccattggactctctgaaaagagattttcattggttatgtataaccatcagtggcaatgaataggtagactttttcttgttccttgttatgatgtgatatgagatcacaaggaccaattttgcccatggtatagctcttaattttgaagaaattggcccacttaaaggttccccacccagtatctcctgctcacacaaatagaagcaggttcctattcacacttaatagacgcatgcttactgtctgtgtatgaagtagaagagaaacaaactagctacgtatttaataccttgaaactcaagaataccaataaaattacaaactatttcctttttatattactattacctttgctaacactttttccatttgtgtaagttatttcagttgtcgttgttggtgatgatgatgactttatgcctaaattggtgtagcttgggcagtgggagctccctaaatttctctttagtctttttagtacatcatcattgctttctagcaacaacgggatattctatacccactctgaattttcctttcccaagacttgaagtcaattctccttcaaggagttctggttccttttttgtagaaaagacttgtagaattagacacccaaacctgggttatataagttcaaatgagtggtgatagtggcaaaagatgctgcttctatttcagctattgggacttttttgagacagggctgaaaaatataatttttccttaatgtatcaagtttctgttgatttttcctatcttatacatttttatatttttgtgccctccttttctctagcatggatttcatagaccatcacaattttttcctacattttatattttcctacattttacatttcctacattgtacattttcctacattttttcctacattgacatagctgatgtgtcaactccaattgtttggtagtggcccatgttgtgaaagtttatgatattgcatctgggttcaggaagaaagaaagcagtaatgatcaattaataatgtttgtcctgagcaagagtaggcagaactggtgatatgtgtgccatgtttggggaccctgtagaccaatcaggctgctttgacacttccattcaaccctaggtcactctggatgggtggtaaactctttttaaaatatatatatatatgtgtgtatacatacatacatacatatatatatatatatatatatatatatatatataaaatagctcttttttgaaattgtggtaaaatgtacataacctaaaatttaccatcttaactgtttttaactgtacagttttgaggccctaagtacattcacattgtttctgtaccgtcaccaccatccacctccagagctcttttcatcttgcaaaactgaaactctgtaccaattaaacaacacttttccattcttgctgtccccactccacggcaataaccattctattttctgtctctatggatttgacttctatagtgacctcatataagtggaatcatatagcatttttccttctgtgaccagcttacgtaacttagcatcatgtcctcaatgttcatccatgttgtagcaagtgtcagaattttcttccttttttaaggctgaagaaatactccattgtatgtataagccacattttatctatttatttgtctatggacgcttgggttgcttctaccttttggctgttgtgagtaatacatatatatatatatatatatatatatatatacatctctctttgagctccttctttcagttcttttgggtatatatccagaagtggaattgctggatcatatgctaattctatttttaattttttgaggaaccaccatactgttttctgtagcagctgcaccattttaaatttctaccaatcgtgtgcaagagttccagtttctctacatccttgcctagactttttatttctggatttttttttatcctaacagatgtgaggtggaggatgaatggtaaatttttaaaaatagctaaccaggacaagagtggactatgatctgagacagagaaccacgaattgggcagcatagagcattacagctcacctcaacagaaacccagtgtgcctcaatcatcccctctggaagtgacccatgtatagcaatcgtatttccctagaacccagtgagccataggctacatcctttgacttgctggggtaacatgctcagtgctttaaacaccaccttctatcgctgtgcacagggctgtaggaatgggtgctgacatttctgtttggtttatttttaagaaaaccatgtaaaaaatgaatataaaagagatgattctctgtagtccactattgcctatttaggatgtgagtgtttggagaccaatgataagagtggatttccctcttcattaggatttccatcagatagtaatggggagagaggaagagagtagactaaaactttatccatttagtgttattcttttttttttttttcccgagacagagtctctatctatctcccaggtgggagtgcaatggtgtgatatctgctcactgcaaccctcgctgtccaggttcaagcaattctcctgcctcagcctcccaagtagctgggattacaggcatgtgccaccacacccagctaatttttgtatttttagtagacatggggtttcaccatgttggccaggctggtctcaaactcccgacatcaggtgatccacccaatccatccagcctaccaaagtactgggattgtaggtgtgagccaccacgcccagcctagtgttattctttgcaatggctctcctaaaacattaaaaagaaggcaggaatttggggttaaaattagtccctctgctattgttcagagatgtaatttattaatgttaccactgaacccattactctgggataaggacaactgactctaaaacagtttagaaaacaccagctaagtgtaagccaaggaccagcaatttctaggaaaaaaaaatgtattaatccccaaaaggacataccgacatatatctttgtgttcgcagttgtttcattgcacttttctcaagggctattttgcttccctgttataaaacccagtgagaaaacacccattgtctctaggtagaaaaagaaaagcatccatgtgagtggaggcagggttgactgggttttccgggacagttattcagcaagaaataaacacttattccaatggcatgcctagcgctgtgcttaggaagcagctacagaaggaatataagaaccaattcctgcgtttgaggactcaagcaagctttgaaatggcccaagaatagtccttaactcatatgctggcaagtgcaacacaggccacatacatgcacacatatcccgcttgttgatgagccagacatagatagaacaggatcccttcaggacggaaagctggaggatgttacagagtagaataagggatgaggtaatggtccagctaaaaccacttaaggaaataattataagcagaacacattggcaggaatatctgtggggagtctgttttggccttgcggtgtgtgaggtgatagccctatctaaccacagcaactgtttattaaccatgcgtagcatgaactgggtcctgtgaggaatataagtaataataataatagtaataataataatactctatatttatatcatgcttcagtttacaaagcacgtttctatgaatctcatttcaagcttaatgtaaaaaacagccaacttcattaccaatgatgaaaaatgatacattcacctttgaaaatagtttgaactatttaaactatggtttccacagggacccacattaagtataatatttttaaatgttggtctagttgtttgactgattcaataattattcctaagtttatggatatgctaataaattataatttattctaacttcaaccaaatctataaagttgcttaacttttcaagtaaattgctctctgaaaactactttcaaactttatttcattatctaagtgtggttctttttgccatttggatgtttactcattcacatctgttctgtgagtcactgaaagtctttttttttaatcatccaagggatgaaataagcattctaacacccataaactcattccagtgctatcatttaagtttacggctggataataaaattaggctggaaaaggtgatctctaagataactttcacttaaatatcctatcatcctcatatcttttttacaggagccagaaaagttagcctatttaataagttgataataaattgcctaattcctgtggatacacttattttttaagcaacataagagaattcacgcctgccttcaagcctccagagattctgctagaaatgtccaaaaacaatgagtccaatattctcccctgggagtcagcaagtgggtcaggaagacccaagtaggcttgggagagctatatatcaacatggatttttcaaggacagaaaaggggaatttctttcttatgtacaaatcatgaatctcctttttagaattcaccccttgatttacaaatcagtaaaacaaggcccagaagatgagcaacttgctcaagatctcatggccaaagtggtggagctggccttgaacccatgttttctgactcttcatccagtgctcttccagtcttccatgctgcatctaatgggcatgtaaaatgtcatcattatgcagaatcttgaatctcacagctccgtggcctgtgtcagcacccatgcgtcagtatcagttgctttgcttcatccagttcaaaagtgcaatcatgtaatcttgacataattttaagtattatatcaaacttagtttttataaacactcttttacaaaacctaatgtctttagtatatccagtatgcaataggacaaccctattgatttatacactttccccagagggagagagtcaggacagcatagtagaggaaggacaaattcatgtttagaaaagatatttttctcacagtgtaaaaaccagaacagccagaaaagcaaggctgcatctcgactctggccctcctcccatctgcttcagcctatgttttaaggcttgtgctctattacctcagccatgagctattttttttttccaaaggaagctgaaataaattgagggagaaaatagtccagctttccaaagtcgactctcataaggctttcagtgcacactgcgtaaataaaagatttgctttacagctcctgcaaagagaaaagtcaatatgagccagctgctttgctccaagagcagaagagcacctgatgtgattcccattgttgccaatgctcttgtaagcgtgtggaggtcttaaaactggtggcagcggttcccaaactttgctgcacattggagccacctcaagatcattaaaaagtacaaatgtttggtccccagtcccagattctgatttaattggtctgaggagcaatttggacattgggcctttaaaagttttcgctaagtgattttaatgtgcatcaaagtttgaaaacaactgccttgccgggcgcggaggctcacgcctgtcatcccagcactttgggtggccgaggagggcagatcacgaggtcaggagatcgagaccatcctggctaacatggtgaaaccccgtcgctactaaaaaatacaaaaaaaattagctggacaaagtggcgggtgccagtagtcccagctactccggaggcttgaggcaggagaatggcgtaaatccgggaggcggagtttgcggtgagccgagactgcaccactgcactccagcctgggtgacagaacgagactccatctaaaaaaaaaaagaaaaccactgccttgtcagccagtttaccaacaagagcaggcactcaatttctctagtctaaaaggtgaatttgacccagccccagtcattaaaggctccatatttattttggttcaaaaccaggctctgaccctgtattagttctctctcacgctgctaataaatacatacccgagactgggtaatttataaaggaaaacagtttaattgactcacaattccacagggctgaggaggcctcaggaaacttataatcatggcggaaggggaaacaaacaagtcctccttcacatgatggtaggaaggagaagtgctgagcaaatggggaaaagccccttacgtaaccatctgatcttgtgagaactcactcactatcacaagaacagcagcatgggggtaaccgcccccctgattcaattacctcctactgggtccctcccatgacacatggggattatgggaatgacaattcaagatgagacttgggtggggacacagcccaaccatatcagacccttacttagctatgtcgccttgggcatgtcatttaacctctctgagccttagtttcttcatgaataaaatgggaataatgatatttaattaatagaattctatgaagaataaatgacatatggatgtagtatatctatcacatttgtgttttaaattgtttctgaaaaaatagtttctgatatagctatcatttaggtttagaatccattaaatttcaagtctctcaaataaatcattcattttcactaaaaaaaaaggcagagataaatctatgccatatatatatatatatatatatatatatatatatatatattttttttttttttttttttttttttttttttttttgagacagagtctcgctctgtcgcccaggctggagtgcagtggcgtgatctctgctcactgcaagctccgcctcccgggttcatgctattctcctgactcagcctcccgagtagctgggactacaggtgcccaccaacacgcccggctaattttttttttttttttttttttgtatttttagtagagacggggtttcaccatgttagccaggatggtctggatctcctgaccttgtgatccgcccgcctcggcctcccaaagtgctgggattacaggcatgagccaccgcgcccggccggcttgtaagtttttttaagatgtagtttcctagtttggattccatgctgactgggcaatcttctaattgcaatttggcttctgtacagaaagatttcatccatttactcattgacaaatatttcttgagagcttactctctgtcagtcttgttctaggcagagggtacatcagcaaacaacatatttctaagggaggaagacaataaacttaacaaattatatgctacagtagaaggtaataagtagtcaccttctgatggataaaaataaagcatgaaagaggaggagaatgacggggtgttctgttataaattagggagactgtcctaatcatgtatgttataacccataagatactagtctctcaatgaattgcagtccaattttctttaagctatagtaaactcattctctgttatgagttgataatgttgatatagtgaataaaatagcttttcatacattacatactttttaaaattccataccatttttataggtaattggttcctgaacaaaaagcagcctaatacaataatgctgagacctctactttatttttcttttgagacagaatctggctgtgttgtccaagctggagtgcagtggtgcaatcttggctcactgcaacctccacctcctgggctcaagcagtcctcccacctcagcctcctaatagctgggactacagatgcacaccaccatgcctggctaatttttttttttttttttttttttggtagacatggggtttttccatgttgcccaggctagtctcaaactcttaggttcaagcgatctgcccaccctggcctcccaaagtgctgggatcacaggtgtgagccacagagcctggtcaaggcctttatttcaaattgtcttatgttgagttccctccaaggcatgcactaagagaaggatttgaggtgaagtagcttcattgggaagtgaccccaggaagcaccactgcagggtaggtacatgagcaggaagagaaaaaagccaatataaggtgtgataatgagcaagcttcagcatgggcgactagagctcaatcctattgaagacttctgggaaacagtagaacatgcctaaggaacaaggaagctgatgcattgatctacccatttcatccgtcatcagttgaaggctgctctagtagctagctatgaagagggaggcatgagagtgggtaatgtttgccccacgatggcgaaaacttcatttgtttttactctcctaatttggaatttttaatgcagtgtctaaacagactaagctgtggttttccttatcccaaaaaagctctaacatcatgatacgatatcagagaagatagtagaaaaaatgcttaatattatgtaaagaacaagactattttcagacatactcaaaagttgcaaaagccctaactacctaatgagtgaatgacaaatcattattcattaaagtgagccctatggggatcagtaatttgatttaaactctttaaaataatgaagttgcattgtttagaaatggtctgcactaagatttctctctttgttcaaaataccttatctaactgaattaatttgaaatagaaaacactgtatttttaaaattattatttatgtatctgtttattagtagagatagggtctcacaatgttgtgcaggctggtcttgaactcctggcctcaaacaatcctccctctttggcctcccagactgctgaaatcaaggaagtttctacaccaactattgaagtaaataaggactaaaaattgtggatctcttctggtgtccatttacccctttttgtgtagtagtctctgtgcttctttggggaccagatgacacagatcttcggtggtaaggcaagagtgggcttcaagatcaggaagaaagatgctcagagagtcacttaggtaaatacagtgcgggcaattggaacatgggcaactcttagggcagtgttattgtacatggactgtagttggaggtacccaggttcaagcctggctctgctacttattagtcatgtgattatgactttatgtctctgtgcttcagtgtcttcatctgtaaaatggggatgataataagactgcctcaaaaagttgtcgtgaagaataaatgagacaatgcattttggagcataaagcagtccccagtacatgataagcacacagtacaggtagctcaaccaagagggctgtgcagtagagtagaggtaagagggctcagatggggctcagaatggggtggtcaccacactgagctctgcagctattgcttctgcagaggccctggactttgaaagcctctttttgtaagccatctggtactttctagagcacctggtttcttggtgctgactccctaagctttagggcctcacctggttaagagagtggctgatttttttgatatagaacaaagcaacattactgtccatgtctgaaggtgaggtcttatcctgcagggaatgcaggtagcggaagctaagcagatcagagtccaaatgccagctgttatttcctgtgtagccttagcctactcacttcgcctctctgagccccagattcctcatctctcagtggatggtaatatccgcttgcagacatcagtacaggtaaagggcatcacagagtaggtgcatgagtgatgcctggtattctcatgccacacttgaggcccatcgaacagtgtttacatcctggggagttttattagagccagttctaaggtttgccatccaaaccttgaagtgaggcactggtcgcctctttgtctaagtttttgcccgccccctgccagaattgggcagaagacttagagctgcttacacaaagccacacatttggacttttaactgaagtgatggaatctttaagtatctgccactctcattcaagtccttggcttgatgatgctcctcagtttggaagaaccatccctaaccagaaatgaactaatctaaggacccatctatctagtaaactgaatcaaaactcttctctgccaggacatcaaggtggatttatttgtgtgtgggaatcatgccccttgacacttaccaacttgattcttcctcctggaacctcatccgcacctgctctccttgacctaaacccctcaacacacaaacacacatagacacatacaaatatgtacattacctagttagggaaacaaccttgcaaatgctgcataagtctaatatttgtggttctgaacatacgtgtggtctttaaaatgagatgtagtgatatttcctgagtgtttgatatagttctcttacctcttccaggaaaaacagaagcctatttggaagccatcagaaaaaatattgaatggttgaagaaacatgacaaaaagggaaataaagaaggtaggaccaagtgtggttgtacattgcaaacttcacccatttgtcaggggctcttgttatataaaaattcccacagtcaaattgactgtgctaaagtctccccgcagagcccaaaaaagactgaagtcacctgtcagatacagaggggaacagaacctccatttctcttattattcaaattagcctttcaagcaaaggcgttttcttttcttttacgttttattaggaaaaatgtcaagcaaacgtagaacgaatagcataatggatccctgtgtctccagcacccatcttcaataattatcaaatgttgccagtcttgttttatctagcccccctttcttggagtattttaaacaaaggcattttctgagcacaaattttgtgcaccctgcagtcacaaaagcagtcactcgcttacataaagcaaaacacagaaccaggccctgttctaagtgccagagatgtcccgcccaaggaatgcacagcgtcattagagctatggttggccctgctcagtgatgtcatggataggtgtgttactgccaaggaggtgagaagatgggatggatcttcatactaggacagagacagttgagagaagggccacaagtcttctctggaaagttaaggatgaatctgccgagtgaggagagatggaggcagagcgaacactaggtaccaagacataaagggacaaaacagaggggtggttctgggaactggagccattcatgtccccaggaacagtggatgtttgtggagaagagcagcatatagggttgggaagtgggcagtagccatgccaggaagacatttatgtactcttcagagaaggttggttttagccaagggagcctaaattggggcctaattaggttaagagctgagaaatccatctggcagcagtgtgactacagattgaaaaaataagaccccagaaggcagcagagagataaggaggtaagacagagagatctggagcagaaatatggggctgtaaaccaggggacaacagaggagataaaaaggaagggaggaactcaagagccatgtggagaaggaggattctgacacgattcccaggtatctggccagagcagttgcaaagtgatgccttcctaagaaacaagtaatgcttctcaaactttaaagtgcatccaaatcacctggggaacttcttaaatatcccactgcccaggctgcactgcagcaccactaaatcagaaattctggggacacagctctggcatcagtattttttcaactccccaggttattccagcgtgcagccaagtttgcaaaccgctgagatacagcacagagggagaaagaggtattttcagcaccctggtagcttaggtcttctaagttgagtgatgatggcaataattatcgatgttcatgcatactttatttggttcaaaatgatttgaatttccaggctgtcagttacattaaaatctacatgaaccatatttcatcgaatctgtcattgattaaaaatgcaccattgttttatgtgccattaaattacaacatgccatcaatgactgcaaagactttaaaattaaaatgttcatcttagaatcactgtagtacactgtgtgccaaaatacatcccaaagccatgataaattgtatggtacatcaatttggagtatttgttactgttttcactgattagcatatgaatcagactcctggtcataatcaacaacatcttgcaattcaatgttcccattccagaaatgaccaacctggtgaagcatagaactctggtgcttgcatatggaaggctctgttagcaaactggcattgggttcgatgctcccttttgtctctgggaaatatgcagtatgccctcttgaagacagaaacagagctctttctccactgctctcatatgcgctcagcttgacttggggtcatcttctcaaagcctgtgggggatctgggtcctagggtcatgcagtggctgcagctgtataagcagggagaattactattagttctgacctttcttaaccattgttgccaccctttgtttggtaagggactgggtgacctgaatccccttcccaaacccaggaaagggaggtccatgtgatgtgatagtgaggataatgagaaaatcttatgtagccttaaaaaaatatgcttttaaaaagcgaatcacagcccttctctcctttgagccttacaaccttaaaacttcttttaaggttagcaagatggctactggcttatgtctcctaacccccagctagggcagagttggcattagaccaaagggcctttcctttgcaccatgctggttttcccactgcacacagtaatagccgtgtcataaagataacaatttttccttttcaaaagaaagcaaaatatttgcctgtttgtccattcaaatcactggacctcttcacatctgtctttgggagtctgcacttttttttttttttgagacagagtctcgctctgtcgcccaggctggagtgcagtggcacggtctccgctcactgcgagctccgcctccagggttcacgccattctcctgcttcggcctcccaagtagttgggactacaggcacccgccaccatgcctggctaatttttcttatttttagttgacatggggtttcaccgtgttagcctggatggcctcaatctcgtgacctcctgatccgcctgcctcggcctcccaaagtgttgggattacaggtgtgagccaccgcgcccagcaaggcagtggttttcaaactttgatgcacattaaaatcacttagcgggagtctgccttttattccattaaagatgttgacactgcagcctattctgcagaggcagtattaatgaaccaggaataaacaagaagtgccctttgtgccttaggggtcaggaataaaggaatcatcgccttaggtgcggtgcctgcaaaatgtatgttcagcttcgttctctacttcgtgcctgagagaatgggaaaagtgaaaaacaaaaataaaaatgagcatttattgaacatttgctttgtacctgttagatgttttatagtcagtactacaaggctatggaatggtcaatcaatgaccagcattcagaacctgactctaccactacctgagcaagtaacttacccccttttctgtttcttcatctctgaaatgaggatactaatgcttacccatgagtgtggaaaaagcaacaatgtgctttctcctgttctctcactcaacacaacaatcaacacagaagacttctgtgaccaaatgcgtgggggtttctccccaccaccaagcaagcaatcaattctgcagccgacactagctggttgtccgctgattcaattcaattccaacactatctacttagagtcagcctcagacaccacagggtgagggcgcagtcccaaaagagtgccccttcctttgcaccagttgcatgtccaggcctctggaacagctggctgactggcttcaagtttcggtttccacagcctcctcttagggttcagttaatttgctagagtgggcctggtatggtagctcacacctgtaatcccagcactttgggaggccaaggtgggaggatcacttgaggccaggagtttgagaccagcctggtcaacatagcgagaccccatctccacaaaaaatttaaaaattagccaggtgggccaggcacagtggttcacacctgtaatcccagcactttgggaggccgaggtgggtggatcatgaggtcaggagttcgagaccatcctggccaatatggtgaacctccatctctactaaaaatacaaaaattagctgggcgtggtggcacgtgcctgtagtcccagctgctcaggaggctgaggcagaagaatggcgtgaacccgggaggtggagcttgcagtgagctgagatcacgccactgcactccagcctgggcaacggtgcaagactccgtctcaaaaaaaaaaaaaaaattagccaggtgtggtggtgtgcgcttgtagtcccaagttactcaggaggctgaagcaggaggatcacttgagcccagaagtccaaggctacagtgagccatgatcatacgactgcatccagcctgggtaaaacagtgagaccctgtcaaaaaaaaagaaaaaaagaaaaaaaaaaggattgctagaattcagagaaatgcatttactggtttattaaaaggatattttaaaggatacaaataaacaactagatgaagagatacatagggtgaagtctggaacagtctgaagtgcaggagcttccatccttgtggagctggggtgcaacacccttccagcatgtgaatcagtttttgttcaccttcctgtcagcctccacgtgttcacctatctggaagctcctgaaccctgtcctcttgggcctttcatggagacttcattggataggcatgattgacaaccatgtaggaatgtgattggacaaaaaggacatggtctaaacccagtaaggcctatctctgcagattcttcttggcctctctgtgcaacattccttcctccagggtacagggtaggaccctctatggatcaagggtgttatgacccacaatcagattagagtcctgccttggctgggtgaaaggagggcaggtcagagagaaagattctgcttcctgaggccttcttctgaggcccaaagtgccctaacattatgacaaaaggctgaaacaagggatatgggagttataagccaggaatcatggacgaaaacctatatagatagttagatgatggatggatggatagatagatagatagacagacagacagacagacagacagacagacagacagatgtcatagggtataacctcgtggggttttgtggggggcaattaaggtgatggctgtaaagtgtccagtgctgggatttccctttcaatcctcatggctgtgccctaacagggagcagatgtcctgcttgccagagaggatataagccctgtctaagcctcactcacttagtgattgtagagaggtccttcatggttcgttttcctttctcataagagcttaaggatacccaagtgacccaggctcagattacattcaggctcgctaagggtggctgctaaaccacccttttatacccactctctcctttctcttctcctcaccaactaacagaaagcagcgttctgtctagtcatttacagctgttattgcctaatacttaaaggatcaagggaaaatgggggtttttaaaaggcttcagaaaggtgtcataggcagcctccttacctggaaatctttatttttggtgggtgttttgacaatgtatatagattttgtttgtttgtttgtttaaggaggacagaggaaccaaaaagagtttacagtttggctttttgctccttgcatacaattcaaacagcatgaaataaagtaactcttaatttgaaaaaaaaaagtgggttgtcacatcaacatggacttaaacctagtataagtcaggaagtcaggaagtcagaacacccggttctgatcataacttttactacctatgtgaccttgaacaaggcacttaaccccgaagtgtggttcctagaccaacagcatcagtatcacctgacagccgtttaaaatgcataacctggatcctcaccccagacctactgaatatgaatctgccacttcccaatagccccaggtgtttggtataaacattaaaatttgcaaagccctggtcatgagcctatttcctgtttggtcaaatggggatggtatgacccacctgaacatctcacagggttgtgatgaagcacagatgagataatacatgtaaatattattttatactgcaaagtactacacaaatgccaagaattaaaatgcctcccgatgtgaaagatggggaatggtaattgtgttattgtataaaatgcttctcagttaatggtaatcactgtaatgggattggcctttcctgatctttgctcattatgctctaataatattttccagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctgagattttgtatacagaatccttatttcctcatagacttatattttataatcagaatatgttgctttgaaaaagcctctaatggactgaccttaaaactcatccttcttccactgtctcatccacataagcactccccgaagaattaagggggttctgttttcaaggcatgccaagtactaaagcaccttgcagagcgtgtctattacaagatgtcatttccaccagcagttcccttaggggagctgaaataaattcacattttctcaaagtctcatagctttggaggagccatctgcttttttggctgctctttttagctggctttttattaggctcagtgacataaaaaggatccaggtaaatgggtataggatttgctggatttactaacaatttccccctgttcttaacacttcctattagtgacttttcagacattgagtttacttataaagagagatatttatgtactctctaagaagacaaatgaggtcataaacactgcataaagcaaggcaaaaatgtatgccacatctcagttatctaaactagattagatccaagccaagttttctcaacagagagcaaagggccaggcagtaaggtagaaatagagataaaaatcattccttccttgtgatccaaagctggtcgagcagctttcctggaggaaaaggttaatgaacttcaggtccctgcaactcagcccccaccacaaacacagccctggaaacatacagtggcgcaaggtcctcttgaaatgttaatggttaatgttcccaaaccagagaatgctttgaaaatgtatcattcagtgtaaattaattacatacatatttttctatatatttgtttcaaactgtaaaaataacataatatgtaatttgtgtattagtgagaggtgaagccagctggacttcctgggtcgagtggggccttggagaacttttctgtcttacaagaggattgtaaaatgcacccatcagtgctctgtaaaacacaccaatcagcgctctgtagctagcaataggtttgtaaaatgcacccatcagcactctgtaaaacgcaccaatcagcactctgtaaaatgcaccaatcagcaggattctaaaagtagacaatcacagggaggattgaaaaaaagggcactctgatagggcaaaaacggaacatgggaggggacaaataagggaataaaatctggccaccccagccagcagcagcaacctgttcaggtcgcctgccgctgtggaagctttgtccttttgctcttcataataaaccttgctactgttcactctttgggtccgtgccatctttaagactataacactcaccgcaaaggtctgtggctccattcttgaagtcagcaagaccacagacccaccggcaggaaccaactctggacatattggctgtcactgtttcaaatggtctttgacacctgcattgctgtcctgaatgcccctacctggtatcccaccttttggtggggactgtgggggaaaggctggtttcttctctcatcctctccagagagctgcaaaaacaaacaaaagccaaagcctgacacacacacacgaactaaactcagtatgttctagagaagccagtacccatctgttgagtggggagagggaactaaaaacacctttgcccaaataacacttgccaaaacatagtgaaccagactgtttccatgagtcatctttgataacatgactgactctaattcagccatacccaaacaggctacgtgtccatcagacaataaactggtgctggctaaaacattttatccattcacttttctataatgtatctaaacatgcagtatttttaaaaataagacatgtacttagggagtttgttgtggttctcaaagcacattggcattcattagctcctatccataatcaaaacaaaaggaacatcatcagtcccgttttatgaaacaggaaactggttcacaaagggaacaaaagcacaggatacactccagcttgtgcggccaagaaatggtaaagttgggatagaacgtaagtttcttgtctcagcccactccagtgattctatgtgcaaggtagggactaaagtactcagtccagaatagttt

SEQ ID NO: 16277 - DNA, 15084 bp, Human
  misc_feature (1)...(15084): n = A,T,C or G
agattagcagcaggtacaagtggatttttaaaggaaaagaatgaggacagggagtgggctgatacaaagttgtctttaaggagttctcattggttcacaaaaataacattgattagtaattggctaaacattatcaagctatagggtgtgcgatatggtgtctgatggggcataattaggctaatttataactaatacttgtggcaatagcaagcggttttaagacataaatacatagctcaaaagggggcaagcaggatgtgattgcctctcattttaatgcctctttgggcctaataatttaactcacattcctcaaatcaaagttattttttcattattcactattcaaattattacaagtgatgttgcttttggtgacgttatttcttgaaatggtacacagctcttaatgaattccagaccaaacaaaatacaattactattcaattttggggtaataacattcctagaaacttcaacgtacattaaaagtgtgggaaaatgctttgtgtttatttttttaatttttattttttgaggtggagtcccgctctgtcaccaggctggagtgcagtggcacaatcccggctcactgcaacctctgcctcccgggttcaagcgattctcctgcctcagcctcccgagtagctgggattacaggcgtgcgccactacgcccagctaatttttgtacttttaatagagacggggtttcatcatgttggccaggatggtcttgatctcctgactttgtgatccgcccacctcggcctcccaaagtgctgggattacaggcgtgagccactgcgcccggccgctttgtgtttattaacaaagataggttcaactctcagataattagttttcactcaccgaatgttcagcaggacattcagaaatcgtgtgtattacgggattttctttatgtagcatcatctgttacactgtagggacatttatattatatccctagctctggccttccgatgcctgtggttttgccagccattgttctgaccaaaagccttccccggtggacacggtggctcacacttgtaatcccagcactttgggaggcagagcggggcagatcgcttgaggccatgagttccagaccagcctgggcaatgtggggaaaccccatctctactaaaaatacaaaaattagctgggcattggtggtgtgcgcctgtaatcccagctacttggaggctgaggtgggaggatggcttgagcccagcaggtctaggctgcagtgaaccctgattgcgccacttcactccatcccgggggacagtgaggttgtgtctcaaaaaaacaaaaataaggccgggcatggtggcgcacgcctgtaatcccagctactcgggaggctgaggaaggagaatcacttgagcccgggaggcagaggttgcagtgggccgggatcgcgccactgcacacttcagcctgggcgacagagtgagacttcgtctcaaaaaaaaaaaaaaaaaaaatcaaaaaaccttcacaaaattttaaatgcttagtctcgggacaccatctcttggaaatttgtgatgaagcacagtatccccaataattaacacagtgcttagaaacagtggaactacaaatctttaaaatgatttaaaagcatatttgtctgataaaggactgctggcttgccctcctatgatccatagcttcgcagtccccaaacaagaagctgtgattcaatacgcagtagcaaattcagggtgacaacgagatactcgcgacctagcccgtgatttccttttctttgttagttttcaattccttcgggattacagggaggcgctccggcctcctcccttagagactgtcgcatttccgccgctaggccggaaagcaccaccgtcctcccgcaggccgcagagggctaggcccagctacggccccgcgcgtcaccggaagtgaggcggcggaagtagtgtaaccagctgggagccagccggcaggacgctgtgagttggcgtgctagtgggatggcagatgaggaagaagaccccacggtgagtgaccgtctctgtccaaaacctgtcttttcttcactccttcgggctcagtagcggaggcagagttcaggatcgggtctgcttgccttagtgaattcagcggacagagttcggggacttcacgccctaaggattgatcattttagaaagtggggaaggacatgaaggaagagtaggttttgtgacccctttccccttgattttggtctgtatttgccagacactgaaacacgtacagaatcatcagagatcaaaactaacatctattagcgcgcactatgagccaacagttcaattgttaacaaaactgtacttactgtgaagtaatgggaaaagaatgcattgaaagtcagacagcctggatttcaaaatttccattctctctgagcaagttatttaactttgaacatcagttttctttttataaaatagggttacgggcttacttaaggaacgtttttagcactgtataagcaaatgcataggaaatattagttttgcttactacaaagtctacaaaggtagactttgattcagtatcaactgtttaacagtaacagtagtaataggccaccttagttgtttaaaaataaaacttatggtcattggaactcttacaagtagaagcagtaggattattagttaggaacattgtagaagccatttttgcatgagttggaagttggactagatacataggctccttcaatgctaaggtttcgtggtttttttttttgctgcttcctttggctttctggcctatctgttgaaaaggaaaaaaaaatgtcattattaaaatatcaaatgcaaggcaattatttgacatttctatatatacattttaacttctagtttgaggaagaaaatgaagaaattggaggaggtgcagaaggtggacagggtaaaagaaagagacttttttctaaagaatgtaagtagtatttgacaatgattttgttatagatgatgaaaacttttggacatgtcctttcaaagtagctttattgctttgaatgtttccctgtagggataatattctcagactagcctatcaaattctgtttaacttttgaatcagatagtaccaatcctaaccccaattgtgtgtgtgtgtataaattgctttttttttttttttgagacggagtctcgctctgtcgcccaggctggagtgcagtggcgcaatctctgctcactgcaagctccgcctcccgggttcatgccattctcctgcctcagcctcctgagtagctgggactactggcgccggccaccacgcccacctaattttttttgtgtgtttttattttgctttattttatttttttaatttttttagtatttattgatcattcttgggtgtttctcagagaggggtatttggcggggtcataggacaatagtggagagaaggtcagcagataaacatgtgaacaagggtctctggttttcctaggcagaggaccctgcggccttcctcagtgttttgtgtccctgggtacttgagattagggagtggtgatgactcttaacgagcatgctgccttcaagcatctgtttaacaaagcacatcttgcaccgcccttaatccatttaaccctgaggggacacagcacatgtttcagagagcacggggttgggggtaaggttatagattaatagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggttggttgttgttgagtggatgtgtatgtgttttgtaggggggggggagttgtgttctttttccgtatgtcctttgggagcgggggtcagtatatatatatatatatatatatatgtgtgtatatatatatatatatatatatatatatatgtgtgtgtatatatatatatatatatatatatgtgtgtgtatatatatatatatatatatatgtgggtgtatatatatatatatatattttctttttgagacagagtctcactgttgtcagtctggagtgtaatggcgcaatcttggctcactgcagcctctgcctcctgggctcaagcgactctcctgcttcagcctcctgagtagctgggactacaggcacatgccacgacgcctagctaattttggtattgttagtagagacagggtttcatcatgttggccaggatggtcttgatctcttgacctcatgatccgccgtctcagcctcccaaagtgctgggattacaagcatgaaccaccgtgcccagcttcagcgtcagtgtatcttttttaagaaaaattattttcttaatttttatttattttcttagagacagggtctcactcttctgtcactggggctggagtacagtggcatgatcatagctcactgcaacctttaactcttggtgtcaagtgatcctcccacctcagcctcctgaatagctgggactataggtgcatgccaccatgcccagctaatttttttttttttttttcctgagatggagccttgctctgtcacccaggctggagtgcagtggcgtgatctcggctcactgcaacctccacctcccaggtttaagcaattctcctgcctcagcctcccaagtagctgggattacaggtgtgtgccaccatgcccggctaattttttgtatttttagtagaaacgggtttcaccatgttagccaggctggtgttgaactcctgacctcaggtgatccaccccactcggcctcccaaagtgctggaattacaggcgtgagccaccgtgcctggccacacccaactaatttttgtattttcagtaaagacaagtttcaccatgttggccagactggtctcaaactcctaggcttaagtgatcctcctgcctcagcctcccaaagtgctaggattacaggcatgagccgccagacactgttttattttttaaacatccaaatccttttccatattttgtttcctcactaatgctgaccatttcttatttcatttctctgatgctccttataccattatgtggtttttacttattaggtcagcataagaaggggatccttgtaccagagcatcccagagtgatgttcagtcggttgttagcaaagacctttgttccactgagattactttgtgatgacaggaatttgtaatcttcaggcttctccttatcttacctgaatattcatagaagttactgacgaaagatctattctcctgaacctttaaaaaaaaaatttgggggggactgggtacggtggctcatgcctgtaatcccagcactttgggaggccaaggtgggaggatcacttgaggtcaggagttcaagaccagcctggccaacatggcgaaaccccgtctctaataaaaatacaaaaattagctcggcgtggtggtgcatgcctataattccactactcaagggccgggcacggtggctcatgcctataatcccagcactttgggaggctgagatgggcggatcatgaggtcagcagatccagaccagcctggccaacatgttgaaaacccatctctactaaaaatacaaaaattagctgggcgtggtggcctgcacctgtagtcccagctacttgagaggcagaggcaggagaatcgcttgaacccgggaggcagaggttgcagtgagccgagatcacaccactgaactccagcctggtgacagagagagactccgtctcaaaaaataaaaataaaaaaagaaagcgtcaaggttttgaaagatgaaaaagtcgaggaactatcggattcgagggaactaaggaggcatgacaactaaatagtatgggaacctgaaacagaaaaaggacattggtggaaaaacttgtaaaatctgaatgaagtctgtacctgtaccgatgttaatttcttagctttgatgactccctatggttgtataacatgttaacataaggggaagctggatatagggcatatgggaaccctgtactatttttgcaactcagctgtaaatctaaaattatcttttttttaaaaaggcaaaaaaaagtacagaatccaaaacagaacgataggaactattggctcctgtgtttgtttttttactcctgtttctggacctaaagactcttgccagtgtaaaaccctagggatatgtctatctcaggctggtttccaagtcacccttttcttctgtaggcctggtctactttcttctctttgtacttctactagtttttacttcttctaaatagaggaattattcttaatttactcatttcttcctttagaagtattctatgagtatcttttttaaaaaaaaaaacttaggtacaataaattgtgcaagtcttaagtgaacagcttgctgaattttatgtatgctatacagtcggctctctatgtcatgggttctgcatccatggattcaaccaacctcagatggaaaatattcagaaaaaaaaactgtgcctctattgaatatgtatagacttttttccttgtcactattccctaaacagtatagtataacaactatttacatagcatttacattgtattaggtattgtaagtaacctagagatgatttaaaatatacataggatgtatttagcttatatgcaaatactatgccattttatatctgggatttgagcatctgcagattttggtatccacgggaggtcctggaaccaagctcccaaggatactaagggacaactgtatacatgtgcgcacacacacacacacacactcacacacttgtaatcactactaagatcaagatacagaacacttccagcatttgacagcatttcttaccatttacatatacccctttgataatctgataaaagttataattattcccagaaaaatgcccatgtacagataatgtataaaatttttccgtatgatttcagggtagtctcaaggacttctttttttattttttgaggcagagtctccctctttcgcccaggttggaatgcattggcatgatctcagctctccgcaacctctgcctcctgggttcaagctattctcctgcctcagcctcccaaatagctgggattacaggtgcgtgccaccacgcccccctaatttttgtatttttagtagagacggggtttcaccatgttggtcaggctggtctcaaactcccgacctcaggtgatccgcccaccttggcctcccaaagtgctggaattataggcgtgaaccaccgcgctggccttcaaggacttcttaacgcttgtctctggactgggagtttataggcgataggataagaacctctgtggatctcagctgggtgtggtggctcacacctgtaatcctagcactttgggaggccaaggcaggaggattacttgagtcccaggagttcaagaccagcctgggcaacaaggtgggaccctgtctctacgaaaaaataaaaataaataaatagttagaaaccagttcaaaaactgcttaggcaacatagcaagacccctgtctctagaaaaaattttaaatggctgggtgtggtagcttaggcctgtaatcccaataatttgggaggccaaggcaggcagatcacttgaggccaggaattcaagactatctgggcaacgtggcaaaaccctgactctactaaaaaatacaaaaaaattagctgggtgtggtagcgcatggctgtaatcccagctacttggaggctaaagtttgagaatctcttgaatccgggaggtggaggttgcagtgagttgagatcgtgccattgcactccaccctgggtgacacagtgacacttctgtttcaaaaaaaaccccacatattagccaggcatagtggcatgtgtctgtagtctcagctgctcacgtgagccagggaggttgaggctgcagcaagctgtactgcaacaccactccagcctgggcgacagagccaagactgtctcaaaaaaggagagcaaaaaaaagaattcacacggatcctgtctgccctaaactacaactaccaacaagtgcgatgctgttgtgggtatgagtaaagacgcgaaccagatcagctgggttcaaactcaggttccatctcttactagctttgtgaccttgggtaaatcagttactgcagtgctttaattttctcatctatagaatggggataatcaatagtttctaccttaaaggatcattgtgaggattaaatgagttatatatgtaaaggacttaagacagtacctggcatataataagggctatatatgttttatcttttggcagttatttttatttgtctgtattagacttctctcttattatttttgagacacagtctctcttattattattattatttttgagacacagcctccctctgtcacccaggctggagtgcagtggcgcattctcagctcactgcaacctctgccctcctggattcaagcgattctcatgcctcagcctcccgagtagctgggattataggcatgtgccaacacccccagctgacttttgtgtttttttttttttttagtagaaacaggttttcaccttgttggccaggctgatctcaaacttctggcctcaagtgatctgcctcagccttctgaagtgctgggattacaggcgtgagccaccatccaggcctacgcccagctaatttttgttttttatgtagagacagggtttcgccatgttgcccaggcttgtctcaaactcctgagctcaagcagtctacttgcctgggcctcccaaagtgctgggtttacaggcgtgggccactgcacccgacctagacttatcctttgcatttcctatggtttcttcagatgaagcctgaaagggctttgctgcagttgtattgatctaggaaatgtcaaaattccttgtagtaagccctctgctttctcattttgagtaccctgtttcttcctataagaacagatttggggctgggcgcggtggctcacgcctgtaatcccagcactttggggaggctgaggcacgcagatcaccaggtcagatcatcgagaccatcctggctaacacagtgaaaccccttctctactaaaaatacaaaaaattagccgggcgtggtggtgggtgcctgtagtcccagctactcgggaggctgaggcaggagaatggtgtgaacccaggaggcgatggagcttgcagtgagccaagatggtgccactgcactccagcttgggcgacagagcgagactctgtctcaagaaaaacaaacaaacaaacaaacaaaaaaagtatttggagaactgtctctcatgtcttttcccctatggtaatatcagtaaagagtctgccgtttttccaacgccccactgccatgcccacacacaaaaaccacctccaaaaaaggctaagctgttgctgtctgtcctgtcctttgccagagtttcctacttaaaggtgttctgctgggggcagggactggtaagtagatgctagagattaggaaaagactgtttaccttagggttcagtaggtgggaggaaggaagagttttgctggaggctacgtgggaacagttggtcatcagactgttcttaaaccttttacacaagaatccatacttggagataacaaatacgatgtaaatatgttttcataccaatattatctataacttggttcatttctactttatttttttaaagtatcaaattgttaaatctgtaaaagtaaacaaaagtgattgttcttttacagtgcgatgtatgatgtatggctttggggatgaccagaatccttatactgagtcagtggatattcttgaagatcttgtcatagagtttatcactgaaatggtaagattctttcctaactggtcttagttaattgaagaatagatttgaaatattaaactttaggtaagactagaacttatggcatccctttgaaataagctatccatttgagtgcttgtttgcagaagttattggttactatttatcattgaggatggaggttatacatgtatattctatccccccttcttccttttgttttttttttttttgagatggagtttcgttcttgttgcccagactggagtgcaatggcacgatcttggctcactgcaacctccgtctcccggattcaagggattctcctgcctcagcctccgaggagctgggattacaggcatgcatcaccacacccagctaattttgtatttttagtagagacagggtttctccatgttggtcaggctggtctcaaactcccaacctcaggtgatccgccagcctcggcctcccaaagtgctgggattacaagcgtgagccaacgcgcccagcctcttgcattttttataaggacataattataaaatccttgaataaaataaaaatattatccataataccattatccaacataggttttttttttcccctccttttccagtatttaaagatacgcaattttttgtgtgtgtgtgtctgtgtgtgtgacaggatctcactctgttgcccaggctggagtgcagtggcatgatcattgctcactgcagctgagaccttccggactcaagtggtcctcccacctcagcctcccaaatacctgggactacaggcacatgccaccatgctttgctgatttttgaattttttgtagagacagggtctcactatgttgcccaggttggtcttgaactgctgggttcaagcaatctaccccctcagcctcccaaagtgctggattacaggcatgagccactgtgtctggctcaatgccgtattattaagtatttagcttctattttttaatcattagaaataatgctgtgataggtctttgattttgcacaggtgagtatataatgacaggatgagatagagttatttgatttttagaaaacccaccaatatttattgggtattaagatagaggaggacacaaagcataaatgaaatgggtgggtacacaaaattataaaattattttatataaatgaagacaaaatctacatatatcaaaaaacaaaaaaggaacaataaagttgacagctttcatgtccttaagattttttttaaagtgcctgtgaagcataaaggagaacattgctaataatccagtagaaaatagacaaaggacatgagtagaaagataattcacaaatgaatagccataataataataataagagaaaatcttctacctcacttgcaattaataaatgcaaattaaaacagtaaaatattagatttaaaaaagttaaatgtaatatgtttctttgtaatagactcacaaggcaatgtcaattggaagacaaggtcgagtacaagttgaagatatcgtcttcttgattcgaaaggacccaaggaagtttgccagggttaaagacttgcttactatgaatgaagaattgaaacgagctagaaaagcatttgatgaagcaaattatggatcttgacactttttgtagtttccgaaaattaccatctggggaaaccatatataataattgtatattttctaaagtaagattctgatatctagccatgtaaatgaaagatggagaaacacaaagttttcagcctttatttttatgcctttgattttagggtgatattggtgcatgtaattgcctgcctttatattaccatacttgaattacttactgggttttaatgaccacacataagtcaaagtaccttgcaaaccatgccgttgttctgacttttgactatttaaaggataaagtagtatttaatgtgttaggtatgtttatgcccttgtaagctatactgtagctttttttttttttttttttttttttgagatggagtctcactatgttggcaggctggagtgcagtggcgtgatcttggctcactgcaggctccacctcccgggttcaagtgattctccttcctcagcctctcgagtagctgggaagtacaggcgcctgccaccacgcctggctaactttttgtatttttaatagtgacggggtttcaccatggtagccaggatggttttgatctcttgacctcgtgatccacctgcctcggcctcccaaagtgctgggattacaggtgtgagccaccgcgcctggcctactatagctgtttaatatgtgaaatctaaatggcatttttgacttgacagatcagacttgtacttcatgtattcagaagtttttagacaacaattagtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16278 - DNA, 64291 bp, Human
tggctacctgtttaatttgcaaagccttccaaattggacccccttatcctactccatttttccccttagcacctaccaccttcgccatgttacatatgtgtttattacttgtatgtactgtctttccctgactagtacatgtaggctgctacatgatatagagattaaaagttaacgttttgaactttcatagcaatttaacattgtcatcatatttttattaaatgaagggattcgtctccaatgaattggaaatttttaaagaactagttcttcactactttgaaaagcatggtctagattgtctcataccttcatataatagcatttgaaaggctcattaaatagaacagagaagaactcggtaactattgtacctatcggacttgaactgtttatgctctacacaaaatatagttgctaacaaagacgaatatttttttctaatttagtgagatgatatgtttttctaacatgggcattactttgtgttattggtattcccatgtttatagctgagcctggtatgtgtctctttgttttatatagacacatatataagtggttattaaatatgtgtcctgcttctttggatggtgcactggctgagtgtgtgaataaattttttggaatgacctaggttcataacctaacttgttgattccttgtttcctgggtaaccatagacacataccttgagtattttcatgctgtagtatttccagataaatggtagtgatatttttcacctttggaagtgagtaaagttctggaaaatccttaggtgaaatgactttaaatcaaaataatattttacaacaattatatggcattatgttagaatgaatgcataattgggaactcatccaaggagttgataccggaactataaatatatttgtgaaaataaagtggtgagatttggctgcttggaaacagagggcaaaggtttctgggaaacagcatgccctttatttcccaggtatttgctctatcacagtatctataacatagtaagagctttattcgggtctattgggagaatctactgggtgcttagtctggtacctgaaatgcattaatgaatgctgaaaatcacattatcttgactttttcctgccaatgaccaaagtttttgcaagcattatctcaatatatcttttaacagataaaccaatgagtagattgtgatgtaatttcaggataaacccatcttcagataggatcaggtaaacagaaattatgtattatagtggaagttagacagacctaggttagaaactgaacttcgctatatttactttgctgtgtttccatgcaaaaatcaaacatcttttatcctcatttataaaatggagatgaatttacacattttatagagctgttgactaaggattatggataatttatgtaaatgtgtaggaaacactataggcactcaatatgtgatagctatggctccactacaaaatgtttagtatcagtaggggtgtatgtgtgtgtttgtgtgtgtgtgcacatacatttagtatatgtgttagtgaatccttttcttagacaaatcttaagcccttgtacagaaagaaaaaacaaaaacaaacaaaaataaatgaaattaagagagcagagattgggtggggctggtaaagggagaaaggagtcttgtctggccagtgcttgtcatggccctcagcaagcttccatggccatccctgttgccctttacagaggcctagagttctagagaacagcatggaaaccatgctagtggattttaaacacctcaagtgcaagaatggaatcttctttattaactgatacaggtatcgcatgtggtcttgtgctacagtaggtgattggccacagcttgctactccactactgaagttcttcttccatatttgactacacagcagagttatcatttgaaggtgaattagaaacccactagcaagcctatgtcatttaatggatgtaatgataaccttattttttttcagatctgggttggaatttgcccctgacaaataataaaatgatgagtgatgcaagtgacatgttggctgcagcgttggagcagatggatggtatcatagcaggtgatctgcatcctgtgaaagacagaatcacaacatttactctcctcacttggctttttcactacaactttcatattatcttttcactttattttcattttttagacctatgccttttgcttccctgtaatttcatctttgttcctcttctccattttctgccagcattattctcaaacattattttaaagtatcaaaaatttcagttccatcctaggtttctaatcaaggataaagaatctgcatctcaggtgattctggtgtaggtggtctgtggaccatactttgagggacacttctctacccagtgaacatgaatgttctgatctgttttcttgaattcaaaattcactttccaccaatgactcccgtatcttttttttttttttttttttgagatggagtctctctctgttgcccaggctggagtgcagtggtacaatctcagctcactgcaacctccgcctcctgggttcaagcagttctctgcctcagcctcccaagtagctgggattacaggcacccaccaccacgcctggctaatttttgtatttttagtagagacagggtttcaccatcttggccaggctggtcttaaactcctgacctcgtgatccactcatgtcggcctcccaaagtgctgggattacaggcgtgagccaccgtacccggccatatctttttttttttttttttttttttaagagaggaagtcttgctatgtttctcaagctgaagtgtagtggctatttacaggcatgattacctgtgaataacatgcatagtgcagccttgaaatgctgtgctcaagcaatcttcacacctcaagtacctgcgattacaggcacacgccactgcacttagctcgttcgcatgtgtttaccttcccaattctttgctaagcttccagttcctatctctaatttccaaccagatatctgtccagaaatgtcctatgggcacaccagtataatcatttaatgcattgagctcattatctttcctcagaatttactctgatagtcttcatctgggttcatttcataacccttcatccacagtttttctaagccagaaatcatttggtccaatattggtccggaatggaccaggtctaatatttgtattttctgatctgccactttcttatccatcatcttcatgaggccagcacacctcacaccaaagcccaccaggctctttttctttctataccccatgattggcctcctagttacgaactggaccatggatatttaccactaactacatggttttaatttttgcaccatgtaactctgacttggagagatttatgtgattgaattctcttttttctgtttcttttgattgttccttactgtgactagactggtttaccgccttcggctttggtatttttatctaacataaatcccattgctctctctgtgattttgtttaacttaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatggtagggtctgcctgttccaaattctgttataaatcctttgttgcttattccaaaatttagaacatagaatagctgattagaacaagaaaagtttagggcaacacatgtgctccgattttattacttaagatatcttaattttcttttgactctaaggataactttttaaaaagtgctattagtgtacattttgtaaataccaacaacaggtcacctgattctgcccataaaaacagactggcttttagattgtgcctgaatgacctactgtggcttaaatcaaatagtcctgtaagggaaagaatcttgcacatgatagatgatttctcagtcatattgggttattcaccataaaggatccaatagcaattctaaatggaaagcatgatgaaagactttcaaaaagcaacaggatttacagcagtatttgaccggaagtgccatctagtggtttatggcaatcatttcagttccagttcccgaattaaattgtggagttgggcctttaacccatttatgcgcagtgttccattattggaacgctaagcttgtgggagttatttatatcctgctcaaagtcatcgccaaggtctcatttaaaaaaaaaaaatcacaacctccagcataaatgggttaatggtgttactcactgaacaatgaggccgctttctaggcatccttctcaaaaattgaagatgtggcagagctaccctttgtctgggcacggttggaaatactgtggttttaatctgtgatgaatacataaaatctaaagaatgtcacaaaaacagattcagtggaggacagaggaaaggagatattttgtgcttaaaggatattcaattttcagtaagatgcactcatatgcttatgagttaactgtgttgatataaaagctaataagaattgtatgaaagaatcgtgatctactttatgatctgtggtagacatgaaaaccgcttgctttgggaaccttaagagtacatcctacagctaaaacattttcatatgatgtgacacaaatattagagctcccagccagtcctgtgctgaatactctgtgttcccacctggtttacctctgcgtttctgagagcgaatagtacaatctatcctttagtgggggtgcagctacacaaactggagttattttacttgttaaaacacataatgccttactattatactttctatttgctctacagatttctcctccagagacttaagggtccaggtttgctgatttctttggggattgcttcatgctctgtacttggtgtttcctgacatattccttagtctatttcaatgtcctatctcaccccttctttactccatgttcttctgaccatttagcatgcagtgaaaaaggaatttactattgttagaagaacgtatttctatcccacacccagaggccaccaatggcaatagtagccgaagcgtacctgtagttcagcttttgacatgtgtctaaaacatgtccattaacatgtgcttaatctgttctgtgaaagtattttcagaaatgataaaaagtaatgatggttacatctgaatataagttagatcatgacactcactccttttttcagaaactaccagtggcatcacatcttactcagagtaaaaaccacagtgggcttactgtgggctgcaaggcctcgtaggatttgccccccatgactttctgacttcatctcttgtcacacatctccttattcgctccacgccaagcacagtggctttttcactgattcttaaacatgccaggtacactggcctcagagcctttgcactggcttttccaggcactggcttttcactctgcctggaaagctctttcgccagatatttgcatggctagctccctcacattcttctggtatttactcaaaagttgtgatctcagttaggccttgtatcaccaccctaactaaaattatacccatttattctttgtcttacatctccctgctttattttgttcttagcattcaccactttcttatgtgcaatgtatttgtaatgtttatatcatttattttctgtcttttcaactggaatgtaagcatcatgaatccaatttttgccattatttttaaaaatttactgtatccctggtgcttagaagaatgcctggctcagtagttatatttgtaatgaatgatgctccatgaatgataaagtggattgcatgtttgaatgaatggaagttgttttaaatttattctttggatgggtaatggcttgttgatctgtgttttcagttgctttgtgtcttattatttgacattttaaccttgagaatccacaaaatgacaaatattttacagaactaatgaagattccgtttttatcctaaaagtaacaataacaaaataaactagatgtagatccagagagataaggaatttttgttgttgttgctaaatttatttttatccatctaacttatctatatgaattcctcaccttgcccccaaccttccaaattaagtgtgttttctcaagcacacagagaatgacaggatgaaagaagaaagacagcaaaaggcaaaaaacaaagcaagaagaagagaggagggctggctgtttggaaccacaaaagcataggtgtgaaattaagttgtcaccacacacctaccacgatagactttattttagaaccaaaaagcaacttgggccagcattgggaatccaacaagtagaagattatatacttataatttagtaatttgctgataatattaaatttttccaatttaatatttcagaagttgggatgtgttttatgatcttaaaatgggtatatgtatacattttagctcggatccttcctcccttcctctctcccttctttcctttttttattaataaggtacttagaatagtcaaattttagagacagaaagtagaagggtgactgccaggagctgaggggagtggggaatgggaagataatacttactgcacatagaatttcagttttgctagatgaaaagagttaattagatggatgatggtgatggctgcaaaacaatgtaaatgtacttactaccactgaactgtacactttaaaatggttaaaatgctaaattttacatatatattttaccacaataaaaaattaaaattgatagcatcctagaatttaaggaacacagaatcctagcaaattcccccttcatattgaacatgggaaaactgcccaaataaaagagattatgatgttttaaaaaaggaagcagtgaatgataaggcaggattgtatctaggcagtttcaaatgcaggctgcagtgactgcagacctgaattttaatgttggccctaagtctttgaagcttatatgaccttgtgaaaatgtctgaagctctgtgtcttggttttctggtctgtaaaatggggatgatggttactgccacttaggattgtaaggaccctgtgaactaacatatgctgagcacttattgatatgcctggtcaaaggcttgtcagaaaggtaatactgaagagcagagcatagagagtagagggaaaatgtttaagagcaaccctttgcaatgagggaaggagttgggtccagttgcaatgggagttaggttacaaaccacccatacatagttcacttcttgcaatgaaagagtacaaacattcctctgactgaagagaagcttctgggatattttagaaaaacttaaattcaaaaatttttggaaataattatgtatctgttaataataacagacatataattaaggttccattcatgtttaatgatggccaacttgagaggccctgtactttaagatggatactaaccttttcattagtgcaactgggcatttgcagttggaattatcattttacctgggccagggagatcccctggtttcttgtaggatgcaggttatttctttgctgctaattgctcctgcctgtttgtttcatatgatgagacactgaatgtgataaaataccaacactagtagcctgttacagtgaggggacattaaatctataagaatgaatttattagtgtagctctaggcttctggaaatgaacaaatttcttttaaaattcagaagtgcgtctcctgtggttaaaaaaaactgtagactatgacatatttgtttaattactgagggtgaattttctgtttcaattatgaaatataatgtgttaacacagatattaataatggagaattacttgctttatgaagctccagatttaagaaggaaaatggaaaaatacgtctaattgtttgagttaagcaagtagttacttactttaggtctaacttgatgagttgccctagaacattcttataatgtttttttaactgaggatcatgaccttgatccatgtcaacagaggatcaggtggtgaaatcccgaaggtgtctggctatttggcagttttaattatgaggccatctcaaagtcagcagaaattacaaaaatacaattttcaacaaagtgagtgaaatactaatggtgaatactaatggtagtaacgccaaagcaggcatcatcacccatgagataggtaaacaggtgaagtgaggtgttctggactggcttctgacctgttaaatcatcataatacccttctctcttatttttacattaaaagtgagataatattaatcccaaatgtatatttttaaaagttgctataaaaataaaaatactcataacttaaaagagttcagccacgggacatgctctctgcagggctgctggctgttcttcctgagtccctgactcccagccccacgaagcagtccccgtcctaccaccctccgatccctgctgctttctgaccagctttgcttttcatctgtgcctccaggaaatgttttctcaggccttggcaaacaaggtacatcttaagattgtatcccatatgtgatcacaattatctgagttatgcggtgcctcactgagacatcctagctaaaattaaggcagttttccccttagtcttcaagtaaactcccacagaaagtgttcacagacacagaaaaacaaattgatcaaatcggcagaattcttagtttacagaggtaaaagatgtgcttttcatggaatcctaggccactggtatttgttaggactgaagggaaagaggtttccctgttcctttgggaaagtgagttaagaaagaaaatgtgacaagaacaatagggactttttcttggtctcatgttatccttcccaaagtggaagagagattcctcctctagatcttcgtatcctgtcacacattgctggctttcaacaaatattgaataaatgagtgaatcacgatattgaatgaatgaagttgctgctatactgagataggagctggggcttcgcttttaggaacactgggaacttcttttttctctgtcctccccaaattcaggggacttaggtgtgtacctatgactagggtaatattatagtctaaacatgtacccgccccccacccccgggttgcccactgcgaagctcatgccctcattccaccacacccagtgagaggacaggggagcggagtactgccactgcctggttgcttggtttccagcatcactgatatcatgttctttgactctttggacagtagtggtgtaagatgccttattatggtattgaactcaaatgcaatatgactgtgctcttcatggctgaaagattcaagtcttatctcaatctctcctcatagttcagagtctagtggagagcaggcatgcaggaaatgtttgcatgcgtggcagaggtataattctgagtacaaaatgctgtcatagtaattatttcttttggtaactagagataatgtttacttaaaggagatttcatggactgagccttactcttcctttcttgatcctgaatgtttaaaaacagagttatgaaatcaagactgcgtgacaattttaataactagttttaaaaataagtataatgactggctggaatgtggtgtgtgcgtgtatttgtgtatatgcagtgttactaatccagctatgctttaacatttgttgaccttaaaaagggggctgttttcttttccccattttaatttagatacttaccattctgatttaggaatcttacactcaaaattagtttctgttttataaaataaataagcattattgtggcaaatcactgcttgtatgttgattttggatttagacaggacagcagagctcaggaaagaacaaagcaaaacaaaggggaaacaggaaagacaactgtagaccaatgcaaaccaatagaacccagaaaatcaaaggaaaacacagcatgatgttataagtaaaaacagtgggtgagactcctaccttccgtgaagtaataactattgaaatggaatggcaagtgcatggggtttcatcacgtgcatttctctactttaaatctatttgaaattttctgtaataaaaaacattttttaaacagacacaaaggaaagatgttaacatttattatgtctttatgcttgattgtaatacttcataattaaaaggaagttgatataaaaagaaggctttctagctggggaaggtgaccacacccacctctaaatacggggcttgtaactgagctcacacccgaccaatcaggtagtaaagagagctcactaaaataccaattaggctaaaagcaggaggtaaagaaataatcaaatcatctatcacctgagaacacagggggcgggacaatgatcgggatataaaccaggcattcgaactggcagtggcaaccccctttgggtcccctcccgttgtatgggagctctgttttcactatattaaatcttgcaactgcaaaaataaataaataaataaataaataaataaataaataaatagaaggctttccacttagatggtgaagggaaaagtagatggtgttctaatgttatgtgtagcacctgccatgtagagtcagggaattcgttttccgggtgaggttcctggctagctctaagattctgtaattctatgagggataaagcgttttagatgtgtttctccccattgtgccaggaaaacctggcagaggccataagttccttaattaaatcaaagtaccaatgttacagttgagttatatctcccccactgactctgcatacacactattggttggatactgtactgttgaagtccccaagttgactccaatttcgacttagctggattgaatgcggtcaataaggggttgcaccatgagctaaagtagaaaggtaaagtgatttaggcttctctaatatgctgtggaagtcagatcgactcaacaagagtttatacttaaatacattttaagttacgtgctcaggattttacaagcaccatggaagaatcaaaagaaacgtaagacagttttgcactgagaaacttaggctgagtgaccaactcacataaaattattagtcatctacctgaggcagaatatgatgaaacactaaagagcacagtttaagacaagacccagaaggtcagcccgtagatggggaaaggagaatggcaccatgtaaagaggaggtagacatgggttatgaaagacagattgatctgagagggaggagtgggaggtgagtggagtgttgggtacaaaaccttgggatagttgttgtaaaggaaaatggaagaaagctcattaaaaggaagaaatggaaaatgataagtagaagtggtgattacaggtcccagcaaaacaggaaatcaaggttccaaagtagaagtggaatgatgagctttcaggaaggagttaagaatcagttctcccaagcctgcaggacgaaagaaaggaaagaaataagaggtaatatatattatactattacgcactgaggaagaaggtgtctaagggagctcacacaagatggccttaactattgtccattacaaaggctctgagatcaggcggtcggttagctcagttggttagagcgtggtgctgacaaaggctctgagatcacctcctaaacatagtgggaagagagagtacaggaggaaaaaggagccagtctagatagaggtcaaccatggcgtgcataccagattatagaggacacataaataaagacccactgagaagcaagaagggcagatcaaaaccaaacctgcagtcatcttgtattcaactagtgtttattgaacacctatcgtcattcttccattcaacagacatttagttatcgcccactgtatgtcacatgccaaggcaaatctacttgcaaagaatgcagagtctattagaagagagagacatgtatgcagtcaagtctaaccttagtgcattcagagtaatgcctgctgtaatgaaggttcatgtagatactgtcgctggcatatagcaaacagtgaattcaaggaagacttcacagaccaagccctgatagaggtggaccttaaggaatggggaaagaagaagaaagggtgggaaaagacggtccgtgcagaaggaataaaagtagtgtgtgaaagagcatgccatatatggggaggttttgagtgacctggtaggtagaacgtgggagttgaaggaagaatagagacaatagggtatttacctaatggatcttactgccaacattcttaatgcaaaggaaacaaaattggcagaaatataaacacaggtggacagaacagtctttacctacttaagttaacacaaggatataacattgatcactcttaaattctgccttatgttcctatagtgacttttaatatactaaactacccttgagcattatgagtgcttgtaaatatcaatacagtactgagaaaaataaatatgctaattttgagccaattttcagtatctgtttctatttggggctaattttggagaactggttttggaacacctcacttccatatcatacaaagtagcttgggaggaaacattgctctcatcttgctataatttcctccaaccagaagaaagatcagtttgtttgtttgttttcttaagacagagtcttgctttgttgcccagcctggagtgcagtggcgcaaacatggctgactgtagcctccacctcctgggctcaagtgatccccctccctcagtctccagagtaactaggaccacaggcgcacaccaccaagcttggctaagtttttttttttttttttttttttttaagagatagggtcttgccatgttgcctatgctggcctcaaacttctgggctcacacaattctcagcctcccgaagtgctggaattacaggtatgcaccaccacccttggccagttttactttttgtcctcactaaacagcagtttttttctacttactgaaatgtatctgtttccaaactattgttacttgtatgggattttaaaaacagatggctgttaatgtccataatcaaaataaggaatttaaagctctacagggcctgtcttggcactttcttaagattgagaacatgcgttattcatcctggctcttttccaaaaaactgcccttgagaagttgtgcacaatttatttttatgttagtccccaggaatggaagttgtccaggccactccatcacactcttcataatacttgtaatttaatgctgggcacttcagttaacaatatgagcagaattatgccgtggtaattgtagaggtatgtggcaaagcagctgattttaaaattttaatccactctaaatatgcattgcacccttactaaattagcctctgattcttagtggccttttggaaaatgtattcagtatgctaaagtttttagaaaaaacattctgaaattttccttttcattcaagccctgttttttttcttcccccttcccagcacatgacttttattattccaagaattgatactagaaactgcatttattggaaagatagaacaatggtatcagttaattctggaaaaacagtagatgtcacatcagatgtgtcctgggcagtaaagttatacagtttgtattttttctggttctaaatctgaaggtattattttctttttcagttgaaccctgggtggccccatctaacactttcggatttcagctggcttttatttctattgtatttgaatgaagaatcaggaaattctattgggattacattatcttatggttatgttgagattatgagagacaccacttatgctactacgtacgtttcaaagtggtgcttttaggttttctgttctttgtgagcctctttgtgtgtctttttcatgacttgcatgtgaggcagctgaggaagaaacaatctatacatcgtttctcaatctatacttcctttggcatttataccacgcataaatatactgaaacatgatttttttttaaaaaagtgtggggggcaggagggaggggaagaaatagtaagcatcaatatacacagagcactgagccagatgctggggaggttaccaaacgaattataggctctgccctggaatagaaggtaacgttatacaaagaagcaaactcacaagttaataagatcaggacaaaaagtgttaaaatggagataagtgaggctagtctgcgctaccaggggaagtcactgtggcctgagtgtttaagcttttggaggaagagagacagacctcaacaactcggggtgccccctacatactcacaaagctttgcctgcccctgggtgtgtgtctgctctcagtgaagaataccagtatccactgttccttgtgggtcattattttctgcttgataagaaattgtttactttggcaaaacatgcctatatgcttaacatgcctgtcttacctcttttgtggtaaatgaaccaaattgcattctcgtattttctgtttgacagtgacagctgtgcagattcaattcaggccccttggactaagaacacttgtgattttcatttatctacgatatatcattcttagagaagatcagccttacccatattacttcctttttcagacaaatggacacctaccagggaacggagatgtgtatcaagaaaggctggcacgtttagaaaatgataaagaatccctcgttcttcaggcaagtgatttttaaatactgttctttccttgcagcatacttacaaagccttttaaattggggtggcaaattcagattgcttgcagcaatcagactgctaatagaaataagcctgataagccatctgtacacaatagggagtggtgaggattggggcagaatgatggtgtttacacccagtttaaaaggagctaccattaatcatcctcagctcttgcaggaccagtctgaatacgggcacaatgttgtctgatctgttcttttttttttttttttttggaggcagggtcttgttacattgcccaggctagtcttgaactcctaggctcaagcaaccctcttacctcagcctcccaagtagctgggattacaggtgtgcagcaccatgcttcactggatctgatttttaagtatattttaatatatagcagaaattcagatatatgaatatagcataacatctgaatatatgtaagtttatatttctgaatctgaaatcagaatatatatatttaatttttcaattttaaaaatgttaccctgtgtgagacaaaacaaaacagtgactagaaccctccttgtgggctaaatttgagtttgcttcttcataatgttttaaatgcttcacaaacatttttctttggtatattgagcaaaatgaattgaagtatatttactgagtgatgattattgaggaaaaactcaaagatctgctgtaagcactagagttgaaggactagcccaacagctcctcaggcacctttgggtatattgagttgccccccctgactttgaacacatctatgatctgtgtcatcttcaaagagctcatggaatttgaattccctgggttttgtttttgtttttgttttggacggagtctcgctctgttgccgagacgggagtgcagtggcacaatcttggctcactgcaacctccacctcccggatccaagcgattctcctgcctcagcctcccgagtaactgggattacaggcacatgcccccacagccagctaattttgtatttttagtagagatggggtttcaccgtgttggccaggctggtcttgaactcctgacttcaagtgatctgcccgcctcagcctcccaaagtgctgggattacaggcgtgagccaccgtgcatgctacctctcccccctacccctggccaggttctttttcttattctccttgaagtatcaaatttttgataatttctatttcaaacattaactttgtttcctctcttatactatctccaccctgctccctaaaaagataacttctgcacatgctgtctctcataaatggttgaagtagctttaaccaaaaagtattgtacattcctaatctacacgaactttctccaaattgtataggcctccttaaatcaaatagcaacatataaataggaatgcgagggaccactgtcttcttggtacttctcagatttttttttctttataaccgtatgaatggtaggatcattcctttttttgttccatttagagaaataacgtatgcagtgggacccaaattctttttcactcattgcattattttgctctaaatacaggtaagtgtgttaacagaccaggtggaggctcagggagagaagattcgagatttggagttttgtcttgaagagcacagagagaagttgaatgccacagaagaaatgctgcagcaggtatgtgcagaggccagaaccaagatgggatttccctgctgaactatgtgagatgctgcatttctatgttgtgtttgctctgatgcagcagtaagtttcttgattcatttagaccagcacattaaaaaaaaaaaattgagagtagtagagtctcaaaacacatgcacacaatataaagtgtttatgtaattagaatctggaacaaaatgtcaataggattgtggcttattttaattttctttttttgcattcagatggtttcctctcacccatagcatgtgttttataattaagaaaaaatataatagtaaaaaatctaataatccagtttaaaaatgggtaaaatatttgaatagacatttctcaaaagaagacatacaaatggcaaacagacatatgaaaaggtgctcaacatcattgctcatcagagaaatgcaaatcaaaactataatgagatactatctcaccccagctaaaatggcttttatccaaaagacaggcaataagaaatgctggcaaagatgtgaagaaaagggaacccttgtacactgttggtgggaatgtaaattcatacaactgctatggagaacagtttggaggttcctcaaaaaactgaaaatagagctaccatatgatccagcaatgccactgctggatatatacccaaaggaaaggaaatcagtatatcgaagaaatatctgtgctcccgagtttgctgcagctctgttcacagccaccaagatttggaagcaacttaaatgtccatcaacaaatgactggataaagaaaatgtggtacttatacacaatggagtactattcaactataaaaaagcatgagattcagtcatttgcaacaacatgaatggaactgaaggtcattatgtgtgaaataagccaagcccagaaaaacaaacatctcacgttcttacttatttgtgggatctaaaaatgaaacaattgaacccatggagatagagagtagaggggtggttaccataggctgggtagggtagtggggatgaagggagaggtggaggatggcgaaggggtacaaaataatagtttccatgaataaggcctagtatttagtagcacgtcagggtgactatagccaataataatttaattatacatttggaaataagaatataactggatagtttgtaacacaaaggataaatgcttgagaagatggagaccccgttttccatgatgtgattattacacattgcatgcctgtatcaaaacatataccccataaatgtatattcctactatgtagccacacaagtagaaaagaaaatatctaacatataggagaggctctgtaaggtcatggatggagtatgcacttgagcaaaacctcgtaggtttccattcctgctgtgtttttattttttctttttccctgtatgacattaggccagttcctaacctctctgttactatgtttcctcatcttttgattaaggataataagaatttctacctgataagttttttgtgaggattgaaatagtatttgttacaaccggtgcctggcacatagcaaacatagtatcaccatcatcaatgttatcatcagactgaagtatatatatggtttatgcatgtgtatctacacaacatatgtctccctcagtaaactgacatgtgcttatttctgttcaaaggagggtaactaaagtgaatagttcttttttattttattttattttatttttgagatggaatctctgtctgttgcccaggctggagtgcaatggtgcgatctccgctccctgtaacctccgcctcctgggttcaagtaattctcctgcctcagcctctcaagtagctggggttacaggcacccgccactatgcccggcaaatttttgtatttttagtagagacagggtttcaccatactgtccaggctggttctcaaattcctgacctcaagcgatctgcctgcctcggcctcccaaagtgctgggattacaggcatgagccactgtgcccagcctcaagtgaataattttttaaaagtgtgtagattcagtaattatacttcactatatcctctacttgataggtgctgctttgtgcgatcataaatgaggtaaattcacgtgcctgtttataataaaagacttcttgaatgtatctgttaaattataataggagcttctaagtaggacatccttagaaactcagaagttggatctgatggctgaaatatctaacttgaagttgaaactgacagctgtagagaaggacagattggattatgaagataagttcagagacacagaggtgagtgatacagtctctcctccctctctctctctctctgtcactctgtctttgtctctgacacacatacattcctagggcaaagttgaaattccctggaggtgtgcaaggaaggcagttaattactacgtaccatcatcctacttcattttaagaataatctttcattgcattgactttttatcactaaatgctaatggcaatttttatttttagacttttgatatgaagtattaatctttttattaacctttagaaatacttttgactttacgatatttggagcatccgtccatccatactgtttttcttaattttgtaaataatgggcttaaatacatggtttcactagtagttattatttaggcacactgattatttactatgtaattggattttgaaaatctgtatagaaaacatgctaacattctatactcacaaaatcacagacagagcttttttgaggtcttttaatttggcattctacttttggtctgttccacatgtaaatcattccaattaaataagactcactgtacttctacaaaaatcagggtacattctgtaacttgaagtatccattttagtggcttaacaagctttattgtttgttctattttgttaattcaggcctcctagtttgtttgctttgtgacatttggcaagttcttaacctctctgttggtttttgatggagacagagagcatatccatttgaaacatacatttgaaatgaagtataaagagttgcagaaatttcttttctctgagagccatctcccctcctttttgcttcctattttgtttccttggttggagtatggaagggtgtcatgctggattagaaaatgggtaccaaggagagaggagagaaaatggtttacttatttttcccttctgtttttatttcaatcatgtatttcacgctgactataagccagcatgataccaggcattacatacattatccaccataggaaagttctttatattggaaataacaagttttactccactgctattttcaaaattaaattttctgtcaaagattcaattacagtggaaagtcttggtatatgtcttgcttcctccatagcaaaaggaagtctttcatttggttcatgttttaatctttttttttttttttaagagataggatcttactgtgttgcccaggctagtatggaactcctggcctcaagcaattctcccattttggcctcccaaaagcactgaggttacaggcatgagtcaccatgcccagccatgttttaattttaaaactctttgtcagttgcctgtgtgagcatgtttctcatttgatagaagctggggctcttaaaacaggacttagaaagttacccaatttaaaattcttggttttgtattttctctaaaaatctctttgatattttcctctttcccctctttttgtcaggtcctaaccccatagtcgcagggtaaagtaatagtaaaactcagtcaacagatgggcaacatggcagtggagctagctctgctgcagggaagaattgatggtagatatggatagaggtggtcttctacattgcgtccacaaagtcaaggggaaatattcacctgttgttaacttaatttgtatatgagatgttaaccaaatgttggggctaaattgcagtagatgtgttacttattgttgtaagcgcctagggtaatatttatatcccttgagtttggctgctttttttaatcaaatctcttttccccactttttcattgtttcactcatgcactctcaatcacatacaaagtgatcttgtcatcaaacttcctgtacactcaatccctgataatctaataaaaattcagtgttatttctaaaacgtatgcacagacccggagattagagcatatgtggtaaactttgtgatgttacatatgaaaataattaaaataatcttcaacattaaactaacttgaatattctcatgttcttgttatcgtccccttaataaaaatatttttctgggtgtttcatgaatccataatatttaactttctcttagaattttagatttatatttggatattaatttccaagaaaatattggcatggggaagaagtataggcatttccaaaggactgagggtacaagtctttaaactttggaagattcaggacttgtccctggaattgctaatgggagatgattagcatcattcaacagtgcccccttgtggtaagagcatacatgtcagagactgagttcctgcaggagccctgaattctctgaaagggaaaagagaaagggaacaggaattttcttttttaaaaggactgaacttctgataagaaattgattgaaatagtttgtattctgttttttaaagttttacattagggagccatttccagattttccagcttgtgttgtcaggggaagatgtgatttatttcaggttggaaatttagaccatatttaaagtattgccatgaaatatagttgagtagttttttgttaaaacagataaattatcccagtttacaattccatttttttcagtggtttcttctttgcacgagcaaagaagaaaggaagctgtaaaatacaatagcagataagaattcaatggtatttcttagcaatgagaaagtaggaaaatatatatttagaaagatcatattgatgaatatcactaaggactcatattatgcaaggatgattagcttagataactgggaaaagctgatttttttctttagacttgaattctgacctgttagttgaggaatcacaaatatgttgctgaataatgtcaaacagttcatgacctaattcataagaagaaaatagatatcatctaagtgaaatattgtgccattattaaggtgtaattgtataactatgataggtaatattttgccccattttataagagaccacaatttaaaagcctaagggtttactgggaagtgtattttattgtagcatcccttctcttagcctttgtgaacttgaatcattacacttggaagcttaaaataatttctatttacaaagttttatttcatatagcattgttctacttgtaatttttggcattcgtggataattttgtcctgtagtctatgaatttgtgatgcaggaatacatgcatgtctttgtaaaaagagagaagctggccgggcacagtggctcacatctgtaatcccaacacttagggagtccgaggagggcgggtcacttgaggtcaggagttcaagaccagccaggtcaacatggtaaaacccccgtctctactaaaaatacaaaaattatctgggcatggtggtgggtgcctgtaatcccatctactggggaggctgatgcaagagaatcacttgaaccctggaggcgaaggtcgcggtgagctgagatggcggcactgcactccagcctgggtgacagagtgagactccatcttaaaaaaaaaaaaaaaaaaaaaggagagggagagagaagcaaaaatatagtaaccattgtagggatctttgtggcttgtagtaaaataagtcatctcccatgcagggtatttgagtgtctcttttggaggagttaatattgcttaacactctaatttcctttcctactctctgggctcttggacaagttttgtgagcaaattggtcctttaaaaagtagcactaaaataaagtggcagtagaaaaggtgcagaattgtgttgtgtcatataaacactaggattggtttctctttcattttctaatgataaaattaggtgaactgcagggccctcatccactttccagttgaaaattgtcattaaacttacagtaaactcaatccctgataatctcctaataaaaattcaacactattgctaaaatgtatgcacatacccagagaatagagaatagttgagaaactttgtgatgttatatatgacgataattaaaatagtcctcaaaattaaaactgatttgactattctcatgttcctgttattcacttaataaaaataaaacatttccctggctgtttcaggaatcttaaggattcatggcttaaaggatttaattttcatttcattctcccatattgggttgacgagcaatccatatttttgtggacaaaggaagaaattacaaattttttaaaatagccatgtatcattgagaaggttcaaaaggtaaatggctttactaaagaatgtggtatatttaaaatatgaaatagcattctatgaaatagaatagaaatagcactctgtgaaatagcatagagtcatttttaggatagaaatatctgacaaataatagctattacactacctttcttaatcaaaattatactcaccttttattttcataagcccatcactttagggcagacgcattggggatttaaaggaatgttttaaatggaaagatgctttcgttcttaaggaggtacatttatttccatttgtctcatctgattcatacaactttaaccctaggagctggtgacttcttaagatttccaagctgctattttataggtataggtaactgtgttaccactttcctaatgtactttcttgtttcttcttggacaggggctgattcaggagatcaatgatttgaggttaaaagttagtgaaatggacagtgagagacttcagtatgaaaaaaagcttaaatcaaccaaagtaagtttttctcacaggttaacattttcaaacaaatggcatcactattcatctatgcccaataatataaataagatgttttctacttaatgtatgataaagaaggtattttaaaagtaaatgaagatttccccccaagctggaaaccttgaatttaaacaccactgatctgaatttaaaaacaaggcttaactcatccgacagaacataacctgccctttctctgagttgtatctaacctcctttataaactgatactgttttctcggttatttagcttgtctttttctatctgtagttttctttcactcctctgtctctctaccagtctttaatggccaaactttctagcatgaaaatcaaggtgggtcagatgcagtatgaaaagcagcggatggaacaaaaatgggagtcactgaaggtgtagtagacgttgggtgatggggtccatggcctgttgctttctggcttgtgttgttttgctgtgatgatgtttttagtggcatgtgcattcattctgtgtgtgtgtcacctgttgattacaaatcacctcaagctgattgaagggacaatgggatccctgatgttgttttcagaaatacatgaaataattggtgaaaaataataaacaggtaaaaagaaagaatttataaattaatctcttagactatctgagacccaagcctagtaaaataattgtaaacattcgcttgtgaaagaattctgtttcgtatccacagtagaggtcattttcctctttagggactttcttgatggtaaatgtacagcagttgatattatcatggctgtgaatagaaatgactgctgagaagcagcacggtgagaacaggttcacacttcctgccagtgctactgaagactttttgtacttgtccactctgctcctaccagaagtcaaaactatagggccaagtgcctcacttcattggagaactacatcttctcatagtactaaatgtaataaatatatctttagagattctgaaagcaaaatgtgatgttgaatataaagctgtacttcttagcattgcatagctgtattttctgtgttaagtacagccagcaaaatttgtttgctaaaactaattctttactgaaaggaaactgaaaatttaaacatgagtacatagaaggatggacttgaaatcttatacacagttgtatagttaaaaattaaaagagggctccactatctgttttcgaaatttattttttcccattgttgtaggagattctgtccttttgtcttagtgatgagggtgaattatttagttccctgatttggctaaaattgttcatgacttgctaccttacccatgaatgaaactctgtgcttgtcaaggaagcatgagtgccaacttgaaatgctgaataaatgtcaagctagtcttttccaatttgcattttattttgcttttatgacactaagtatctaatttgattatcttccttgattaacttggttatatttttaatttaatgtaaagatttaaaccttagggctatcccatccctaattactctttaaaagatctctttttaatttgattacaaagaaacttgaaataattataccataactattataaacaggacttctactaatagtcttgctttttgcttttcattgcccttgtctgatttctgatgcttgcatctaaattctagtagatttgtttcattcataaaacctgattattgatttaaagagctaatatgctctctgaatgttccttttcagtcatgatctgctatttttaaatgaatttgtaacttgtaggatgaactggcatctttaaaagaacaactagaagaaaaggaatctgaagtaaaaaggctacaagaaaaattggtttgcaagatgaaaggagaaggggttgaaattgttgatagaggtaagaagatatatttcacatttatcatctcattttgttaaagtcctccaaaatctgtaaaggaaaccaatgaaaatcaatgtgtagttttagcatcaaagaaagagcagcagaatccagccaggaccagaaccacaggggattctccaagactctttactgtgactgggaatccattaatttcctcttcagcagctggaaaaggggaattctgtactttatttggtgtttaagattgctagactgtaaattctcatcacaaggatggacttgtctcaattgcgatgcaagggaatttgtgccaaaggagttaaaaagaaccatccctgtgtcccgggatcgttgccctcagaactgaaattagataaagtaagggacttagaaactgttctgcccttttgagagaagagaaaaatggttctgtatctttggaaaaattagtaaaaaatttataccagggattgagccctccaccttttagaaaaataggctaattctgtttttggaaaaaatgcatgaatttgtccaaacttttttcataacagcagaggtttgttctgagtattatatggaccataatttctaacaaagcagattgtgcatgatagaaaatagcccgaatgaaatacatttttaaaattatatttggaaatataatgtgcataatatctgacaacactaggttaaatttaacctttctttgttattacgaacgatgactgtggccctacgagataccaaagcaatttctgagtcattcaaaacagtacaaattccagttagcgtagctttgttacatttttatccattttatgaacattagtaacattgtctgtccaatgagggacttgagttagattatctctaaagtccttcttggctctagaataccatggccttatacccctgcaggtatcacaattccctgtccgtcagaaaattcatcaagcctgaggaaaatggattctcaccaccaaccgcttcaccgccccaccccatcacctactgtttggcatatatataattgtgtattgataagggacattcagaaacaggtcatactgatcatgctttcagggttttaagaataaaatgggctggtttcagtggctcacacctgtaattccagtactttggaaggctgaggaaggaggatcgcttgaggccaggagttcaagaccagcctgggcaacacaatgagaccctgtctctacaaaaaatttctttttaagatttgaaatttttaaatttcaaatttcaccaggcatggtggctcactcctgtaatcccacctacttgggaggctgaggagggaggatcacttaaggcccaggagttcgaggctgtagtgagctatgactgtgtcactgcacttcagcctgggcaatggagcaagatcctgtctctgaaaaaaaaaaaaaaaaaaagaataaaatggcatcacaggacttgtgggctagaagatattagagtatgctccccaaagtctgatctgaggactcgaaccaacctgggaactgcgtgttaccagtgcccaccagctaactacggggattgagaacaagtctttagaaagctcatgtcagggtgatattgggatagcatctaactgcatcctcactggactcatcttactggacaggagatagaccctttcagtgttgttgaacttgagtggtgagttgcatgtgacacaagcagtgttctagtcacattcaggaggaccaggtatcaaaccgtgatggaaatataaaaacaaagtgacactaactaggttttcatcatttatggtataagaagtgcttgtagtccataaacctaattttaatgtgagaaaatcaaggtccagaaaaatgaagtgacagaggtagtaactcaaatttaggtcttctgttctctttctaacctcacatagagcattattgtactaccaatcctgcagtcacaaaatagtgctgaaaaagtttttatgaggttagatttcctttattttaggtaaaaagagactaaatagtagtgatttaaaaatattacttattgttgtaatgtatgctaacttccaatccaatgggttttcctgcacagatgaaaattttaaaaagaagctcaaagaaaaaagtaaggtttggtgcatttccatcagcctttacattcaccaaaaatactaccttggactgttctttgcatgtgttttaaaacatttctctcaccaaagatgtaaagttgcttcatcaataagccctccatttcttcagagtgtacacaatagagggtggataataaaacaataaggtaaaagattattttgaagattttgtctgattcaacctttccgctctacagtgtataaccgggcacacagcattgtggatgtaagaaaacattttccctgcagtctaggtgattcagggtcagaggagaaaataacttttatagtacgaaaactcacgattttaaaggtttaccagagttgaaagataattttgaaatttgcttttgcttttcaatgttttgaagtccactatttgtctgggatctattagaagctcctttgaacatattctgttgttacaacagagattgaatccagctgattcatggagcctgaatatttaatgcaacattaaggtaaatcctgccaggcatggtgggaggatcacttttgaggccaggggttcaagaccagcctgggcaacatagtgagatcctgtctctacaaaaaaaaaatttaaaattagctgagcatggtggtgcatgcctgtagtcccagctactcaggaggctgaggtggaaggatcacttgagccccaggcatctaggagtttgaggctgcagtgagctatgatcttgccattgtagagtttgaggctgcagtgagctatgatcttgccattgtaccacggcctgggcaacactgacaccccatctcttaaaaaaaaaaaaattaactccttaggggctctttcccccagatgttaaattctcaattcctatagaatatatcttaattgaaaatgttacaccaatgctgaatgatgcaccactgttttataacttatcttaagaagactggatgtggtggctcactcctgtaatcccaactcctcaagaggttgaggtgagaggatcactggagcccaggagttcagagctacagtaagctgtgattgtgccatgcactccatctgaatgacagaggaagatgctgtctctaaaaaaaagtattatcttcagtaattttttttttctcagaagcaggcaactttagctgattttttttttcctgtttgaattttttagtttgtgatttcattttggagtgacttttcatttatttatttatttgagacagggtcttgctatgttgcccaggctggtctcaaactcctgagctcaagcagtcctcccaccttggcctcccaaagtgctgggattacaggcatgagccaccacaccaggccctggagtgacttttcatctttaaaatatataagttttttattattcaagtaacatgcttttgtatttgaatatcaaattttaaggagaatcacattcagcttactttggcctttatgtcttgaaatctatcttaaggtagtattggaaatgaagtttatagatgaagcaaagtacttattatccttacgtatggaactacaaccagcttcttagcatgactactcatgtaaatactacaagccatcaggcacttaccgttcattcatgcctctatcttggttataactatcattttctctgcttttgtcattatatataccattcatggctttcacgcactgctttatagattcctgttttagaaacgttatgtttttattactatagcactgaaatttcatcttcagtgttctcatgaagattctcttgttgctttaagagaggatagctagttctcacacacccttgttttctttctagagtggcaactgttcaggtgaggtagaagatgtccatcttttcagatttttccaaaagagaatatgggtgttaaatgtgccctttttaaagaataaatgaaagaaatcattaacatctttaccttaaaatatttcagtctggagagtaagtaacttcttatcactgtcacacatgtgaactgaactgacttctgatttgatgttattttcagacatcgaagtacaaaaaatgaaaaaagctgtggagtccttgatggcagcaaatgaagaaaaggtatccagatgaaatttaaatatatgtgtggatgttttttaacaccattttgaccattccatgcaatttcatgagctatgccgttttaaaagaatatgcccacaacactgctaggagtgaggggcaggtgtgcacactcccaggtgggctgtatgcacaggaatagggaggagctgcactggctccactgagaactcctgcccccatgaattcagaaaatgttcaaactctctgatcagttccgcatattcacgtgacatgtaagagagaggatacattccatagtacctcctgtatgtgggcactgaaaattctgggctaacttttgggccctgaaggagctagcttgacagcctcagcttcatggtcatgttggttttgtcctccatttactcattatttcctttacactcctggcctgtttcacatgtgtgattgtctctgctctcctgagagattaaataccagaaaacagcggcacgggctttacgttagctacactggctgcattccaaggtttccacaggtttcctcccccccagttggttcttgttatccacatgtgatgtttcgtcctgctaagggcagggatgcagttactgcacgaaagcaatgggtttcttcgtggcttacctgaccacgtatctagcaggcagccgcagctgtgttcagctgatgtcatcagaacttctctccccttatctgcctgaatgaatagaaccagaggacattttcctaaaaagaagagtcatttcaaggaagtaaaaaacaacaaaaagtcaaagaactttagcttgatctttttctcccatcgtaagtttctttctctcattcttgactcttctgtttttcttatctccttgtttatttttgcctcgcattctctttatttgctctttattgcctggaagtaaactgattgtcatgtctactcatataggttcctttttgctaatgtttcccactattgaataaaaaaaaagtaattagcaagctgcccactgtaacttttatttttttttaaatcactgaaattcattttgttttcatttctgtccctcaaaaagccacagcaaacaaaattcccagtgttgaatgagggcttatgagatgctcaaactgttagaggggcacccagcataacataacttcctcgtggggtcggggattcagaagacttcaaagaggacataatttgagcaaattctggggaagagcaagagttgttcatcaggaaaataaaggcttcttaggcaaagggtccatgaatcaaaacttgtctcgagaccaggtttgaaacagcgcagtgcatgctgggattgtgctggaacatgaagtgcaggtggagtaggggcgtggggctgaccacagagctaagtcagtgggcaggctacttcatacaccatggtcttgatttagggtcttagcttgtaaaccttaggcagtgacatgattacattgccattttagaaagctaactctggtagcagaatgggagagtgaagacagacaaacagttaagagtcagttaaaataggtgagaaatgaagagggcttgaagtaaggcaatagcagtgaagtgataaggtgggaagagcttttagagaaatttacgggttgacaagatttaagatctctggatttgaaaaacgagagaaaatttctggtttgggcaattgggtgaatggatgaatggatggttctcttaaggagttaaggaaatccaagcacagactcaagtactgaagggaaagaatgagcttaattgtagatatagtctattcaatatgcttatgggacattctaaaggagatttcttacagaaagttggaacataaatctaaattttaagattaatgtagaactatagattagtggggagtgagacccatcaattttaggagaaatgcagagttgtagattggtggggactaagccacagttgatgtgtcagttagcttttgctttgtgacaggccacatttattatttctcatacttctgtgagttggctaggtgattcttctgatctcggctggcttagctgatgtctacagtcagctggtggcttagatgagactgcatgcataatttaggatagtgtcactcacatgtccagtgattgacagcctagtttaggttggccccagctgggaggactagcctcttctccagatggtctcccatcctccagtagactaggctggacttcttcacgtagttcctcagggttccttagagccacaccacagggcagccacaaagggcaaatgttattcaagcctttgcttgaataacatttgctgatatctctttggccaaagccagccacatggccaggcccagaatgagaatgggaggcgctagggaggccattttcataacacagttgagcacatgggaaaagcaaagagggtcatggacagaacctggaagctctagcattttatagtccaagaagataatgggggttatggaagttcaacagctatctggtcaaaggattgagaaataaaaatcgaagaaaagaaagagtggatggataagtgaaaggagaaggaaagagtggggtcagtcaagtgccatatggaggtcaaattagaaaaaggttggggccgggcatggtggctcacgcctgtaatcccagcacttcaggaggccaaggtggacagattacttgagcccaggatttcaagaccagcctgggtgacatggtgaaaccccatctctacaaaaatacaaaaatgagctgggcatagtggtgcatgcgtgtactcccagcaactcaggaggctgaagtgggaggatgacttgagcccaggaggttgaggctgcagtgagccaagattgtaccactacactgcagcctgggtgacagagcgagaccctgtctcaaaaaaaaaaaaagagaaaaaggatgaaaagtgttcattgtttttaatagataggaggtcaccttggtagagtgttttaagaggggagaagccagatggtgattaatgatggctaataaagacagaagatgggggtctttcttttaaggtttgacttagagaggagagttattgaagctgacttttttctttttttgttttgtgtcttattaccttgttttgtttttgtttgtttaaagatggcagctaaaggataggatctctaaatttagaggtactttgcccatatgtttaatgtatgtaggaaacatagtctagttattaccagttctcctaaagcttagaagtattctttaaataaggtaaataattcacatctgcttattcttttttttaaatgctctctcggcagaatcatgcgtattctttatgtaattactattctttatgcaattctttatggaattactattactcttttaagaacataggattaaagattacaatttattttattcctaggatcggaaaatagaagatcttcgacagtgcctgaacaggtacaagaaaatgcaagacacggtggtactggcccaaggtaaaaaaggtagagtgtagctctaaaagtttttctacttggttgactctaagtggctataaacttacacatttggcctcaatttctttcctggatcatacccattgtcccaaattaggtagctaattcgttaattgaacaattaggcaactgtactctgccagaaagtgtccagcctgaggagtgagtgtactgtagagtcattggtcggggagtgcctctctaaggagttgatgagatagcattccagagagagaaaaacgacagtatatgcagagagcctagggggaaaagaatatggcatgcttaagaagaagaacaccagtgcaactgcaaggtggtgggcagtggggagaggggatgagatgagaccataatgatgagcaacctctggtagcgcaaggggtggagttaagctcttgctcaagtgcagagggactcactgaagggttttaaaagtcagcagtggtcaggcgtggtggcctacggctgtaatcccagcactttgggaggccaaggtgggtggatcacccaaggtcaggagttagagaccagcctgaccaacatggtgataccacgtctctactaaatacaaaaaaattagctgggcatgggggcaggcacctgtagtcccagctactcaggaggctgaggcaggagaatcgcctgaacccgggaagcggaggttgcagggagccgagattgcgccattgcactccagcctaggcggcagagtgagactcagtctcaaaaaaaaagtcagcagcatgacctttgtaacacgtgggccatggagggaagtgagcagtattgagagccgcagaaaccaattcagagatttgcagtattccaagtgaaaaaatctagtagttgctgattgggaatatgttatggttggattgacacagtggtgtaatgagatagaggaggagagtgaagaagggggaggaaatcaagaaagacgtttccaactaaagcaactgggtagatgatggttccattgactgatatggggaagcctagagaaggaacattgggctgggtaagggggattgagttcagctttgaacatggtgagttcagaaaaaccctgtaagacaggtacataaagagagttgtgcattttgttgtgtttattattattttatctgcagatgggccaattggccatcctcaaatgtggaggaaatttgaaagtgctcttgttttttagcaatgcataaatagagttatttgctcgcaacgtaagcactggatataaacaattcttttggaaggtccccatgaaacactcagattttgaagttttaattttgatgagttcacagagaaggaaaatcctgctttggatcaggatttttgaaaaaaaaaattttgtacacaaggtctggcataatcgattttataaatatctgagtgagcaaatgaacctctaataatcagtgttgactagcaattctcatcactcagcattttccatgccttcagaagaagagtctctatcctatggaatattgcaaatttgtaagtgattaatttttacatatgcctggcatttaaaatgttgtttgattttatagaatttcaactgtccaattcttacgtttaaaaccaaggcagaaaaaattaattcctgtaattagactatatcgtaaaacatttggaaaataaagaaaagagataaaaatcactcgtaattgcactggcatgatcactattggcatttttgtgtattgtttatttctagctttttttcctgtgcatacaaacgtgtaaatacaagaggtagtttttaacaatgtacagcagcacagattttcttaaacccttgaaaactatgttctgttccaataaagagttgtataaacagtgatttctcactaggagttatatttagttaatcctcatacaattctaataacactaaattctaatagaattagaataacattctagtgaaacctaaattaagaagctgtggtctgattaagatctttaaacaagtgtatgatttaccatgtcatattatttgtagattagcgtgttaagtatcatttttttctgtttttaaaaaagaatatctggcactgcgctgttcaccatttaatcccttttgatttctagagatgtaaaaaaaaattctcaagtttgcagctttggtgaatatgtggttggttttttccatcagacattttttgctttaaaatggcataaaaggatcctcttgagagatcaaagatcatctgtctttttgttttttctgttctcctatgttttttcaagagcacagcagtgatgaaaactaagttgtttaaatgggactttgttgctattcacaattcgttttttgtaccaggtattcttcagtttgaatatttctacactaaaatttgtaagcccctgattttaaaacaaagttacaagagagttgttggaaaaagttaacttttaattttctttcaatctgatgagtcaatgtatcgagtatgactttgtctgttaatatcacaggtagccattgtggcccaagagcccttggccttagtttcaaatgctgtttcctaggtcctatgttgttgtttttcaagggctgccaggagaagctgactctgatttttgaggatcagaaaaaattttatattcgttataattgggattcttatcttcttgtaaaagtgaaatataaatcaaaagctgctgttgtcttctctttgttttatcttttcctaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagaggtattaatagactttcagtatttcctttatgttgaagagactgtgttattgaaaagttaaaacactgctcataacatgaaaaacatgggttcctttctcagttccatcaccaactcaagtgaggttatataaataaattgactttggccacttctgatggtgactctgaaagataattgaataaaattttcttctgacttctttagacttggaagaagcaactggagaggagtaaacagttatacactccttactttgcatcaaactggcaggaaaatctgtttgctgtctattgtacaccacaccgaaactttgtggcttcaatgacagcatttcttttgctgatgactctgcactttagcagggttcagcatgagcatctcgtctctgctctacttggcatcagctggagtggcgtgaaggcctgggcctgagtcatctgaaggctaactcactcatatgtctggtggttgaggctggcctttggctgggacctcagctgaggccccatttagaacaactacatgtgaccgcttggcttcctcacaatcctaagggtgagcattccaagaggcccgggcaactttgcatcgcctgttatgatttatctcagaaatcacatggcatctcttctgctgtagccacaggcctgcagcccacccagatacaaggagaggaaacatagaccctacctcttgatgaacaactgacaacattacattgttaggacacgtgggatgggaaatattggtgcaaccatatttggaaaatataatctaccctctggctacaccgctttacatccctctcccatgcaaaatacactcgccccctttccgaagacccctaagtcccattccagtgaggcgtcagcatcccaggatcttgtcacccagaccaggtcgagatgtgggtgaagctcctcaggtacagttccttgcgcatagcttcttgaggactctttcattgaattaaagagctgtggatttcaaggacagttatctgccctccacacacccatacgatggttggataggcataatgtaactgcagtagccactcccattaaaaagggggagctggaaggctcacaggtgtcaccagtccatagcaattccaaaatccagccaggcacatgttgccaatcctctgggctattggctcttccctctaagtcatgcttcctttgcctatatttgcagatgagtagttttctcagttttgtgcctgcagaagtgcccaaagatatccaaattcatctcttcattttccattatctctgttcctttgagtctaatttagtgtaatactttaaacatttagaatttcatacgaatcatgttataattcactgcattacagaagaacacatccacagctatcttcaccataagcctatctctagctaagtttccctgtaaggctgcagtgggacatcccattatttttagagcctttcatcatttttcagaggttcaatgagaccgcactactgtaatcttcctaaggtatttttttttctatttttatttgattctagtctagtccatcctgaggtcttagcaaagggttttacagccacatccttggctcacctgaagaccatgttttcctgatagcccttgtgcttgatctttgccctgaaaccatttcttaattttagtgtaatttttttttgtctagaaagaccgggaatgggaaatagtttcattgtttaaacaatcttggcttccttattttagcagttccttttttggtcatttctcttctcacattttactataggtagtgagaagaaaccaagtggcatttttacttttatatctgttgctgataattacacaataagaagatgaaatttgaatggaatgaaaatgaattcaagaagaaaacattgaaaatttctcacttaaatgtaggagagggctgaaatatttcattaatcaaggaattagttaaggaataagaaatactttggtggaaaatatcccctaattgttagatatatatttatatcgaaagcaaaaataatatttgacagtcaacgagtgtgctgcagttacagaactagtgttacatgtagggtatatccaaataatcccatatccttttagaaaaagtctttgctatgtgaattgtagttttaagtttgtaacaagaatggtttgatgagggttgagggagttcagcgacatttttaaagaaaagccaggagggagatctgagtttggagttaaagtcttaaagtttgaaaaagatcaagaaaattgatctgttagtatagttatattttccccatgattaggaatctcaagagacaaatgaacttcaggaaacagtgatgatggctaaataagttgcccaggattcatcataaagattcaaactgaaaagattgatagttaaataatctgctactttataataattcgacttcacattttataaccttttattgtgttaaaggatgagaccaccactgaataacataaacaaaaatcacaaagctgaatgtattgcttacttaagtaagtgagtgttcccggtccagtacattctcttctagctgatcatatgtagggtttttgagatggttggagctcaagggttggtggactttctgaggcaagtgagagtcgacatccactgtagatgtgtggttactaaggtgagactgttgctgactggttggcgtgtagaagggtgttcactggtgtgagtctttatcaggcagctttcagaggtgaagaactgtcactggttgactggcaggagttcattgtggcaaactttgttcatttttttttttactgaaatatttttcatttattcatttatgatgtggcctgcaatctaactgctctacagttgtaaaaaattattgaaaaccgaagtattaaaattatttcacagactccttccttaggatgcacaaagcatttgtttgagaaaatgtgttatgcattttatatgttgctgtaatattattattatcattaagcaaagtgttttaagtggtagccacaaagtccattgtaattggttttaattacacttttcatcaattatgttaattgaaattagtcaactagtacacacatagaataataattaactggcttgaccaatgttccatataagattagtagtagaaattaaagtaaaaatggagcttttcgctgggcacagtggctcatgcctgtaatcccactttgggaggctgaggcaggaggactgctcgagcacagagttccagattagcctgggcaacatagggaaaccgtgtttctacaaaaaaattttaaacattagccagctgtggtggcgcacgcctgtagtcccaactacttgatagggctaagttgggaggatcactttagcccagaagttcaaggctgcagtgagccatgatcgcagcactgtactttagtgtggatgacaaagtgagaccctgtctcaaaaaaaataataataataataataataataataataataataatagagtgttgaaagcaaaacgtgttacccaaatcttacaataaatcattgcaacctgcaggggtaggcattgtcattcttattttacagagggtgaaactgatggatgcctagcgaagttatttgctaagatcaccgatcacttaggcaagtgtgtcagaaccaacatttcatccagggcttaaggttgttaggatttattattactagctgggtacagtggcacacgtctataaccttagctactcaggaggctacggcaggagactgcttgagccgaggagttcaagaccattctgggcaacatagcaagacgccgtctcaaaaaaaagaaaaaaaaattactattaacttacttaatggtataccgtcttattcacaatattcagtgtcttattcagaaccaagttaaaaagtttccttcctccagaatgatttccttgattagtactccttctatatagatgtttatattctgaaatcattttatacagttctgaacactgattatgagattttgtcaatagaccgtttaattttcttatgtttatttaaattactctgtggcttgtgttttgttttgattgattgattgattttttgtaattacattacagttccatactaccatcttgcaagtttccatcccttcattattgccagcaactgtaagcatggaaacttctgaaaaatcaaagttgactcctaagccagagacttcatttgaagaaaagtatgtcatttattaacagtgcaatataaatgttcaaaaaagtagatcagccaaagacaaggatgtattgcatttatttacagacacaatttttacctagagaagcaagaaactgcaagatgtccactgggggatctgtaatcagttctgtattatggaaataaaaggtgtgaagcaggaaataataagagatcaggctggggaggtagggttgtcaggttagaaagagattttaaggaacttggccaagtgtggtggctcacgcctgtaatctcagcactttggaaggccaaggtgggcagatcacttgaggccaggagtttgagaccagcctggccaacatggcgaaatcccgtctttactgaaaatacaaaaattagctgagtatggtggcacacgcctgtaatcccagctactcagaggctgaggcacaggaatcacataagcccaggaagcggaggctgaagtgagccgagatcacatcactctactccagcctgggtgacagagcgagactctgtctcaaaaagaaaaaaaaaaaagtttagggaacttggatttttatatccgaggtcataggtaactgtcaaaggattgtaaactaaatagtcacagtcacgggctgtaagtgtgtttgaaggatgggtctgaaggggacaggaaaaggatacagtagtttgtctctaagaaaatagaatgttttgccaacatattcccagattgtctagtcttattttaggccaaataaaataggacatttaaaaaaatagaaatagcttcctttgcataattttttgtttttgacttatctgttcacttagaacatatatggtcttttattcgtgaagttaataaataccttttgttctttacattttagtgatggaaacataatccttggtgccactgttgatacccaactgtgtgataaacttttgtaagttacattttattgaatgtgaaaaatgtgattgaggctagagaaagagagttctgttatactaacaattactaatattaacagcaaatgaccgaggctgttaaattactgaataaatcaatgtagctataataattgggtgggggtgaaggtggggagctgtaagtttacaaagaaataatttctgatttgctattatctcatgccagggttttgcagatctcatgccggggttttgcaggtctctagccttgcttcatcagttttcatttgaagttcaatgcttttaattcatttttgcactgacatattttgagtccagtgggaaggcatcacagggaatgatgtgatgcttggaaagctgagatgggtttttttgcactttcagttttatgaactgacctaatatctgtgtttatccaagttaaagtctggattaaattaggaaagtctattttcagagcagtactcaaaaatgagatcttttcttttctcactattatcttttactttatttggtagttgatacttctggcaatacacctaaatacagaagaaatgccttttgaaagtttgtaaatgtgcatatttatattattctgtttcgtagaggcaaatacattacttctctgtcactctctctaaactggtcacatatctctaccttcaagtttttagtaacaccagctctatataattgaatattaattatgtgaaagagaaagtctctggatgtttatagtgtctctttgccttcactaggatagcaaatgaattattatgggcagcattagggattcctctactatgctttaattagaactataaaatgaattgctttgccagactcagaaatgtgattcccttgtgaattgaaaagtgaaacttccattctttattttaattagaaggattagatataaatagtacgtgagtatttttaaagttcctagtacatgcagaggatgcagcactagtccatggaaaacactgctttattttcgaatattgacatcacaaggctagtcctaagtgcttttccagctcttctaacatgtgcagaacagttagaattattggcaggacagttaatcacccctgcttttaaaagaactaaatgttgtcatttagtgaagcacataagtgactgcctgattccagattttcttttattgccaggattcaacccacacgcaattttagtttctttccaagatgttttacttagaaacagtggcactggagccacttattattaattgttattactgttatttttagaacttcaagtctgcagaagtccagcagcctgggcaatctgaagaaagagacatctgatggggtgggttctgtgttttttggttttttttgtctgttatcctgagaaaaaactatttagggatcttcatcttttccctttttgcaaataaaactcttatgaagagcttgtggtttttagtggaaaattattagatgttaggtttaacagtaaatattaagaagtatgaatatgaaggattgaaaatagtatgtaaaaccaaaaatggagactttaataaaacattttggaaaataaacaatactaagattttgtagcttagaagtagatataaaattattttaacttatggagttgtatgtgacaaattcagaattatacaaaggatttccctaacaaccttaaatattgttattgctttgaacaggaaaaggaaactattcagaagacttcagaggtaactttttgtccaaattacaatgcaaaaatatttctacttccattacatgtaaattgcttaaatgtctccagtagataaaaactttcagaacctctagaacattatgctaaatgaagccagacacaaagttcacatattatatgattccgtttatgtgaaacatccagaacagataaatctatagaaatagaatgcagaccagtggtaagaggtgggaaaaatggggagaagctgtttaagggtaaggggttttgctttcgaatgatggaaatgttttggaagcaggtagaggtggtggttgcacaacatcgtaacatactaaatgccactgaattgtgcactttaaaattgttaattttgttatgaatttcacttcaataagttattaaaaaacaaaaccatagtctctcagtcatgctacttaatgttcctaatgaccataactgagcttccttagacctccccaaaagcccttcttagattaccattagattatacacccggtgcccatctaaagcaaacattttggtatgtttaaagatgtcgtcaacatgtgctcaattcttctttcccctgattttttttttttttttttttttttgaaatggtatcactttgtcgtccaggctggagtgcagtggtgcaattataactcactgtagcctcgatttcctgggctcaggtgattttcccacttcagcctttcaagtagctgggattacaggcgtgcaccaccatactcggctgtttttttttttcgtttgtttttttttttattttttattttttaagtacagatgagatcttgtcatgttgcctaggctgatcttgaactcctgagctcaagtaatcctcccacctctgcctttcaaagtactgggattacaggcatgagccactgtgcctgttctgtcctctgattttctgtcattaaccttgtgaagattacagcctgataggctacctccagatccagtctcttgactgttggctcttagtgcctgagtcatatgtggatagaattgacaaagcagccagtggtgacagctataattaaaatccttgttgtcttttcagttcaataaatggttaaatgattttgacgtcattgttgagccatggatgataatatcactaaattgtgccatctgtaaacttttggtttctatgagctgtagatatatagagtaaaataaccacctaaaatacctatatcccctcacccttttctctgcttctgtaaaaaaagaagcagagggcaagaattatttctacttctgcaaaaaaaagaagcagagggaaagaatagagaaatgaaaacaagaagacaaaagtatctttgtataaaggacacccacttcaataaatggtgctgggaaaattagatatccatatgtagaagaatgaaattggacttcacctgtcaccaaatcaacaaaaatcgactcaagatggattaagaacttacatataagaccagaaactataaaactgctagatgaaaacataggggaaacacttcatgacattgatctaggcaaagcatctttgtataaatactaaaataatatactgtgttacagctggctctaattgcccattcaaagaaccaaaaagctcaaaataaagttgctcactgtgccttcattttcttattctttgaggagaatatttaaaataactggaatagaatctccttatactgctggtatagaagtttgaactaatgcctgctttgtagaataattaatattatattaggcttctattgacaaagttataatataagaatatgaactgtattatagctaaatccgtgacataattgttagaaaagtcagaaatctgctgctattattctggttatgtaatgtctccatgtcttttgaggaatgaggcaaacaaaatttaagaatttttgtatcctaaatatttaaagccctagacatatcgattctagattagtgatgaacatgttttccttgttgcttttgttgttgtttcttaagtagctttcagaattgattttttttcaacttctgataaggcatttgacattggtgatcaatgtattagttcagttattcttttgaataaactcatggatgtggcgtgagtgagtatttgctgttagcctggcatgtgctgaggatgctgcacctgagagctgtttcactattcttatttgcctctcaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttaggtacgtatgaccaaaatgcctttgccctaattcttccacaaggaggaaaagagcagtgtcttcccttcccttactctttcattcattgattcatttctctttctcagaaacgaaggtgaatgacttaggggaatttagcaaaaaatgcctccgtggatttaatttagtgttgtgaagatatatagactctcaccctgctctctcctgtggtataaacttagcggaaagacctaaaatcatgattccctttgacttcatcatggagtttcccatctgttgtgatagtggataaattaacattgacgttgagcctgtgtgtaacatcagaagcactgtgtgccgcatgcctctcctccacggtgtgtatttggcgaggaggagtctgatctgcatttcattttgtcatctctgtgttctctccattgggctgcgtgtgattgtgtgcgttgttgggatatctgaagatcgtaaacgaagtgccagtgcacccaccctaggtattgtacccctgcatgccagccttcaccagcactgtgctccaaaccaatctaatccctgctcttggcatctgtgatctctagaaagcgatctgacagcaatcagaaaatgtagttctctattccggagtgttctttccaccttctgctaaaaaggactctgtagaggctttgcttccaagcctaaatgctgttttaaccaatactagtaacactcactgtgtgaatagctttgagaggacctagacgtgtgcagcatccctcagagtgcagggcaggaatgtcctggcattgtacattgcagctctttcagccttgaagtgcatattaccacacactaactcccaggtccttgcagtccgttctccatgcttacatttcccccagcctccaaaaagaaatttttttggccatatagggaggtttatagaagacattgaatattatagttttaggcttacttctcttaggggaacattcttctgacgttttattactttgaagatggagataatatttagtgatgacagaagcaactttacttgatatctgaggcgttaccccccaaagtgattttagaagaggggcagctcagttttcctctttgtaaggcaggggacaaatggggaaaaaagttctcaaaataaaaaagagaaatatggtagttttaagatgaggataagctaggcagcattttcaggggcacctgtagccatcgtggttgaaggatttgaattgggaaagttcctttgggtttttccaaaaggtgctgttaccttgtatagatatccacctatctattcacatggaccagcaaacgggacttctctctctatcgatataaatgtctagaatgaacactggatgcataaaataaactgatctgttcagacaactattttcaaatagtttttttttgcatctttcttagaagaactgttttgttaatgctaagaggtaaatgctgcttattataacctataatcacagctctgctttgtagaaaaatcaactttctgcaactcatagatcttgctgaaacactgttcttgtgattttagtacaacttttactttcttttataaagtataaaatctcacactgaagacaacagtagcccttgtgtttgctagtatgggattgtccactaagggacagctaaaagaactgaaatagttaatgcttggagatctgagagtggcaactgtggatgtgattcttttaaggtaaaatcaacaggcacttactttatgtcaaaagaaaaattaggcatatccagttcattcttctctcagtgcctaggatttaatagattggaatacatttcaaaaataaagaattgcttgaactgggtaactgatttgatgtaaatgccaaaggagaaggagtaaaaggaaaatgacatagagtctgagctagagtaacagggacagtattaattaatattaaccaaatatcaaataagaacatttaagagacgaggccaggcgtggtggctcacgcctgtaatctcagcactttgggaggccgaggtgggtggatcacgaggtcaggagttcaagaccagcctggccaagatggtgaaaccctgtctctactaaaaatacaaaaattagccaggtgtggtggcgggtgcctgtaatcccagctacctgggacactgaggcagagaattgcttgaacccagtaggcggaggttgcagtaagccgagatcatgtcactgcactccagcctgggaaacagagtgagactctgtctcaaaaaaaaaaaaaaaacatttaagagagaaaaagactctcggggaaattggatgagtttgtgaagtcccagatgtcccgacacactgaattgggaatatcacaggcatttagatacagagcctagagagagagattaggcccagagattctgatcctctagagggcatttagaatataatcttaaagtggcatgggggaagaaaaaaaagcaggggtgctacagcaaagacactatcagatgacagatgtaggagagtggtcatgtcaagaagcaaaaggagatgattttgaaggatgtagcaggtaatcaacagtaccacgtgctatggaaagattgggaataattccattatgaattgaaatcactcaaggaaagaatgtggcaatcctatcacactcttttaatctccaaagggcttgtaattttattaagtttacacacagtaaactatggagcagaacgtatatgtgtgttccatttctaatatttacaaggtgctctttgtaaatcactgattatagaccaacagaagaattcttaacagttctagaaccaagaagattaacatcatgtttattccatattttaaaattcattgtctgcattctgctcttggagtagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaagtaagtaaagcagtaaacaagtggaatgggccctgtcttacatgttgcttaaaagtggctggacatgggtatggactttgtaaggcctttgtattcctcttatggaaggaagtttggattgtgatgtgggatttattaactcattgggtcttagttaaagtttaaatttaaatgtctatgttaacaacacaaagaggattagttccagtaggtgcactagttaaaaatgttctgattaacaagtctaaggcctcctcaggtctaatactggccatgtgtgttgtcttctttagacttaggagaagtcaatcaactacattcaacccagatgacatgtctgagcctgaattcaaaagaggagggacaagggcaaccgcggggccccgattaggttggtctcgagacttgggacagtctaacaggtaagaagagccaactgatagacttttgcatctctaccaagcatcatagcctcatgagtcctgcagtattagtactgtcattgggttaaacaaagtcattgcttaatgctgtgcctaatgaaaggggccatcatctttagagccgtgcaatttgtcaatggttgatgaacaaacagaaggtgagggctgtgcgaactaggggagaggccagagctaaagtgtcagcagcatctgtgttagaatggctctcagacttaaattttacgtagatggtaattacaagtactctaaagcataactttggaaagatgggatagcatagtggttaagagtatgttctagaatcagaccacttggatttgctttctggccttaccactttctaccagctgggtgaccttgagcaacagcttccacaccctgtgcctcagtctcctcatcatcataattagtacctaccccaaaagctgaccatgaaggttaaataagttaatatgtgttaaatatttggcagataataactactcaagaaacattagcatgtaacagaatctatgaaagcacttaaagacaaaaatgctatcagaatccttgtatttatcaggactatataatattttatccattaagattctaagaactgctctgacactcttaaccaaagtttagggctggcttagaactactacattgactcactgtgcataagagggtggggttggcaaacataaagtacaagacattgataccaaatcttttaacagtataatagactgactagaaaccctttacatatagcccctcccatacaggtggaacactggacataggttacatcaaggaggaaactctctttggccttcttcaaataccaaacagtttcatttgccatatgttgtctttgaacacagtagagctccttgtactatttaaaaaaaaccattcatcttcccctccgcaccctgcccccaccccggaacaagaacactatttgtgtatctaagtaaaagaaaacaggaattttgctttgattgtttcctacactcagtgacaacatattgccctcttctcattggttaccatatggaaagaaaccataattctgctaaagttagttcaaattagacttaagtttctttcagtccaactgagtttcctgtttgggaatccaatcttcaaacaacattggttaaaactgatacagtgacttgtgtttgtccaatttggtctttttctgtagcacttgttcttgctctatcacgttaaatcttttgtggtttcatttgaaatgaagacagtggtcttagaagataactttcaaccagttgttcctccaatgtatactaaaaattaagcttttcatggtcaaatgtgtatcaccagggaatttccatgtctattgaatgtatagttgtttaaaactaatgataagccacaggattggctttggattatttttcatgcaattactcattttcctgtagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggtgactgcttctctgttttgttcacacaatggatactgagaagaaaacagtatgaatgtagggttgttttatagtccagaaagggccatgagtgaagccagtaaaaactctgtaaacaaaagtttgggttttcaattgcttcatgcttcttttttctggtggtcttgggaggacctggtcttgatgattccttatggaacacttaagccattgggcattttaatgaaaaagaattacataagcataattcagttcatatttctcgaaatcattgtttggctttatcattggcctgttttctcagtgtaagatatgcaattaacttcactttgcaaaagaaaaaaaaaaaagcaccctacaatttgtgtctaattatttaacatttcttccaaattatttaatattttgtacaaaataagagtcaaattctttttatgcatgctacagttcctagcttacaaagaaaatgagtcactagggaatgcctaacacacccctaagataattgtggtggtcttggcttttcagggaccttttgttcaacaacactttactagcccaagttgggattgtaattcagtattgaattgggtctttaatgctagcttcattttggagaaatttgcatcctttgccagtggcacccagcctatacagatagaattataaagtcaatgtttattgtttcaggaacttggaatcaagcattcacttcatcgaaagaaactccagctagcactccaagccctgggatctgaagaagaaaccaatcatgggaagctggatttcaactgggtcactagtaagaagtttttattctaacaaaatgaaataattatatacatagttgctttttctttttaatcacaagaacagatgttttgtggcatggtagcaacactggcctctctcttttaggatggttggatgacattggcctccctcaatataagacccagtttgatgaaggacgggttgatggtcgaatgctacattacatgactgttgtaagtgactcactcctggggtttgggggaggaaaactttttttctctgaaaaacacaggaattgagtaagccaaacacagtgttttcagtgattccaccagagtttgaagctgttgcttgaacttgaggagagtggcaggcatatttcccatgaggctgaagttgtagcatttggtgattgtgattgaacaggcttgggataatttgaaaccccaatgtaagctaagtgaagcctaatttaaactaagctctccagaaggttgattttatatgtaatacattcaacaaagtaaacactgaagtgtacactttgaatgggtacattttatggtatgcaaattatatctcataaagattttttttgtattatttcttttgagatggagtctcgctctgtcacccaggctggagtgcaatgacgtgatctcagctcactgtaacctctacctcccaggttcaagccattctcctgcctcagcctcccgagtagctgggattacaggctcacgccaccatacccagctaatttttttgtatttttagtagagacggagtttcgccatgttggccagctggtctcaaactcctgacctcaagcgacctgcctgcctcggcctcccaaagtgctggaattataggcatgagtcaacacgcccagcctaaagatattttttaaatagaatgtagaatttttaagcccaagctatctctaagttatgggtttctatgtgcaatgaccatttggaagaggccacccttttgacctgacatcttcaaggacttgtcttctcctttccactctggacaactgttacctgaaaccctatcacccgtctcacttcagcctagttctgctacagcaggagttactggggttaaaggaggagggaggaaggctagacttctactctggttccttcattattgtacatttctagccctccagccaatgtgtaggactattccctgctttacagcagtgagaaagatggattccaggagaactttgttttaggttccataccactattaatgttctacttaaaattctctttatttatttatttttatttttatttttattttattttattttattttgagacggagtctcgctctgtcgcccaggctggagtgcagtggtgcgatctcggctcactgcaacctccctctcctgggttcatgccattctcctgcctcagcctcccaagtagctgggactacaggcacctgccaccatgcctggctaattttttgtatttttaatagagacggggtttcaccatgttagccaggatggtctcgatctcctgacctcgttatccacccaccttggcctcccaaagtgctgggattacaggcgtgagccaccgagcctggccttgttctacttaaaattcttttatttatttatttattttggagacagagtctcactctgctgcccaggctggagcgcagtggcacaatcttggctcatggcaacctccacctcccaggttcaagtgattctcctgcctcagccacccgagtagctgggattacaggtgcacaccactgctcctggctaatttttgtgtttttggtggagatggagtttcgccatgttggccaggctggtctggaacttctgacctcaggagatccacctgcctcggcctcccaaagtgctgggattacaggcgtgagccactgtgcccggcctaaaattcttttatttaaacagctttttgtgaagtaggctatagacctaactaccctaagtataatctttttcaagtaagtagcaagttttaaacagccaacttaagtaggcatttctcaatgtcaaaaaaatttggagttcagttcatggatttttcttctctgtcattgaacccaagccccttaccttgatgagcacatcacataaacctgcgtgaaataatactaatatgtgtagtatgttgcacatttgctatgtgtcaaacatccttttaagcattttgctcatattaatactggattctcaataacccttttagttaatattactaatattattatagtgtgtataatatatattaaaaagtttttaaaactttttattttaagataattttagatttacagaggagttgccaaagctagaattctgtatacctttcactcagcttcctctaacgttaacatcttacgtaatcatgattacattcatcaaaattaagaaattaacgtagatgttaatacaatcaactaaactgaagactattcacatttcaccagtttttccagtaaggtcctccttctgttccaggatctaatctaggacactacattaaaacacacattttgtgacttacgacttctggggtcaaattttccagggtcatttactcttttatagccatttcacatacgctgcttgtgattttaagcttgaatttgttcacatatatactatataattatgtaatactgtatatacatagtattatacacacatatgtaatactgtagatacatagagtatgtatatatatatatacacacacatacacatatatgcatgtttgtatatatgtgtgtgtgtatccatatacacacacacacacactctgtgtatctatagtattataatactattattatccctacttttttacatgtataaaggaaggaatcgagaggttgggtaacttggtaaccaagtttccacagttagcaatagaaagtcatagagagtttgaactcaggctgtttcaagatccctgcttttaatagctcacgattatgactagaacacattcagtaaatatttgcctccctctctaagtgtgagtatgttccccctgagaatgtgaacaaattcaagcttaaaatcacaagaagcatctgtgaaatggctataaaagagtaaatgaccctggaaaatttgaccccagaaatcctaagtcacaaaatatgtgttttaatgtggattagatcctggaacagaagaaggaccttactggacaaactggtgaaatgtgaataaagtctgcaatttagtcaattgtacattaatttcttagtcttgacgaatgtaatcatgattatgtcagatgttaacattagaggaggctgagtgaaaggtatacagaattctattctatctttggcaactcctccacaaatttaaaattattttaaaataaaaagttttaaaaaaattgggaagaaaatcactcagaaagtctgttttgatataaaataaaactttctttttaaaatccttcgaagtataaagaatttcaaaaataattaacattttaatcacactgtaaacattgtgcattcagatatttttttaagctgacagactagttagatgaaaagagtccagactgaaatgtttggaatgggtgtctcaatcctagattaaaataagtactctttctaacatgtcttaagacactacttttaaggaattactccagaaaaacttcaggaaataatttttgcctggttagtagcctcaaggatttaaactgattaatatttttattaaatatttctgtagtagattacatttttttctttctttcatgagaagtgttttatcagaaaggtgtgtctaaaatggatgctttccttgtttattttctgggtgtgtttggaagtagactgttgcttatcttcatactgctcccaatatcaccttcttctgaaataatttgttttggtgtgtttggtatatttgaaaatattcccaagagccacagactggtgaaaattcttccttgaaggggttgattggtaatatatatatgtgatacttataacttcatttttcttctctccttgactctgaccaaaacctttgcactgattgattatagttgcgccaaaattgttcacaatgtctgctagataaaccataataatctagagctattcaatagcagacaggtccttactaaaaaataatttagaactagagaattattaaggtcagggaatagtataataagagcactgttctgattttccccaaaattatgatgtgccttagttcagaaaacccagccttgctaggagcggtgcctcacgcctgtaatcccagctttttgggcggctgaggccgggggactgcttgagcctaggagtttgagatagcctgggcagtatagtgagatcctatctctccaaaaaaaaaaaagatgaaaaaagaaagccaactcttgatcatgttcaccaatgagcatcattcgctcttcactatctgctgaaaggaaacagagagggcagtttatccaaagcctaagtactttatccaccgataaagttctcaaaactaaagaggaaacaaataaattccctgtttgtagtatgtgcagatcaagtcaaagcagatcaccttttgtagtgacccagcaagtgcttttctaactgtgtttttcagagccctggggttctacagatctcagagcatctggaagagagagaaacaggtggaagtcagcttcattggcaaaaaatactaatctggggtttgggggaagattttgttccaaatgggaaagtgggttctgacaagaccttggggcatattggtttgaggggctcttctccttttactccagttttctgagattccctaagaaagtcctcctgctacaggccagcacagtgagctcctccttttgttcttttttgcaggatgacttactgtctctgaaggttgtaagtgtgctacaccatctcagtatcaaaagggccatccaggtcctgaggatcaataactttgaaccaaactgtctacggaggcggccatctgatgaggtagtgttttaagattgaggtttataagcatgcacttcccaggcatgggactgtccatgtgtcgaaactaagagccatttttcttggagcctgcaggaaaagccttaaaatccagcctcatttacttcttaggctttttctgtattccttccttttctctccatgacggttccccttgtgtaactaaagccaagggttctttttcagttatgcttcttccttttcttgggtgtatttttttttcctgactctaatcaacagagataaatatcactataaagacttccttttctggccaagtatagtggccaatgcctataatcccagcactttgggaggccaaggcagaagaatcacttgagcccaggagatcaagaccagcctgggcaacataggaagaccctgtctctacaaaaataataataaattagccaggcatggtgggtgcacgctggtggtcccagctactcaggaggctgaggtaggaggatccgtctgagcctgggagatggaggctgcagtgagccctgattataccactgcaacgccagcgtgggtaagagaattagaccctgtcttaaaaaaaaaaaagacttcctttcctaaagcaatgctttattagtatataagaaagcttgaaactcaaactatgacagaaattctttaaaagagaatttttccctttctttttgcatttagtgggttgttgagtaactgtactccatggagcagactttttagacagaaaatgcaatttaatatttaggatcctggttgtgtgttcccatagaataccatcgccccatcagaagttcagaagtggactaaccatcgagtgatggagtggctgcgctccgtggacttggcagaatatgcgcccaatctcagaggcagtggtgtccatggtgggctcatggtaaagctctgatttaatttaaaattgacttactttgcttcctttagtctagtcagtaggatattatcaatttttgcttatcataatcctaaagtcatctgactcaaccctcctgccctatttctagtaaacctttactttcagagtatttgtattgatatcttataactctagattgaatttaaagccagttctcttttattgtcctctttcatgttgaataacatgtagctgctttctctcatatgatcatgtttgaaaacccctgcaaggatgcagattgtatttctgcatgttaatgttgcttaaggaggtggctcccacagacagcaccctagagaggcagagcactgatattgggatgcctgaagcctggatttcaggaccagctctatcactcactaacttgggagaaatggagaaaagatatgtaaattaaagatcaaagtccatattgtgtctacctcaccgggctgttgagaggatcattggagataacctaagagaaagctttgcaaattataaagcacaatacaaacatgtatgatttgtggtgacttttgacaagcttttttttttttctttaaacaggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaaggttggttcaggctcatacggtttaataattgcttggcgcaaaggcaacgttttgtcggttacctggttattctgttttctggggtttactaagttttgtgggtgggttccttaccagcagatgcaggaatcctcagcgcttagttgtcttgggagaaagatgttggccaatagacagttgacagatagagagctttattgaagggaaatagggagcaaagagcttattgtaagaataaaaaaaaaagaagaagaagtacaggggctgatcctgcagggaaaacagcagggtcgcagtaacaatgtttatttaaagggacagtacactccaaaaaccaaggcacagcgggctgctgaaagagaatgagcccaagagttctgcattgggtttttatgatgtccagttttttcttgaagctctcaccactgtgttaagtctctgccttttttatctcgttttcccgctcctgccttgagtccttgccttctccctgcctagttcccaacccaggcttgtgggaccctcccttaactatagttggtgcgcatgcgtgggccgggtgttggctgcacttccacctaaaggctgcattgctcattcccgccgccccaggaaggttgtataccagtcaaatctatacgtactgtacctgcgtttctcttaggaattctcctttaccttcttcccctctttatcagcatgcagctagctacattctggcaggtgatctgcagagtgagtgattactgggcgtcttaaggggcgttcctttctgcataggtatttcccctcctctctgctcaaatggagcatgcatgttttgggtggtttctggggtgcgagattttccagacctctcttttctcaggggcttcccctcatgtctagctatctgcccactctaacaagttgaaggaacagttgacccttgaagaacatgagtttgaattacacaggtccactcctactcggatttttttttttcaagcaaatgtggagggatgcaaaccccacatatagggaggcccaactttttaggtacacgggtactgctggacttgagtatgtacggattttggtatacatgggggtcttggaactaatgctctgtgtatactgagggacaactgagtatatatcttttaaaagtataataattaagagaatgcacccagatagctcagtcagtagagcatcagacttttaatctgagggtccaaggttcatgtccctttttgggtgttccctcttaggtgggcatggtgcctcatgcctgtagtcccagtgcattgggaggccaaggcaggaggatcacctgagtccagtagttcaaggctgcaatgagctctgattgagctatgagcatgctactgcactccagcctggacaacagagcaagattctgcctctaaaaaaataataatgaacagcataatattggcttccataatccatgtattggcaatgcagacagcccataacttgggtccaaatattgattgcagttgttctgtttttataaatcaagtacagaagagaggtttctcttgtacagatttagcttctctggcttatgattgaccagcctcgtaaataggaaaatacactttaaaaatgattgaaggtgggccagaagagaatgggtatttcctagtttacctggatttatggatcataccaaattcagattactttttcttctttaaaattaatcctagattaactcttctaaatatgttatcccaaccaacttgatgggttactgggtcctccagaaatttgtgccgaagttctttttaatttttttttaccccctctatctgcctgagtatccagtgaccaacccagtgaccatcatggagtttctcttctaagtatcactgacgtttcctctccaaaaaattcttttagcagtcaccagtcctgttatggaagcagaataggcatacaagataattatagcctcacccaaagaaaaaatatagtgaagtctattctattttgctaatcttagattgaaaaaccttgcaaaattggattcagctgtgagaaatctcattgcattaagtcctgtctaatcaaaactatgaagctaggtgcagtggcttgtgcctgtagtttcagctactccagaggctgaggcaggaggatcccttgagcccaggagtttgaggccagcctgggcaacatagcaagattctgtctctaaaaataatagtaatgatgtaatcaaattattcttgccatattttgtttatcacggtgactattcagctatttggcgtgaataagaagaataaggttaatttcctgagattcataacaagggtcatttatcattgcatcatttatatgcctaggatgcccttttgtttttatccatatttaaacatccagctacttttctctctaccatggggtaaataattaaattatacatataggagggagggggcaacgcaaaaaaaaatcacatgttatcaggccttgattatatgaattttatcaaatcctttggatgtttttgtttgcttttcttttaaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcaggtaaatccaacactgtataactttttgcgagttcttccatcattcagacactaaatgggaactttgtatactgtgtctgatcaaggacattttcttcaaataactaaaaatacagataataatagtgaacacttagagatcacttatatcttccaggtaccatcctaagcacttaatgcatactatgtttatggtaaccttaagacatggagagcattgttattctcattttggagataaggaaactgaggcacagagagctaagtaacttgcccaaggtccccaacctgtctctttggctccaaagcctgtgatatttaccaatattttgccatctctgtattaaaacatgttaggaatggacaggttattctacctagccttttcagattaaagtcgtgggaccgcatatttcccctctaatcaacaatgctttgctactattagcaaaggcattagactagctgtgtcagtaaagtgtctcttctaatttttcacttccagttgcagtggtgaaaggagattatcaccagaagtgttctgttgctcttaccccattcagtgctatttgcattatttcttcttagacttttgttcctcctgctgcactttccctgaaattgtgaaaacacttatgtcatgttatggtttgttatttgcagatggaagattcagaagggacagtgagacagataggtgcattctctgaaggcatcaacaatctgacggtgagtttgtgaaatgaattgaaaatgttattctataaatgtcttttataacaaccccaaaggaccacatgtctcttggagaatgtgtagctctgagctcttggctctcagtgtgactccctgtctccttgttttccagcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttctaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccatttttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctcatttttattgcccttatttcattttccgttgttcatagtaacaggctttgtttctgacatagaaaataacacaatctctttataaactg

SEQ ID NO: 16279 - DNA, 88240 bp, Human
  misc_feature (1)...(88240): n = A,T,C or G
attacaggcatgagccacctcacccagcctagctttttctttaaaaaaaaaaaaaaaaaattgtttattccaaaacaaggccagtattcttgctagcataaatcagttatcaacgtgattgtgcttttatatttaccttctttttttcctctttaatcctccttcccccctacccttcctagcctctggtaacaaccattctactttctatattcatgagatccacatttttagctcctacgtatgaatgaaaatgtgatatttgtctctctatgcttggcttatttcacttaacataatgacctccagttccatccgtgttgccgcaaatgacatgatttcatttttatggctgaatcgtattctgttgtatatatattccacattttcttcatatactcatgtgttaatgggcacttaagttgattccatattttggctgttgtgaatagtgctgcaagaagtggtatataactgaatgactaagaattcaaagcatcattgcttcagttaaatttagcacaaccttacttgtcagatggaaggcattcccaataacagaggccttatactacatcatcaatatggacattacacagggctcaatttactgaactcccctgctaagtacagaggtagaacctcatactctaaagtcgtcagctgagaacttgatacagttgtctgataaattatatcaagaattaagtatgttattttaagggtatgctaaaggaactgtacgccacttaaagggattttctgggacttttttttttttctttgaaacaaccactctgtacaatacaaaagttctgaactctttaaacatatatatttttttctttttctttctttttttttttagacagagtctcgctctgtcgctcaggctggagtgcagtggcgcaatctctgctcactgcaatctccgcctcctggattcaagggattctcctgtgtcagcttcctgagcagctgggactacaggcatgaaccaccacgcctggctaatttttgtatttttagtagagatagggtttccccatgttggccaggctggtcttgaactcctgacctcaggtgacccgcccaccttggcctcccaaagtgttaggattacaggtgtgagcaacggcgcacagccgtatctttcatattttaagttgatatagtgccagtcagtctttaaagaggacagtataaaaatgaaccattcccggctgggcacggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaatcatctgaggtcaggagtttgagaccagcctgaccaacgtggtgagacccccgtctctactaaaaatacaaaaaaaaaattagctgggcatggtggcacatgtttgtagtcccagctactcgtgagggtggggcaggagaatcgcttgaacctgggaggcggaggttgcagtgagctgagatcgcactactgcactccaggctggacaacagggcgagcgagaccctgtctcaaaaaaaaaaaaaaaaaaaagttaactgttctctaatctttcttgtgtgaaatatgagggcagaggttgagatcatgacatgcagataagaatgacaacttcagtgaaggaaatagaggagcaagcggtagacagtagttcactgtgaattctgtccagtctccaggtttcagcagctttgggaagcaggctaaactgttcttggggttcttcaggttaataacaataagcaagggtggagtgcttaatccttttaagtgaatgataaacactgtggaaggcgtgtcttcaagcgccccactccctcagggctgtaggtcacgtgagcttaaagtacttcccgaatcccagccactgtctcttgtaggcagggatcacagtctgaaacgacagcaaggaagaggtaggcagggaaaactaactggaaggaagtttaaatacagaaagagcaaagtattatctaactataacaatgccacattttactgtgactaaggtagaggacccagaggagggggcagcggcttcgatctctcaagagcctagtttagcagacataaaagcccggattcaggattcagatgaaccaggtgagtacgcaacttgggagcttttggaacctataaaatgtttcatgaaagaagtaactaggatatcaaaattcaaaatgccttctttaggacagagaaaagtgttgtggttgaggtgtttttcagttacttatttcactcccctgtgtatctgatagcttctcttacttttctcacacactggattgtttttccccacaatgagttctgtgttcattaccaacaggtgaaactgaatcagtggcaatgtttgaagagttttcaagcaaaaagaaagacacagaagtcaatttatgtggaatttagaattcactttttcctcacagtttagattatatctggaaaagactttaaacccaccgagtggatgacatttaaacttagcagtttacataatattatataaagagggagcatggttcagtagttttgtaccgtggactttgactgtacttgtgatttctcaggttattcagtattttacctcagtttaccagcttaaactataattcaataatgaatggtctaagaattttttaatggcagaacaaaagtacaagagatggtcattgtggtgactagcatagcatcaggttaaaaaaagtatttgatgaatgtgattatccctattattttctttaaatggtaacagttcacacttgctagaggaattgtggttttgaatttttaaacaagcaattaaatctttgttaatattatagtattaaatatagttgtaatttgaagccccttatttttcaagtctgtaaatcgtgagcagcgtctttagttatatgaattaagaataagggaataagctctcaaaattacttttattttattttatttatgtttttggagatggagtctttctctgtcacccaggctggaatgcagtggggtgatctcggcttactgcaacctccgcctctcgagttcaagcgattcttttgcctcagcctcccgagtagctgggattacagatgcctgccaccacgcccggctaatttttgtatttttagtagagacaaggtttcacctttttggccaggctgatctcaaactcctgacctcaagcgatcccccgcttctgcctcccaaagtgctgggattacaggtgtgagccactgcgtccggcctcaaagttacttttaattccgtgattctgtgattctcactttcctttatagcatgtaacacattgcaattccttggtgtcaatagcggttggttatctttttcttaaaaccattcgagaatttttatgaatcttgtttgaagatgcaaacttttaaggaaaatgttccttttgttttttccttctagtgagataatttattaggggaatatcagaaaaaagattttatgtaaactctttgtccgcaaggttattttcattttgctgaataggatgatggaaagtggaaagcaagtttaatctgctttgaacttgaatatgattctctacaactcaacttcagctcaattaggttctgtctcaggcctgtgtgtatttatttatttacttattttttacttaatcccaaatgtgatagtaaggctaatgtgtatttgaagctgcaccttctttgcttatgttttccacccttacagtttaatccctttaggcttttgtctttgctgttgtcttcgttaatttcataagctgcaaacgaagtccatctgtacctcatttcatttgttttttaaatttgctttctccaccacctctactgttttttattatttcatctttactagtcccattatgtttgcagaaatttgctttcttcagattataagagagtgttaaaatcattcaatctgttagcaactacctgtaaaagccataaaaatttgatagtacccaactttgtaatgagtggacattattaggtgtaatttattttcttccatagtaattgcttttaacaaggaagaagtgacagatataatctaaattgagtttaataagcatttttactttggcattttccataacagcccagaaaatacctacttgaataaactattgcttagcaagtgaacaactgctggtagtatattatctaaattgcacttgcctttattataaggttaaattcaagggtaggaaggagggaaatgtatgtcagaacaatctaaaagttatttgtttttttaaacctaggagtaaaatatttttgaagataacatgattttttggagcagttgcttttcatgcaatgagctttatccccttgttctcctaagttaaaaaaaaaaaatcttaaattgatcatggttttttcacaagcacttccaacattggccagttatataaccagtagcatttttcattgttttttcttctgaatttatatggagagaaaaatatgtagtgtcatataaattgaacatatttagaatgtaaatcatcctttaaaatgtgttttttaaatatgagatttatttgaacgggacagatgaggaatttgagataaaatagaagtgtgaatgtagataatctaattttttgaaaaggtacaggtatactttggaaatattgtgggctcagttccagaccactgcaataaaatgagtcacatgaattgttgttttttttgttttgttttgtttttttgagatggtgtctcgctctgtcaccaggctagagtgcagtggcgtgatctctgctcgctgcaacctccacctcctgggactacaggcacatgccaccacacctggctaattttttgtattcttagtagagatggggtttcaccgtgttagccaggatggtctcctgacttcgtgatccgcccgcctcagtctccaaaagtgctgggattacaggcgtaagccactgcgcctggccgtcacatgaatttttgacttcccactgcatataaaaatgatatttatttatactatactgtagtctgttaagtgtgcaatagcattatgtctttaaaaaacagtgtacataccttaatttaaaaattatttttattttttttaaagacaggattttgctatgttactcaggctggactcaaactcttgggctcaagcgatcctcccctcctgcctcagcttcctaagtagcttggactacaggcatgtactaccattcctggctctaaaatatactttattaccaaaaaatgctaatgatcatctgagccttcagtgagtaataatctttttgctggtggaggtggagagtgttggctcaatgttgatggctgctgcagggtgggctgctgaaggttgtggtaactgtggcaatttcttaaaatagaacaacaatgaagtttactgcatgaattgactcttttatgaaagatttctctgtagcatgcaacgttgtttgatagcatattacccacagaacttctttcaaaattggagtcaatcatctcaaaccttgctgcttagtttatggaatattctaaaatcctttgttgccatttcaccagtgttcacagcatcttcatcagcagatttcatgtcaagaaactactttctttgctcaaccataagaagcaactccttatctattcaggttttatcatgaaattgcagcaattcagtcacattttcaggctctgcttctaattctcgtactcttgctatttccaccatatctgcattatttcctccactcaagtcttgaacccctgaaagtcatccatgagggctaggatctacttcttcccaatgttaatgttgatttttttttttttttttttaaggctggtcaagtgaaggagtaggagtgagagaaggaacaaaggaatctgtaactggttatgatcagttagttgtaaataccattgcactcaccagcctaatgttgatatttttactttttcccatgaatcacaaatgttcttaatgccgtctagaatggtgaatcattttcactgtactttgcttagatccatcagaggaatcactatctatggcagctacagccttagaaaatgtagttcataagtaataagacttggaagttgaaataattccttgatccataagctgcagatggatcaaagatgctgttgttgatgttatgctggcaggcatgaaaacaacattgatctctttgtacatctccatcggagctcttgagtgaccagtgcattgttgaagagcagtaatattttgaaagaaatctttttttcctgggcagtaggtttcagcagtgggcttaaaatactcggtaaactagctgggtgcagtggctcacacctgtaatcccagcactttgggaggccgaggtgggtggatcacctgaggtcaggagttcgagaccagcttggccaacataacgaaaccccgtctctactaaatgcaaaaattaactgggcgtggtggcatatgcctgtaaatcccagctacttgtgaggctgagacaggaggatcgcttgaacccaggaggcggaggttgcagtgagctgagatcgggccactgcactccagcctaagcaacagagcaagactacgtctcaaaaaaaaaaaaaaaatcaataaaccatgctgtaaacagattagctgctattcaggctttgttgttccgctgagcataggcagagtagatttagcataaacctttttttttttttttcgtttttaagagacaggagtctcactatgttgcccagccagccttgaactcttgtgctcaagtgattgtcctatctcagcctcctagtagctgagactgcagatgtgcaccattacacctggcttgttgtatagtccttaagggtcttaggattttcagaacagtaaatgagcattgactttaacttaaagtcaccagctgcattagcccctaacaagagaggcaacctgtcctttgaagcgaggcattgtcttgtcctttctagctatgaaggtcctagatggcatcttcttccaacataagactgcttcctctccagtgaaagtgtgttgtttaatgaagccaccttcatcattgatcgtagctcaatcttctggataacttgctatagcttctgtaaaagcacttgctgctttaccttgcatttttatgttttggagatgtcttctttccttaaacctcatgaaccaacttctgttagcttcaaacttttattttgcacccccatcaactctcttggccttcatagaattgaagagagttagggtcttgttctggattaggtttttgcatattggaatgttgtggctggtttgatcttctatccagatcactaaaaccttcttcatatcagcaataaggttgtttagctttcttaacatttatgtgttcactggaatagcacttttaatttccttcaagaactgttcctttgcattcacaacttgctctttagtgcaagagacatagcttttggcctggcggcttttaacatgcctttctcactgagcttaatcatttcaagcttttgattgaaagtgagagatgtccaacatcttttcacttgaaaacttagaggccaatgtgggtttattaactggcctaatttcagtattgttgtgtctcagtgaatagggaggccagaggagagggagagggaaaaggaagcagctggttgatggagtggtcagaacacacacaacatttatggattaagtcttctgtgggcacagttcatggtgccccaaaacaatttcaatagtaacagcaatttcaatagcacagatcatcataaacaagtatagttataatgaaaaagttagaaatattgtaagaattaccaaaatgcgacagacatgaagtgagcacatgctattggaaaaacagcactaaaaagacttgcttgacatagggttgccacagactttaaatttgtaaacaaacaaaaaaccccaaagtatctgtgaagcaccataaagcacagcacaataaaacaaggtatgcctgtatattagaaccctgcttaatttcaaaaccctgggtttcgaagggaaaagcagaaactcggactttccttacgtctttcttgactgttttcttcctacccattctgttttctcagcagcgtgtgctcagaaacagtacttaaccacacactgtattataataatctgtttacttgattctctcccctggtacactgattataaactccttgaggacttcgtcagatcattttcgtatctccaggtcctaaggtaaaaatatggcacataataagcaactcagtgagtaagacatgctccctgccttttttattcaccaaacacatgttcagtataaatatgtcaggtattgtacttacttttttcctaaggctacagaagtataggatgtacgggaggatccccaccaaaggcagcagaatgagagtcagagacttcactttaaatcccagtcctactaattattagtagtgataatttgttattaattattacttgagtgacttttgccaagctgtttaacttctcaaggactactttccttcactgataaaacagagaataacagcacctgctttacagggtggttgtgaggattacatgggattatgtaccatctataaagcacttaatacatatgtgacagcactcaaaaataagaactacttttagtggtctaataagaaaaagaaacagatttggataacagatgatagaataataatattaactggacgggaccctggacaggtatctcagaggaagggacacaattcttgcaggaaggtttagaggcaatgataaaaagaacaatacaaaggaatgagagcagggtatagcacatgggaaataaaagtttagggcagttagcacattgggcatgtggtaaagagataagagatgagggagagaggtagattgaggccatttatggaagtgttattaatttcatcctttctccactctgtgggatagtgggtggttattgcctttttagtgataatctgaggctggtgaataagtgacttgcctcaggccacatggtgagtagcagagccaatgttcaacttataaattctttgtgctctccactataccatgatgccaaatcctagctttttactaataagaagagattactttatatcttaatgtgcctgagccacagattttgatgtgagcattatcgaaactgtgatttttaaaaataggaccaatataacaaagttttactgattattgcatttacttaatcagatatgaatttccattcattcatttatttaaatatttatttccactgcttcacttggctagcctaaaaatatatgtattaaaaaataaaaataaatattatggttagtatttttgtgaaataattgttcgagattttctcccctgctcctcaaatcttatattgcctatggattaggcagatttgaattgataaacttgccttcactggacacagattgccatttagaagattttctctcctttaaaataaggttctaaggaaatttttagaaatggacctatagcacaatagagagaggaacctgtactggtattgaagagcatctccaaacagtaactcacaagtaatacaaatggtaggagagcaaactatgagacaaatttctattaaatgaggtttaaattttattgagaatccacaggatgttagactattaactaaataattgttacccatgaaagcttatgttctaaaaaaggtgatttggctgggcttggtggctcatacctgtaatgccagcactgtgggtggccaaggtgggcagatcacttgagcccaggagttcaacaccagcctggacacgggacacacacacacacacacacacacacacacacacacacacacacacacacttgagcccaggagttcaacaccagcctggacacggggacacacacacacacacacacacactcttgagcccaggagttcaacaccagcctggacacggggacacacacacacacacacacacacacacacacacacacacttgagcccaggagttcaacaccagcctggacacggggacacacacacacacacacacatacacacacacacacacacacacagttgagcccaggagttcaacactagcctggccacggggacacacacatacatacacacacacacacacacacttgagcccaggagttcaacaccagcctggacacggggacacacacacacacacacacacacttgagcccaggagttcaacaccagcctggacacagggacacacacacacacttgagcccaggagttcaacaccagcctggacacggggacacacacacacacacacacacacacttgagcccaggagttcaacaccagcctggacacggggacacacacacacacacacttgagcccaggagttcaacactagcctggacacagggacacacacacacacacacacacacacacacacactagctgggcgtggtgttgtgtgcctgtagtcccagctactcggaaggctgaggtgggaggattgcttgaacccaggaggtggaggctgcagtaatccgttatcatgccactgcactctatcctgggcaacaaagtgagaaagtgagaccctgtctcaaaaaaaaaaaaagattatctctttttattcactaacattaaaatagattgaaatagacaactaaagagcttctctgtgtcaataaaaatcttttctatagtgattgaaaagccttttattttctagtccttttaacaattcatgggaggcttttaccagcctaactaacggaaatttagatctgcacgctttaaaatctcaggatcaaagctttatcctttttttaagttggctctgtgaggcatgttttcctgcctccttccccaacccgcagtatccagccattgtcagaaagactaatacctctctgaaatatcttcccaattctgtttactatatctaagaccttaatataagaatacaaatttgattcctttcagatttttacattttaaaactttgtttagattgtgacccttctttctcatattacaatctcagacactttgatttcttatttgagcactgttatcatcggctttttagaatctctcacttccaaaatttttctagcttagtataccaaccttctgtcaactgtctgctacttttgccccacaagagatacaccagatttcaactgatttaattctataaagataaaaattgctataaaatatgcatattgcttaatttttaaattctatagtcaaagcaatatttaggaatataaaaatatattaagtgtaattttagtgtattataaaatattcaaaagatttttaaatttcgggctgaatttagacatatggcataggttaacaaattgattataagctggtaaatttaaagaatcgagaatttcttgctttggccaggctgaaagaggaaacaattttacccagaaaatgtcatcaacatttcagtaaaaataccaactaccattgttgagcatggtgagtagcagagccagtgttcaaaccaggcactggtttgtggcttatttaatcctcacaacaatcaggacaggtaaccattatcaccatgttaaaaatgaggaaagtgaggtgccaaaaaattaggaagattatttaagtgacagatttggaattcaaaataagggctgtgtagctctaaagccattatttttcgccacaccacgctgtttctactttaaacatatatgtaattatttgtgttttctgaactaggctgctctgttttttcagtagttactagttcttcttaagctctattatcttcatggatttaacaaaattaattgaaagttaactgcttcttctaccgttttgttttggattgcttttttatttcgcatagagtatttacaaatgtagaatattctttcaaatggcactaaaaattgagaaatctgaacttgacttaatccaacaatctggtttggtttttttttttttttttttgtcaggtggacagtgtctggcttccttgctcaggctgaagtgcagtggagtggtctcggctcactgcaacctccgcctcccaggttcaggcaattctcctgtctcagactccagagtagctgggattacagacatgcaccaccatgcccggctaattttcatattcttagtagagacagggtttcaccatgttggccaggctggtcttaaactcctgacctcaagtgatccacccacctcagtctcccaaagtgctgggattacaggcatgagccaccgtgcccaacccttaatccaacagtctttagtagctctccactcctcacatttctaggaagatgcaattatcagcgagatagaaataagagacttaacaattcgcaggagacttgtaccagtctaactaatggaaatttagatctgcatgcttaaagactaagggttagtgatggaaaaaaatgggcatatggagcaagtgaaataattgaattttaatatcactgaaggtaggtaagatatttttaatatattaagaaaaattatatttcattttcatggaaatgaagctgagtaaaaactaaattctttctagagaaaaatactaatataggtagaatatagacatggcaaagattaaatatggtacataaataacaaatgattttaataaattctaaagcctcatatggtaaattagatctcatttattttcctgtattctttccatcaacatgtaaccttttgtgacagaagattctgatggttatattagaaacagtgaacctatagtaaaagccctaaaagttgtctccatcttccccttacttcattgccttcgttcatatttttttcttcatctcaactttcttctcttctgctgtttcctgcctacagtaaaaaaaattacatatacccacattcagtttcattacttcaagaccaagttcatacttatttcctccaagatgactttcctaatcttctactccaactttgattatatcattaattggtattaatgggtggacatggtgactcatgcctataatcccaacactttgagagatggaggctgtagaccaggagtttgagaccagcctgagaacatagtgagacctcatcttcaattttaaaaataaaagaaaaatgtaaaaaacaaagaaaaataattggtatttatcagcagtcaaatattcttgcagtaacactgtaattatattttatctcttcacctgtattgagggtgagacatagtgttttaatatttttctgaaaattacatattttattttttattgtggaaatttcaaattcggaaaagtttagtgaacttcctgttcatgtctgttacctgtaggtattcttctttattttttagatatgctttatatttagggatgtcaatccctttgggaaataaattccaaatgtttttccccatcggtatttttttatcgaggtgcagttgacataaagttaactgtacatctttaaggtgtatattttgttgatgaattttgacatttatatgcccatgaaataattataatgaagatagtgaacattttcgtcacccccagaagtttctttgtgccctttatgccccactcacctaattccttggtccctaggcaaccactgttctctttttctgtcaccaaattagtttgcatttcctagaattttatataaatgtaatcatacagtatgtactccttttggtctgactgcttttatataacaattattttcagagtccatctaatcagtttcctttaattttgacttccattaagatcttccttatttcttaaattttttcttcagaacttaatacttagggcagtagttgaaaacaatgcagtccacagatgtttggactttacagtggcactttaaatttttgacttacatgccaagattttaatgcttttaggattagtctgtaaacaggactgacttttcagagtgagttctgggaaggtggctacttgaatatctcactatccctccattcctgcttccagcctgtatctgtcaatcttgagtgaagtggctcctggatctgatgaacagttggtgcaattgaggccatgggctgtgtgagaactctgtcagggagagttggtacaggacttttcctctagacaagagcctggaaaatctcaggataagcataagaatggcaaatccaggaaagaacttggtttggtagatatccatgaattcctggagggaaggagaaaaggaaagagccatgggtctgagatcttcccatccctgtggctggcatatgtaaggagacctgagagcagggaggcttcctcctgggcctccacaagggctggtggcttgcctgctgcagcactgcctacccacaggggtagagactgctttgcctttccattttcttgagactgctaccgcttgtggtcctccaacaactaaatctcatcccccatgaggtgacaaagataaacaacccatctggggaagccaggcaacctgaaagagaaaaaccacttagaataaacaatatattgagttagctaaatagaaatgctggaggaggctgggcacggtggctcacgcctgtaatcccagcactttggtaggccgaggcgggcggatcacgaggtcaggagatcgagaccatcctggctaacatggggaaaccccatctctactaaaaaaagatacaaaaaattagccgggcgcggtggtgggcgcctgtagtcccagttactcaggaggttgaagcaggagaatcacttgaacccaggaggcagaggttgcagtgagccgagatcgcgccactccctttagcctgggtgacagagcgagactccatctttaaaaaaaaaaaaaaaatgctggaggagagagaaacttgaacatgaaaataataatgggccacatttaagactttatggaacaaaaaatgtgatttttccacctaaataattattatcacctgactccatttatcctcacacacttattttttttaaaactatctctgctagagtgtaagcaccaggagaacaggaacttttttgtcttgtattcactgctaatctgttgtcaactctaatacctagaacactgtcttacacatagtaggcgcccgaaacataattattgaataaaggaatgaatgagtatgaacaattattgacctggaagatcaagtaaaataaatatttcaaagcatggagccaaaaaaaaaatacaaaaaaaaaaaacttttaaaaaagagacctattggatcgattcaggacacctaacatggctaatacaagttccagaagaagaaaaaggaacaaatggagaaggaataattaaacaacataaaattatttcctgagctaaagacttcagtgtgcagaatgaagttctgggggagatcagtgatgaaaaacacatacatagggatatccttgtaaaatttttgagctccaaggattcaccttggaggcttccagatagaacaggttgcacctatcaagtaacagactggaatcagaattctaattcacaacactggaaactaggagatggtagaagagtatttacagattggggatttcacaatcccaaatccctatttcccttgaagatatttctcccctatgaggggaaacatgttacaactatacaaaaatttcaaggatataatacccacttaactcctctgagaaaattcaagaaggggttttagccaaataacaagtgacctagaacagagatcacatgatgaaagggatagaaataatggaaaatgacagactctttgggaatgtattatgtaaatgctaagtaaggtttttaaccaaaggatgcatagttcagagaacaataatatttacaatgtgataagtaagtcagggcagaacctcaaaactgtgggaacaaaaggaagtaacagctttccaattaaggtgaggagaggaaaaagcaccaatatgtacatgaaaagatgctcaacatcattagttattaaagaaatacacatcaaaaccaaaatgaggtacagttttttcacactcactgggatggctataaacaaaaagacagatatcaagtgttggaaaggatgtgaagtattgaaactctcatctgctactagtgacaatgtaaaatagtacaactactttggaaaacaatttgacagtttcttaaaaagttaaacatagaattaccatatgtcccagtaattaagtgtatttccacacaaaaacttgtacaggaatgtttatagcagcattataaataatagctaataaagaagtaacagcccaaatgtcctccagctgacaaatgaatagataaaatgtgatatagccatataatggaatattatttggcaataaaaacaaagtactgattcctgctataacatgtgtgaagcttgaaaatgcaagttaaggaatctagttgcaaaaaaacccaaacacatactgtatgattccattcgtaggaaatgtccagaataggtaaatttatagagacagaagttagattaatggtcgtttagtctggatagggttggggagagtgagatggggattagcctgctgatgggtagagggtttcttttagtggggagacaaaaatgtaaaattagattgtggtgacagctacacaacagtgtgactatattaagaaacactgaacactttgagtgaattatatggtgttgtcttagtatgtttcatgctgctataacaataccacagactgggtaatttataatgaattgaaatttattgactcgtggttctggaggctggaaagtccaagaccaaggtgccagcatctgctgagggccttcttgctgcatcttcccatggcagagggcagagagggtaagagggagtgagagagaaggggaccaaactccctattttgttacaaactctcttgataatgacattaatccattgttgagggtggcttaattacctaatggcctaattacctctaattagtcccccacctcccagtgatgttgcattggggattaagtttccaacagatgcttttgggaggatatattcaaaccatggcaggtctgtagtttatgtttcaaaatgtattttttttaaagaggaactagtgttgataatacacagcagcttgcatgaatctgcaaggcattaggctcaatgaaaaaaaggcagtctcaaaagtttatatatgattccatttatattttctaaattattgaagatcatgacacatttactattcaaagtatacacactaaaaacaatgtttttaaaaaattccagaatacagtatatataataatagtttctagtttaatgtctgggtttaaaactttaggaaatgttatgttcagcctacattaagcagttaacctttgactgtaacatgaaatcaatataggctcttaaaatattggaaatgttcacagtagtctcttagtccccctaattccccttttaactccttagttcctaatttgttgtttaggccaattttctccccttcttgttaagaagatagtctcttatggtcatgtttatttttccaaaaccatctttaaaatgaaaatgtgaaatatgtttccacagtgcatgaaaaataatttggatcatccacaagaccaaagaatgacataatctttttttttttttttttttttttgagacagggtctcccttctcccgtctgtcacccaggctgaagtgcagtgtcatgattatggctcattgcagcctcagcctcctgggctcaagcaatcctctcacctcagcctcccaagtagctgggactatagacatccactactacgccaggctaatttttaatttttttgtagagacaaatctccctgtgttgcccaggctggtcttgaactcctaggcccaagcaatcatcccacctccacctccggaagtgccaagattataggcatgagccactgtgtcacccaggctggagtgcagtggcacaatctcagcttactgcaacctccgcctcctgggttcaagcaattcttttacctcagcctcccgagtagctgggattacaggctcccgccaccacacctggctaatttttgtatttttgtagaaatggggtttcaccatgttggacaggctggtctcaaactcctgacctcaagtgatccacccgcctcggcctcccaaagtgtcaggattgcaggcatgagccaccacacctggctagcccataatcttctttatacataattttcttcagtaatatttgcaacagcctcaagatccatcctcctttgttatttcttagtaagttttttttcttcttttttaactgtgtaggtacagtcctcttgtatcatttatacttttcttgactgaccagtttgtggatttggcccaataaactctctttatattatactttggcctttattaaatctactgtctggtattactctcaccatcttctcagtgttataggctgagaagaaaattacaaccataggttgtataagttataggctgtgaattagaagtataactatcttcatcactgctgagttcttcaacttctagtggatttatctccacatatttggaagaatttcaacacaacttaatctaatgtattcagaacacagtttacctcatttgcattttctttatacaaatctgagctcaaacaaaaagtggtcttaacatttctcttgcttgggacactccactaaatagcactggtttgcttaagagcctctgttaatctaatacttattcttagcatatgtactggattttgaaggacattgttgatgagtacccagtattagtggcagatctgcaggctggtctcgaactcctgacctcaggtgatccgcccaccttggcctcccaaagcactgggattacaggcgtgagccaccacgcccagccttgtctggctgtcttttctttaaaataagtcagatggatcaaagagacgattgctaagtaaattcacatacaatttcttcaggattcatgtgttgtgtgttctgctccataggcatgtttggccctacattttcactactttctaccttaattaccattttcttccttctagtatctagacttgttgggaaaaattggaatgacagcattacagtcatagtgtcaataatttttttccctctgtttccttctctagcattctgagcccttggtctcaggtgctttctctttccattggcttttaggaaagttcatccttctgtcttcagctcttatgttttgatgaggactttgtttctttgtttccatcatcagcctttattaaaactaatcctgaattttggtctcttggtatttgtctttgaaatcacttcaacatgagtcagttaacaaacatgttgaggccgggcctggtggctcacacctgtaatccctgacctcacctgaggtcaggagttcaagaccagcctgaccgacatggtgaaaccctgtctctactaaaaaagacaaaattagccaggtgtggtggtgcatgcctctaatcccagctattcaggaggctgagacaggagaatcgcttgaacctgggaggcggaggttgcagtgagccgagatcgcgccattgcactccagcctggacaacaagagtgaaactccttctcaaaaaaacaaaaatgttgaacattttataaatgttacatgaagctctgtctgtattacatgaagttgtaattgtcacagcaacgttaaaacaaaattcttgtctcaaaatgcttataatgggcagataggacccctgcccctcatgcccccaaacctgctcctctcattcttttttttttttgagacggagtcactctgtctcccaggccagagtgcagtggtgcgtctcagctcactcactgcaatgtctgtctcccaggttcaggcagtcctcgtgcctcagcctcccaagtagctgggactacaggcacacaccaccatgactggctaattaaaaacttttgggtgtgtgtggagacagagtcttctatgttttccagcctggtctgggctcaagtgatcctcttgcctcagcctcccaaagtgctgggattacagacatgagccactgtgcctagccacctcctttcattcttaatcctggcagctgtgttatggctaggggtaggggagtaggggaatctcacagccatgaaaactgataccaccataaattcatcatttccaacaatgttgtactgtcgacactatttagacattctgtgtgattctagttagcttcccttctcaatccttacagagttaaaatgcttaagacctcaatcctccattctcatatagctaaaccttctacttcacagagtaaactgtatttctttatttctaatattcttcttcataagttcttaccagcatctgtgttgacacctatcctttaccaccttccttgttgtcgttcaatattgatccatacacctgtgctctagaacctttcttgcttcctaactcttgtgatttctaatttttttattgactccttcccccttgatatattacaatattcaatctctctgtcactctttccttttctttctcgccgatttttgctcatttagtcttccaaataattctcaaatttgtcccgttctctccatcttcactgctactatcctagtccattgttattttttgtctaacctcctaaagccatccattacagtaattaccagaggaatttttctcatatgtaaatctcatcctattactccctcatttaaaaccccctaatgtctccccatgctgacaaagtctgtactgcttagcaggtacatgtacctacacgatctagaacatcccagcttaatagcttccttgtttattactcttttgtacatactgcacaccagatataatgaatgttcttgaatgtctctgttgctttaacacatttattccatcctcttggagtgttcttcagttacctagcaaacaatcttcatgttaagactgagctcaaataccacttcttccttaatggtccctgtgatcactccaggaaatgtaatgtaatgtacacgctaccatactctatgtctacacctccaatatagtactttagtcacccactgcaatcacttgtcttacccgtatgtgctgtaagccccttaggggtagctgctgtgctctattcatctttatgcatctccagtgcctagcacataatctgacatttatagatgcttagtaaatatttgttgaattaatatgttgattaattaaaagataatacaaggcagcttatacccaacagttgagaaaaggttaaactaaaatataaaggggcttaaatgccaagctgaagtttttcgagttcaccctataagccaatgggtccaaataagtaaaccacaatctatttataaatgtctacaccagtagcctccgctaccaccatcatccccaccatcatcccccagcctgagatttcaaagtaggaacaaaggtagagcttacaaaggcagcccttcccctttgctttgagggactcagattagtaccccacacatgatgtagattacaaataaacaagtgaaaatgatcttcacaaaatgtttggggtctcctggcagtgtcacttggaaagctttcaaagtatttattttgttgtttaagcaatgatgcaaactgataaaggcagaattttaggattattagtatggaggaaaatgtaggattgtttgaagatgggagaattggtggcaattggtctaagctgaaaaggatgagaatctaaatgatggcagtgcaatggaatagattggtgtggaagcatactgaagccacatttaactggatttgatgactaaatattgagactgagggaggaagggggaagaatcaggttggaagtacatgtgctcactgcttctgtgtacccactttctctgtgaatgacaggattcttttcttcttttttatgttaggtatattaaatcctgctattttatctctggaatgtctctcctccatttccccccacccatttttctactttttcatgaactaatcatccttcaagatttagctcagttatccccttgacaacatctcttaccattgctttatttttattttatttatttatttatttatttattttgagacagagtctcactctgtcgcctaggctggagtgcagaggcaccatctcagctcactgcaacctccgcctcccgggttcaagcagttctcctgcctctgcctcccgagtagccaggattgcagatgcccaccaccatgcctagctaatttttgtatttttagtagaaacggggtttcaccatcttggccaggctggtctcaaactcctgaccttgtgatccacctgcctcggcctcccaaagtgctgggattacaggtgtgagcggcctatttttgttctttccttcttgagtcccacagtatttgtacttaaactgtaataattttattgtttcataattgtgtatttttcccctctgaacttcttgagagcaaatggtcactgtttttgatatccatagtgcctagcatgtacctgacatatagtaggcattcagagtcttggttgaattaatattaataactactactgctgtcctagacagttagccttagagatgtttgcacatggacagaccgccgtggtctattaatgagtctgcctgcctgtctctaatatatctagcatttatttctttttgcatttttgtactcatgtttccttgcctaaaatactgctttcatttttagacttctacatagagaatttcagttgttttccatctcctttagactcctctatttgccttccaagattttcctaatatgacccaatcttcccaagcaaatctttccagacatgtgctgtatttattcctcctctgtgattttgagccctccatgatttttaaggttttcaaaaatcctccttcaagttcacactgccttgatcaatgttgcacgtctccctgtggaccctcacactgcttcctgctagtgagatgatccaagaccacagctgaggcctggctttgccatggttccattggctttattggctacaccaccttgggcaaatcatttcagctttctctgagctagtttctttatgaatataggaataattcttcttcacatggttgctgtgcagtttttatgtgatgatagtaggaaattttccctaaattcagtcttttagagactacctttgtaatctttctatttttatggatcatctttgtgtttatttaatttttttcttaaattgagtcactgcttttatggtttccttttaaaaaggaacgttgtcactaaatgaaataccagcatgcttgccataaatagagtataaattaaaaatagatacaataaagcagctaatcttgttagatactgttgccaagcttaggctctgactaagcctgttaaaaaagagattagcaacatttgaagagattttaaagatattctagcacaaacatttttaaaaatgatatttggcaaagtgcttccaactttcagttagctgggttaatggcaggatgaggggagaaggtagaatcagttaaaacttatcaagatgtttagtagaaaatgaacttaataaacatttgtagttaaattttcaaaaatttgattcttatggagttatcagaagtatacaaataacacaagtaaaacagtttggttactaaaattttttttcaaatatcaaagtagaagcatatctacttttctatgtggatgttctttatctcttcttaatttctctaccttcagtcctgactctctgttggattccataaccacatgagctttcctttaccttctctgtgttctgccatgctcttggcaaaaagggatggggcagtcttacctgggtcggcaatgtttgtgaactctgctgcattagcaacgcatcgatatggccatctgtggtcactgtgtagttccatgcaccagatacctactctgactatttgtaattatttcatacatgccttgttgtgatcttgtgccttagataattatcttccctggataattaaaagttatgtatattaccattattcattcttgtacctaaattttaggaacaaccagtatgatatagtagacaaatcagaatccaagttcaagcgagtcttttttgaaatttacactcagtttgccttggatgaaccattgagcctaatcttgctttagctttttaatatttcctatctgtatcacagggttatcatgagaaccaaaagaaatatgtgaaaatattttaaaaactgtaaaatgttactatgtgtaagttactattattaccatcattctttcttagtttcttaagttgaagttgacttttcaactagattatgagctgcttaatgtcaggaaatatcttatgctcactcttgttccccacagcatccaacacagctttaggcatgtttaaaacttatggaattaaattatcattgtttatttgaattggaatcattaataaaattgtactgggaaatgtagtacagacagtccttaacaattactattataaataattgtatcacaacattccaaactgtgtgtttgtttgtttttgagatgaagtttcgctcttgtcacccaggctggagtacaatggcgtgatctcagctcattgcaacctccttctcctgggttcaagcaattctcctgcctcagcctcccgagtagctgggcttacacgcatgtgccaccatgcctggctaattttttgtatttttagtagagatagggtttctctatgttggtcaggctagtcttgaactcccaacttcaggtgatccgcctaccttggcctcccaaagtgctgggattacaggtgtgagccaccgcacccagcctccaaactgtatgttaatgtgtattttgtccacactataaatgtatcaaattttttgatacaagaatagtgactcaaactattattatcacatgactgtatcgttataaatcaatgtgtatatcagtgctaagaattcaaccacattactttgatattttccacagtactattgtactacaaaatgtttagaattccaagaaatatgcccagctacctaaattctaatttgtcgccatgactctttttagcatataattgttattatgtctgttgaggatcattctgtggcttatctcaattttctgtgatatagtattattcctattgcatagatggtaaattaaagctaagaagtattgactcattttcccaaggttacactaataacatgtggtagagctagtatctcacctgagctttacctgcttcccagttctgtgttatcttttcactctgcctcatgtctgcgctctgggatagttgcacagctgtcatagtgggctctgtcttcagcatcatcctggaggttccctttgcctttcctgtaaaatggaacaatcatgatagtacttacagcataggatgagattgctgtaaatgagataatacaggtaaaacgtttaggtgtctatcacatacataccctaataagtgctaactgttgataattctttctattgttgttatgtctactaggagacttttattggtcccaaaattattcatgacacttgtatttattataaatccataatttaaccaaatattacacaaattgatgtaatatgaatagggaaagtagagttgtgtctataaaagctaacgtggattatttagcaggtcattaaacacttatttaaggctgggtgtggtggctcatgcctgtaatcctagcactttgggaggggaagcaaaaggatctcttgaggccacaagttagagaccagcctgggtgatatattttgtctctaccaaataaattagccagttatagtggtgcacaccagtaatcctagctactcaggagactgaggtgggaggattgattgagcccaggagttgaagattacagtaacctaagattatgtcattgaactcaatcatgagcaacagaacaagaccctgtatcttaaaaataaaattaaaaaaaaggtatttagggccaggtgtggtggctcacaactgtaatcccattactttgggaggccaaggtgggtgaatcacgcggtcaagagttcgagatcagcctggccaacatggtgaaaccccctctctactaagaatacaaaaattagcctggcatttttgtatcacattttggatcacaggtggtgagtgcctgtgatcccacctactcaggaggctgaggcaggagaattgcttgaaccagggaggtggagtttgcagtgagccgtgatcacaccactgcactccagcctgggtgacagagcaagactccgtctcaaggtgggggtggaaggaagtatttaaattagcagtggacaagagacctgtaaaagagttgggagtggggcaatgacaaagctttgaaaagaatatagatattgcttcataagtatctttaaaccaaagttggaaatcacagacttatgccttatgggtgtaatttacacaagaaagaaaatgaataaattcaatctgcatagttgtatcgcttttacaaaatgattggtgaattaatatacatttgcaagtttatatacttttatgttgaaatattaatgtgtgagccatttttgtgtgtgtgtgattctctatttcaaccagcttttaaaattacctatcagccctggctgggcatggtggttcacacctctaatcccaacactttggaggctgagacaggaggatcacttgagaacaggagtttgtggccagcctgggcaacatagggagaccttgtctctacaaaaaaacatttttttaattagcaaggtgtgacggcacatgcctgtagtcccagctactgggaaggcttaggccaggggattacttggacctgggaggtttaggctgcagtgaactgagattgtgccattgtactcctgcctaggcctcagagcgagactttgtctcaaaaaaatgaaataggctaggcgcgatggctcatgcctgtaatcccagcactttgggaggccaaggcagacaggtcatctgaggtcgggatttcgagaccagcctagccaacatggcaaaaccccgtctctactaaaaatacaaaaattagctggatgtggcagtgggcacctgtaatctcagctactcgggaggtgaggcaggagaattgcttgaacccaggaggtggaggttgcagagatctgagtttgcaccactgcactccagcctgggcaacagagtgagactctgtctcaaaaataaattaattaattaaataaaataaaaacctatcagtcctgacagcaatagatagaattacttttactacattttactaatttccctgttttacctaattgctgtatccttaaagccatatcagaactcaattaagattttttaaaaaacacgtatcttaaggagtcgcttccaagatggctgaataggaacagctctggtctacagctcccagcaagattgacacagaagatgggtgatttctgcatttccaactgaggtacctggttcatctcattgggactggttggacagtgggtgcagcccacggagggtgagccaaagcagggtggggcattgcttcacccaggaagcacaaggggtcgggggatttccctttcctagccaagggaagccgtgagtgactgtgcttggaggagtggtgcactcctgcccaaatactgcgcttttcccacagtcttcacaaccatcagaccaggagatcccttcccatgcctggctcagcaggtcccacacccacggagccttgctagctgctagcacagcagtctgagattgacctgggacgtgggagcttggtggggcaaggggcgtctgccattggtgaggcttgagtaggcagttctgtgctcacttggagtaaacaaagtggcagggaaccgcgaactgggcagagcacaccacagctcagcaaggcctactgcttctctagattccacctctgggggcagggcatatctgaacaaaaggcagcagacagcttctccagacttaaacgtccctcctggacagctctgaagagagcagtggttctcccagcgtgatgtttgagctctaagaatggacacactgcctcctcaagtggttccctgacccctgtgtagcctgactaggagacatctcccagtaggggccgacagacacctcatacaagcaggttcccctctgagacgaagcttccagaggaaggatcaggcagcaatatttgctgttctgcagcctctgctggtgatacccaggcaaacagggtctggagtggacctccagtaaactccaacagacctgcagctgagtggcctgtctgttagaaggaaaactagcaaacagaaaggaatagcatcaacatcaacaaaaaggacatccacaccaaaaccccatctgtaagtcaccaacatcaaagactaaaggtagataaaaccacaaagatgggaagaaaccagagcagaaaggctaaaaaattccaaaaaccagaatgcctcttcttctccaaagaaacacaactcctcaccagcaagggaacaaaactggatggagaatgagtttgacaggttgacagaagtaggcttcagaaggtcggtaataacaaacttctccgagctaaaggagcatgttctcacccattgcaaggaagctaaaatctttgaaaaaaggtaggacaaatggttaactagaataaccagtgtagagaagagcttaaatgacatgatggatctgaaaaccacagtacaagaacttagtgaagcatacacaagcttcaatagccgattcaatcaagcggaagaaaggatatcagtgatcgaagatcaaattaatgaaataaagtgagaagacaagattagagaaaaaaaagtgaaaagaaatgaacagagcctccaagaaatatgggactatgtgaaaagaccaaatctacgtttgattggtgtacctgaaagtgacagggagaatgaaaccaagttagaaaacactcttcaggatattattcaggagaacatccccaacctagcaaggcaggccaacattcaaattcagtaaatacagagaacaccgcaaagatgctcctcaaaaagagcaaccctaagacacttaattgtcagattcaccaaggttgaaatgaagggaaaaatgttaagcgcagccagagagaaaggtcaggttacccacaaaaggaaacccatcagactaacagtgcatctctcagcagaaaccctacaagccagaagagagtgggagccaacattcaacattctgaaagaaaagaattttcaacccagaatttcatatccagccaaactaagcttcataagtgaaggagaaataaaatcctttacagacaagcaagtgctgagagattttgtcaccaccaagtctgtcttagaagagctcctgaaggaagcactaaacgtggatacgaacaactggtaccagccactgcaacaacataccaaattgtaaagaccatcagtgctatgaagaaactacatcaattaacagatgaaataacaagctagcacataatgacaggatcaaattcacacataacaattattaaccttaaatgtaaatagggtaagtgccccaattaaaagacacagactggcaaattggataaagagtcaagacctatcggtgtgctgtattcaggagacccatctcacgtgcaaagacacacataggctcaaaataaagggatggaggaagatctaccaaggaaatgaaaaacaaaaataaataaataaataaagcagggcttgcaatcctggtctgtttgataaaacagactttaaaccaacaaagatcaaaagagacatttacataatggtaaaggaatcaattcaacaagaagagctaactatcctaaatgtatatgcacccaatacaggagcacccagattcataaagcaagttcttagagacctacaaagagacttagactcccacacagtaacaatgggagactttaacagcccactgtcaatattagatcgacgagacagaaaattaacaaggatatccaggaactgaactcagctctgcaccaagtgaacctaatagatatctacagaactctccaccccaaatcaacggaatatacattcttctcagcaccacatagcacttattctaaaattgaccacgtaattgaaagtaaagcactcctcagcaaatgtaaaagaaacagaaatcacaacaaactgtctctcagaccacagtgcaatcaaattaaaactcaggattaataaactcactcaaaaccacgcaactacatggaaaatgaacaacctgctcctgaatgactactgggtaaataacgaaatgaaggcagaaataaagatgttctttgaaaccgatgagaacaaagacataacgtaccagaatctctgggacacatttaaagaagtgtgtaaagggaaacttgtagcactaaatgcccgcaagagaaagcaggagagatctaaaatcaacaccctaacatcacaattgaaagaactagagaagcaagagcagacaaattcaaaagctagcagaaggcaagaaatagttactaagatcagaacagaactgaaggagatagggacacaaaatcccttaaaaaaatcaatgaatccaggagctggttttttgaaaagatcaacaaaatagactgctagcaagactaataaacaagaaaagagagaagaatcagataggcataataaaaaatgataaaggggatatcaccacctatcccaaagaaatacagactaccatcagagaatactataaacacctctatgtaaataaactagaaaatctagaagaaatggataaattcctggatacatacaccctcccaagactaaacaaggaaaaagttgaatctctgaatagaccaataacaggttctgaaattgaggcaataattaatagcctaccaaccaaaaaaagtccaggaccagaaggattcacagccagattctaccagaggtacaaagaagagctgataccattccttctgaaactattccaattaatagaaaaagagggaatcctccataactcattttatgaggccagcatcatcctgataccaaagtctgacagacacaacaaaaaagaattttagaccaatatccctgatgaacattgatgcaaaaatcctcaataaaatactggcaaaccgaatccagcagcacatcaaaaagcttatccaccatgagcacgtgggcttcgtccctgggatgcaaggctggttcaacatagcaaatcaataaacgtaatccaacatataaacagaaccaatgacaaaaaccacatgattatctcaacagatgcagaaaaggccttcaacaaaattcaacagcctttcatggtaaaaactctgaataaactaggtattgatggaacatatctcaaaataataagagctattcatgtcaaacccacagccagtatcatactgaatgggcaaaaactggaagcattccctttgaaaaccgggacaagacaaggatgccctctctcaccactcctattcaacatagtgttgaaagttctggccagggcagtcaggcaagagaaagcaataagggatattcaaataggaagagaggaagtcaaattgtctctgtttgcagatgacatgattgtgtatttagaaaaccccatcgtctcagcccaaaatctccttaagctgataagcaacttcagcaaagtctcaggatacaaaatcaatgtgcagaaatcacaggcattcctatacaccagtaacagacaaacagagagccaaatcatgagtgaactcccattcacaattactactaagagaataaaatacctaggaatccaacttacaagggatgtgaaggacctcttcaaggagaactacaaaccactgcccaaggaaataagaggggacacaatcaaatggaaaaacattctatgctcatgggtaggaagaatcaatataatgaaaatggccttactgcccaaagtgatttatagatttaatgctatccccatcaagctaccactgactttcttcacagaattgggaaaaaactactttaaagttcatatggaaccaaaaaagagcccgcattgccaaggcaatcctgtgcaagaagaacaaagctggagacatcaagctacccgacttcaaactttgctacgaggctacagtatccaaaacagcatggtactggtaccaaaacagatatatagaccaatggaacagaacggaggcctcagaaataacaccacacatctaccaccatctgatctttgacaaacctgacaaaagcaatggggaaaggaggctacacaaactacacaaacatatacatggtgttgggaaagctggctatccatatgcagaaaactgacactggacccccttacaccttatacaaaaatcaactcaagatggatcaaagacttaaacataagacctaggaccataaaaatcctagaagaaaacctgggcaataccattcaggacacaggcataggcaaagacttcatgtctaaaacaccaaagcaatggcaacaaaagccaacattgacaaatgggatctaattaaactaaagagcttctgcacagcaaaagaaactattaccagagtgaacaggcaacctacagaacgggagaaaatttttgctatctatccatctgacaaagggctaatatccacaatctacaaagaacttaaacaaatttaccagaaaaaagcaaacaaccccatcaaaaaatgggcaaaggatattaacagacacttctcaaaagaagacatttatgcagccaacagacatatgaaaaaatgctcatcatcactggtcatcagagaaatgcaaatcaagaccacagtgagataccatctcacaccagttagaatggcaaccattaaaaagtcaggaaacaacacatgctggagaggttgtgggaaaataggaatgcttctacactgttggtgggagtgtaaattagttcaatcgttatggaatagagtgtggtgattcctcaaggatctagaactagaaataccatttgacccagcaatcccattactgggcatatacccaaaggattataaatcattttacgataaagacacatgtgcatgtttattgcggcactattcacaataggaaagacttggaaccaacccaaatgtccatcagtgatagactggataaagcaaatgtggcacatatacaccatggaatactatgcagccataaaaaaggatgagttcctgtcctttgcagggacatggatgaagctggaaacatcattctcagcaaactgtcacaagatcagaaaaccaaacaccacatgttctcactcataagtgggagttgaacaatgagaacacatggacacagggaggggaacatcacacaccagagcccgggggggtagggaagggataacattaggagaaatacctaatgtagatgacgggttgatgggtgcagcaaaccaccatggcacgtgtatacctgtataacaaaactgcacattctgcacatgtaacccagaacttaaagtatttaaaaaaaaaagtacttgctttggcatttgctttgctttgcttcctcattggcttttttcaagcaaattgttataagtaatttctgtagctgcactaggtgtcatcatatttaagctttattatttgtcctcttttgaagcatagtatgagtacatatcttgtgaattaggagataaggttgctgcataattaatgcacatagggaaattttttatttttgagacagagtctcactttgtctagaatgcagtggcgcaatcttggctcactgcaacctccgcctgccaggttcaagcgattctcctgcctcagcctcccaagcagctggggttacaggcacctgtcaccacacccagcttattttttgtatttttagtagagactgggtttcaccatgctggccagtctggtctcaaactcctgacctcaagtgatccacccacctcaacctcccaaagtgctgggattacaggcgtgagccactgtgcccgggcagggaaattttaaaaatggaaaatggagctctccttttagacttatgaatgctattaatgaagaccacaatgtattagccaaaagactacggagtcaaatacaattttttaaattgtggcttaaaaaaatagcataaggccaggcatggtggctcacgcctgtaatcccaacactttgggaggctgaggtgggcagatcacttgaggtgaggagtttgaggccagcctggacaatatggtgaaaccccatctctactaaaaatacaaaaaaattagttgagcatggtggcacgtgcctgtaatcacagctactcgggaggctgagtcaggagaattgcttgaacccgggaggcggcggttgcagggaacttagatcgtgctaccacactccagcctgggtgtcagagcaagactgtttaaaaagaaaaagaaaaaaaaaagcaataaaacctagcatcttaataattttttagtgtatagttcagtagtgttaagagtatttccattgttgtgcagatctccagaactttttcattttgcaaaactgaacttctatacccaatgaacaactctccattttccactccctaccaccccgttaaccaccattctgttttctgtttctattaatttgactcctttagataactaatataagtggaatcatatggtatttgcctttgtatgactagcttatttgatttagtgtattgctgtcaagattcatccatgttgtagcatgtgtctgaatttccttcctttttaaaggttgaataatattccattttatgtatgtgtgtgaaccccannnnnnnnnnnnnnnnnnnngattgcttccacctctttaaatgaattttttcttactgccatttggtgggtacatgggagaactcacacctaatttaaaaacccatcccactggttttccactacacagggattccctactaagctggcttggaaaaaaaaaaaaaccatcataagcactgtgcctttaattcgattgctagctctctgtcagtctccaactcagtaaagggtaaatggcatctctgttcatctaattgctgtggaaatatctttgactcttttctttctctcccaccctgtagccaatcatcagcatgccaatcttgtcagtccctcctttgaaacatacctaggctagtcaacatatccagcatctgaccacttctcattacctctagtatttctgatctgatccatactaccattatcttttcttggaccactgtaaaagccttctaacttttttctgtttatttgcttggtccctgctatctgctcattccagactatagctgttgtgatcatgttaaaacagaaaccaaaacctttcaatggcttcttatctcacagtaaaaacaaaaatcctgactatatcctacaaggccgcacatgatctttgattcctcctccaacatctatatccatctcttattccatactctgtcactttcaacttgcttattctgtctgataatccggtctccttgctgccattcatcaaacatgtcaatacatacctgcttcgcttagcactaactgttcttcctgcagatatttgtatggttagatatcttcaattttctgctcagatgtcacattatctgagaggcctttcagactgagtatctaagtgtgcacacaaaccactctcccactagtcctctgtattcttttactcagcttttttgtttgttttatagcttactgttcttgacataggttactggttgtttttttctccactaaaatttaagctccttgatggcagggattttgttactacatttctagtaactagaatagtgtttcacatgtagaaggttctcagaaaatatttactgaatacattaatgaaagagctacagatctcaaagtaacatgggccaggcgcagtggctcatgcctgtaatctcagcactttgggaggccgaggcaggtggatcacaaggtcaggagttcaagaccagcctggccaacatggtgaaaccctgtctctactaaaaatacaaaaattagctgggcgtggtgggcgggtgcctgtaatcccaggtactcgggaggctgaggcaggagaatcgcttgaacctgggaggcagaggttgcagtgagctgagatggtgcctgcctaggcaacagagcaggactccgtctcaaaaaaaaaaaaaaaaaaaaaaagaaaagaaacaaagaaagtaatatggacattacttttgaagactagcccgtgagctctctttccgtaagatatcatcaacctgcctccctccatcagcttcactacagccattatcatgtctttctgtggtttcttcagtaaacttgtaactggtttccccatttctgttcttggtctcccctacaatccattctcaaaccagcagcctgcatttttaaaaaattatgctggccaagtgtggtggctcacacctgtaatcctcggaggctgaggcaggagaatcgcctgagccccagagtttgagaccgagacgagcataagcaacatagggagatcctgtctccataaaaaaaatcaaaaaactggctgggtgtagtggcacatgactgtgatcccagctactaggaggctgaggcgggaagatcacttgagcctgggaggttgaggctgtagtaagccctgattgcaccactgcactccagcttgatgtcagcgcaagaccctgtttcaaaaaaaaaaatgctaacctttcagtcgttttacgtcattttcagagtaaaattcacactccttattatagtgtgctacactacaagatgtagtgcctacctaatttaccctctttaaaaaaaaaacactttgttactcactatgctttagctacattaatatttcctaaatataccaagctgattcccatcttagggtcttctcacagctgttcctctgtcctaatcagtcttttcaggatcctcatatgtctggctccttttcatgcaagtctcaccttaagggttacctcctcagaaaggtcctgacagtccacccaataaaaaatagcctctctaatcacccttctttattttctttataacaccataagctgaaattatcttattaattatcttttctatttttatttttatttttttcgagacagagtttcgctcttgtcacccaggttggagtgcaatggtgcagtctccggtcactgcaacctctgcctcctaggttcaagtgattctctagcctcagcctcccaagcagctgggattacaggtgcctgccaccatgcctggctgatttttgtatttttagttgagatggggtttcaccatgttggccaggctggtcttgaactcctgacctcaggtgatccacctgccttggcctcccaaagtgctgggattacaggcgtgagccacagtgcccggctattaattttcttttcttattgatgttcccatatctgcatgacaaaaggaactttttcttatttaccttctatccctagcacatggaaaaatgactgggacttattagtcgctcagatatttaaacacaggaatggttgaacgaatgaagttttatagtagccatctgaggcacttggtaaaactacagaatctcagcctcctcccataaaattgagtcattagggttagttatgtgacccagaaatttgtagtttaacaaataccccatgactgttgtaaccaggcaaattttgaaaatactgacttaatggaaatagtgctgagtgaatgaatgagtgagtgagtgagtgagtgatcatagctcattgcaaccttgaacttctgggctctagtatcctctcacttcagcctcctgagtagctgagatgacaggcacacaccaccacacccagctaattttatttcttttttaagagatggggtcttgctatgttgcccaggctggcctcaagctcctggcctcaggtagtcctccagcttcagcctcctgagtagctagaattacagacttgaagcactgtgcccagccagggagttatcttttaaccttagtatattgataggaattagttcaacgtttcccaaagtgtatatcataggacactaattatacaaggtatttgatacaaaatgaatgatcttttcctatgtgtttaggaatgctgaatattatattcttcttttggagattagctaggcagtcattagcattttgaagggtatgagaaattacactttagagcaatctacttatctattaaatagatttgacaagtctacttacaatccctgccccaaaccgtttcttaccaaatccctattaatatactaaggaatgtgtacttatgccctaaggactatacactgtacatgaagtagagtatgtggttccttgctactatcgcagcttattctgttcatggttaactgtctacacaagccactatgtagcagatggtgtggactaaagtacacattttagcttaatgatctttagctatttttttttggcatatgtaggctctatatatcttttttaaactatatttttattacattaaaaattaaaataaggatttttgtcctttatgaggtagtgtagaaacataaagaattaactttttgtatgcactggtttacattgccatcttattgcttaattactttgcctaaaattgcctactattttttacttatttatttatttatttttgagacagaatcttgctctgtcaccaggctggagtgcagtggcgccatcttggctcactgcaacctccgcctcctgaattcaagctattctcctgcctcatcctcccaagtagctgggactacaggcatgcgccaccatgcccagctaattttttgtattttagtagagatggggtttcaccatgttggccaggatggtctcaatctcctgacctcgtgatccactcgcctcggcctcccaaggcgccaggattacaggcgtgagccactgcacccggcttactcatttatttaaacctcattaatctcatgttagtttttctaggtctatctagttcattgctataaatttagaatatattatgtaaagaggatgggcttttcagattttgacttagttcaacttgttttcccaccaagatgagatcctacccatatagacaggcagaatctaataaatgtgaatgttagagtaattgtctttggttccatctttttttcaatacctattaaagtatagtgatcagatcaatgtaattagtatatccattgtctcaatcatttatcattactttgtattagaaacattcaatatcctcctcctagctatttgagtctaatatattattgttaaccgtagtcatccttcaatagtgtagaatactagacttactctttttttatctagctatacttttgtatcctttaacaaatctcttcctatccccctgccctccgcccatacccatgcccttctcaccctcaagtatcgtctgttctaatttttacatctatgagatcaactttttttttctgactctcacatatgaatgagaacatgtggtgtttagctttctgttcctggcttatttcacttaacataatgtccttcagttccatctacgttgctatgaatgataggattttattctttttaagagctgaatagtattccattgtatatacataccacactttctttatccattcatctgtttttggacacccaggttgagtccatatcttggctactgtgaatagtgctgcaataaacatgcagtgcaggtgtctctttgatatactaattttactaatttcctttgctttgtataaatgctcagtggtgggattgctggatcatatggtagttctagttgtacttttcttgagtactctccatactcttctccttagtggctatactagtttacatccccaaattcagttccatctttaactatcttagtttaattctgagttggaatcgtttcttttgatgatgatgacgctttggtttttttaaaaactgggagttaagaaagttagaaatgccttacgtgttaagactagtcatttcagttgtttgttttcctgaaacaacttttgtgatatgtctagataatacagccagtagcataacagtcttaattctgatgtatatgcgcttggtcatgcctacttctttatctaaagaattgggcaacaatttctgctgttggtgtgttatttaattatattactgattctagatttaataaagactaaaaccttctagccctgtgttttagctacaagataccagctagcctttatttgcttcaaattgtctgccaatgatggtaaacaaagtgattctcaaaggaaattttgttcaaaatagtctcaaagactattgctattggcaaactaaggaaaataataaagctcttcagaaaaacttgacagaggcagttttgcaagtgagtaccacccacaatcatttcactctgtctccattctcccaggtgcatggcaggaaactaaaatcttcattcttactatttacccaagataagttaaatatattgagcaagtgcttatttgtaaaactaccatatcattagtgttacaaggaaatattttcagttcatctttctgattacatctatctgtttttaataggtatatagtttgtttctattttttatttgatctatcattttgacttatagagtatctctggcttttgattataacctgattgtattttgtcctaagagtagctttatttatgaagaccatcatggggtaaaactagtgacattattggcacatagttcctattagagagaataatctggtttaaaataaatgtcattttgagtaatctttaggacaactcccagtcttaggcaaacttgggtgtgccctcaccaatgacatagtcaggaaaagtggtaaatgggggagtttagacacagaacaattgaagggtgctcagacatatctcagcagtgttagcatgatgactgcacaatttggattgcaaacccagaaacgcccttcaagttaaatccactgaacaattgtaatttttacaggcaaaactagtttcattctagtgggttcacgggcctatatactcccagattgacctttattttagttctttgttttttttgttttgttttgttttgttttttgtttgtttttttgagacggagtcttgctctgtcgcccaggctggagtgcagtggcctgatctccactaactgcaacctccgcctcccaggttcaagcaattctctgcctcagcctcctgagtatctgggattacaggggcgcatcaccatgcccagctgatttttgtatttttagtagagatggcatttctctatgttggtcaggctggtctcgaactcctgacctcaggtgatccacccgcctcggcctcccaaagtgctgcaattacaggcgtgagccgctgcgcccagccgagctaattctttttaaaggaaaagtcatttatattttcctctctaaaaccatacctagtctgtcagagttatctgagatgttttcctatttctcttcataggttgtattccctggcaatttcgaataacttgttttagcctatcataccttgttttagaacaagaaagttagaattacagaatattgggaagcaagaacataagttctcaaagcatcaagactataacctttttctttgggcagtagtatgatgtgtctttagccactgattaacccaggcattagttttttagaactataaacattaaaatatgaggttctcaacttttctgttcctgcacacctgagagatacaaggtattcatattagtgactatggctgggaatcagaatcttgaaggagaggtgttggtatgatttaaagagaaaaataaatgatgtgataacacttcctcagcttttcctctagagtcactggagtaggtttagatgatgaccaaggttcttctagttctaaaattctgttatgctttctctactcttcttttcatgccagctacatgcttgtttctccataatgatagggcccaattttccctaagagagagagtgactacagaactgttattcctattttgtcttatgtgcaagaacattcctactttgtcttatgtgcaagaatatatatatatagtggggggttgggggagagatgaggtctcactgtcaccccggctggagtgcagtggcatcatcatagctcactggggcctctaactcttgggttcaagggaacctcttgccttagcctcctgagtagctgggactacaggtgcacacgccactatgcctacctaatttttaaaatgtttcatagagatgcggtctcactatgttgctcaggctggtttcaaactcctggcctcgtgatcctcccgcctcagctcaccaaaatactgggataacaggcaggagccactgcacccagccccagtatcctttatttagatgggaagtaagataagtttaaagtaaaaactgggaattcacttgctggtatgtttggggaaaatattctagaataggaacatttcaaattttcctttttcaaagcaaattaaggaaaaaaatcccctgaaaataaattgttaaatgttcaaatagcatttaaaacttctgtggtagaaatcagatttctacctgacttccttaattaaaatatatagtgtatactccaatatacatcagaaactggaatttgttaagtattctgattgtttctttctgtctgggatgcttaaagtgttaattaaatgatatgtaaaacatatgtggactatggattttgtctaaaacaataatgtgatataaaaatgtctcagatttattgttagacaaaatcaaaggtacttttatgtaatctgttgcatacatcatagctgtagaaaatccttaacttcagttagaggttagtgaaaataaagatgtgactttttttcccattgttcacataaaccctggtctaaaattatttttattaccccaggcacattcaaggaagccagaatcatcagcgtctcaagagatttagtctttgaggaaagtggagcttagtcttttctgtttttagctcttagtgcttttcaaacctttaaaataagtaagtggttgactgttaaatgatgattgtcaatatctcttgcattaggaacttggcttattgccacgaattttatttcagattactaaagaaattgatatttatgaaagccaatgtagtcagtgtatcttaaagtcaaactactagaatatatctgctaatagtaataagtgctttatttatgtcttgactttgagctgctatagccataagtattttttgtcattaaaatgttccttcgtcattaaaaatataattcatatcacaatcctgaatcatccttctactttatgaaacgactgcttggtcaaatttgtgtgattattatttttttaatttactttttattgtggcaaaatatatacaatacagaagttaccattttaaccatgtttaagtgtacaactcagtggcattaattacatttacagtgttgtacacccattaccactatctgtttccagaatttctcatcaccccaaacagaaacgctgtactctttaagcaataacattccataccctactccacccagcccctggtaacctctaatctgctttccatctccataaatttgccctttctcaacattttatataaattgagtcatataatatttatctttttgtgtctggtttgttttccttagcataatgttttcaaggttcatccatgttgtcacatgtatcagaattccattcatttttatagctgaataattttccattgtatgtgtatattacattttgttgattccttcatctgtagaagtatacctggtaaccttttggctattgtgaattattttgtcataaactttgtggtaaagtatctgtttgagtccctgttttcaattattttggaagtataattaggagtagaattgctgatggtgattatgtttaactttttgagctatgtgatcattctttacactagttcattctattttttattatcttcacattaatatttcataagtttttaaatttttttgcttatttccttggttgacttttgttgctgattttaaagaaattatttgttttgatcattcatttttttcttttcttttcaattgtttgtttttcagacctgagtcagaactccatcacaggggaacacagccaactgttaggtatagtattactgtggggattgactttatccaaagtcacccttaactcatttatcctaacagacattactcccttctctgattctattttctatcccctccttttctacttcccacccaacaacttttttcctgctgtttctattcccaacttgccaagttttaggaaactacttctataattgattactaagactcagttaaattaaaaagtaattttgcatggtttatggttaaaaaaaatctaagaactagaattttttaaagataatttggaaaagaagatattataatagctttgtaatatctgactttgcagctaattttccctttttattacttttcttggccttttgatcccctttttaattattgaaagtacttcataaacagtatgtccttaagcagtccttagaatttggtgttccagttccttatctatgaaacaaattatggaaatgaatttacttcctctgggtaccacttctttaaagtaagtgcataatttgacaagaatttctctttttttttttgagacagtgtctcgctctgtcaccaggctggagtgcagtggtgcgatctccactcactgcaagctccgcctcccaggttcatgccattctcctgcctcagcctcccaagtagctgggactacaggcgcccgccaccacacccagctaatttttgtatttttagtacagacagggtttcaccatgtcggccaggatggtctccatctcctgacctcgtgatccgcccacctctgcctcccaaaatgctgggattacaggtgtgagccactgcacccggccttgacaggaatttcacaagacctcaggactgataaattttcaaagtgtaaaaagaaacataccctgatgaggcattcagctcaaacaaaaggcatatataaagaaagtaaaagtatctcttcttcttaccacctcatttccacctcttaaaagtacttgctgttgacagtttcttgggaattcttctagaaatttttaattataaatttttgtattatatatgactatcttttcctttttatatcaatggtgttatagtaaatggactgttctattatacagactgcttctttttacttaacattttaccttggacatcttagtacataaagttctgcttcattcctttgtttgtgatggaagagtatttcattgtgctcctgcactataattttattcagccagtttcctactcatgagcatgtatttccaagtgtgttactgttgtaagttgtgttgcaatgaatatcttatacttatatccagtatataagatagatatatcagtcttaatgccagtatatttgtagggtaaattcctaacagtggaattccttactcaaaagatatgtacatgtttaaaaagatacatcagcttaaactctcaccagtatggagtaatgcttgactctctataataaaaaaaaaaacaggtattattaatcttaaaatagtttctttacctaataggtgaaaatggcatctctagttttttatttatacttccttcagtgtaagtgaggttaagtaatttttagtatattatttggtatttaacacttgtgtgtctatgtatgctttgatttgaggcttattttgatccctgctgagcttttagctgtttaaatatgtgtaaagcagctatggaaaaataagctatcaaaaagtccaaagtagggaaagtaaaaacttcagaggattagttgaagaaactgggatactcctttttcgttctttctatattaaagacttaggatagtccttgggttaatgagaagagtttatgagaccatagccctcattcctttagtgagtttatatgctgaaacagtacctgacatcctaggcactcagtatatatttgttaagtaaatggtttgacataaatatacaaatctgatcaccaaggtcctgaccgtgtgatgttagaggttttttgtttttttggtttttggtttttttgagatggagtcttgatctgtcacccaggctggagtgcggtggcacgatcttggctcactgcaacctccacctctcagattcaagcagttctctggcctcagcctcctgagtagctgggactacaggcgcacgccacagcgcctggctcatttttgtatttttagtagagtcaaggtttcgccctattggtcaggctggtctcgaactactgacctcaggtgacccacccactgtggcctctcaaagtgctgggattacaggcatgagccaccactcccggccacttttttatacttttatattggatagtttctatacattgctcaaaattagtcttctgtatataaaaattttatatttggatcaggaacgattaaactttcattgaaaaattttgccagaccatgaaaagaacatctttcctctaaactatgaaagtgtttctgtccctgatacatacatgacaggcagagatgtttgagaatagttcattatcaggaacacatgtacaatggaggcagcttagctagtgaaatggacagtcaaaagttgatacagttctagtattactaagctggattttgttcccagctaatcacctgcagtaaaggatacctggggaactgtaggcaaaaataagtaactttgattatgaaggaagagttatcttagtcattattagccaaaaaattctaatagtatttgcaaagagactgcttcaaacattaatctcatttggcagcctacagttgcattcaatttttagccaacctgaggattcatccagtcttctggccagattatcaggtatgtccatcctgccagcctgagttctctctcctagattcatggagtcagatcatattttccttttttctcatgctctgaagaactatcctcttctgtcttctgtcttaagtatctttgttttagctgtagcctcaaaacctttaaaagtctggtttaattaaaagaaattcatgagtttgcaaaagactgaaagattttttttgttgtattttctaaccatctgataagttactcagaaaaggcattataaggttgaatgaaaatcttccaaccaggcgccgtggttcaccacgcctgtaatcccagcactttgggaggccaaagcaagtggatcgcaaggtcaggagttcgagaccagcctagccaagatggtgaaaccccatgtctacttaaaaaaaattggccgggcatggtggcgggtgcctgtagtcccagctacttgggaggctgaggcaggagaatcgcttgaaccaggaggtggaggttgcagtgagccaagatcgcaccactgcattctagcctgggcggcagagtgagactctgtctcaaaaaaaacaaaaacaaaaaaagaaaaagaaaaaaaaagaaaatcttcccagctctccctaaaaaccttgtttaggataatttggcctggtaggtgaaaaactggttcaattgccttgcctgcttaattgaatttgtaataacatctttcagacctttgctgttgaattggatatataaaagccctttccagtccttctaaatgtttttactgtcaacagggcacagttattttaatgtatctactgttcccactgactcatcgggtctcttgcaaaactcagggtcaggctgaggagatatacgggagggtgaaactgctgttgtaataatcaagctgtacacctgtgatttatgaacttttctgtgtgtgtgtgtgtgtgtgtgtgtgtagctttgcacttaaaaaaatttttagaaagctagcaagcaaacaagccatgggtcctggcattattaaaagttttatcaggcatccaaggaaaaataattcgagtcttctgcagtcagtctctcataaggaatagaaaaccaagtaactactacctcagttttgaggcttttgcaaccttgataaccaaaacttaagaatggcaacatgagattaaaaaaaaaaaaaagtataggccaaccttacttaggaacatatctacaatcctgaacgaaatatttgcaatctgaatcgggcaacatatttttttaaattatcccctcatcaagttgagtttctgctagaaatccatggttggtttaatattgaaagttaatttatataattcactatgttaacaaattaaaagaaaaatattgtataataatcttaatagaggttgaaaaagcatttgatttgaaacatacctgatatggtttggctgtgtctccccccactcatcttgacttgtaattcccataatcctcacgttttgtgggaggtaacaatcatgggggcggtttcctctatgttcttatgattgtgagtgagtctcatgagatctgatggttttataagcatcacgcatttcccctccttgcactcattctctctcctgctgccctgtgaagaggggccttccaccatgattataagtttcctgaggcttccctagccatgctgaacttggagtcaattaaacctcttttctctctctcttttttttttttttgttttttgttttgttttgttttgttttttgagatggaatcttgctctgtcacccaggctggagtacagtggcatgatctcggcttactgcaacctccatctcccaggttcaagtgattctccttcctcagcctcccaagtggctgggattacagggacccaccatcacacctggctaatttttgtattttcagtggagacggggtttcaccatgttgtccagtctagtctcaaactccaagcctcaagtgatccgcctgtctcgtcctcccaaagtgctgggattagaggtgtgagccattgtgctcagccaaacctcttttctttataaattacccagtcttgggtatttcttcatagcagcatgaggaagggctaatacagtaaaaacccagtatttaagtttatgagttcataatgataatttaaaaaatgagccaggcacaatggcacacgcctgtagtcccagcactttaggaggctgaggagggaggtaggaggattacttgaggccaggggttcaagatcagactgggcaacattgcaagaacccatctctacaaaaaagcaaaaaataattagcctggcatggtggcacacacctgtagtcctagctactctggaggctacagtaagctgtgatggtgccactgtactccgcgacagagtgataccctgtctctaaaacaaaacaaaacccacaactaactggtcaccattggagtatttagtgaaccaattattctgagaactggtcagtaaagggaaagaattattcgtcctgtttttaactgaaccacttggtaatcaaatagtagattaaaggaaatgtctctttttatagaggtattctagctaataaatgaaggaacaataatagaatgagaatattaccatttggtgacctctcataaattaatggagctaggcattactcatcaacaattgctaatatctcaaaaggaaagacaaccagatgacaatgacatgtacctcctggcagttcataataccactgtgaagtagttttcctccctaccctcctagaagtactgaatgtgattaagcttttagattcaactaccaatttataggaattacaaaaaaaaaaagagcatgttaaacagcatcacatggatgccatgatcaaaacccagaccatcagaaactctccaggacaaatgacatggtttccttaacacatcaatggcaaaacaaagtataaaatcaaaaacatgtagcatttgggataacctttcagattcacatagtcacatagtacaaacccaaacctgtgccaagggaaattaggtacacctactgctctcttgcctaactcagactagcaaaggccatttgacaagatcaggaagctaaaggagtaacttgagatttatctagggcccaaattatagtataagtggtaattgacaaatgcaacattatagaagtaataacatcacaacagtaaagtgtttatataaagagtaagacctttggtataccttttttctgtttacaaaaaaaaaatatgccatgaaaaacagaaatctgaaatatttagtagaattatcctatcagttttcatttgaattatgcagtgaaacaccagtaagtttcccaaaaatgtcagcattatttagatagtaaaatgagaaaaaagaaacataatagtgtctgggcgcagtggctcacacctgtaatcccagcagtttgggaggctgaggtgggtggatcacctgaggtcaggagttcaagaccagcctggccaacatggcaaaaccccatgtctactaaaaatacaaaaaattagccaggcatggtggcaggcgcctataattccagctactcgggaggctgaggtaggagaattgcttgaaccctggaggcggaggtcgcagtctgctgagattgtgccactgcactgcagactgggcaacagagcaagactccgtctcaaaaaaaaaaagaaagaaagaaaaaaagaaacataatagtaatctgacaggtgatgtaatgcaaaccattactgaggccagtctcagtggggatccttcaaaggagtcattttaggattctgaataatcctaaaagagccctggaatatggatttggttcttagttcctgcagagtaaagattatttgctactcagaaactagaagttccattccatctggtatttcttggggtcacaacagtgacctaaacttttgaaggctgaactctaaagcagcatggtttcccaccaagatattcaagccaaaaattaatccttgcctttcaatataatcacttctaatttcatgccttttggtataaccacacttgatgaatgcttcatttcttgccttggaaagccttgacctttcatgactgtccacaagccatgattgaccaggaactctttgggagcctcccattgcacaacactaccacaagtagaccatgagtaggacattattggttggaggcatcattggtctcataaaatgtagacaaaaatctccagggatattcttctacctttctaaaaaaagtaagcaagcaaatggaaggtgggccagaaacagccaggatccagactgtctgatgataataagacaaggcaagccagagctgctaggaggtggcttggacagcaggtagcagaatgggacaggattgtctcatgccagatttttgtaacagcatcattgtaaggttattgaatagcagagaggtagtatgttgaactcttacttccataaccctcaagagaaatgacatggtcctgagtctgggatacaaaattctattaaatgtttaaatcagtagaggatgcagttaggaagatgagcaaactcctcaggaataaaagactgtttaaagagaaggaaaataaatggaaattctagaaaagaaaaaatatatatagatataaaaaagaaattaaacagtagcttagtagtaggtaaatagcgtaaacaaaaagaactacacctagatacatcttaatgaaactgcagaaaatctaagaaaagatcttgaaagcagccagagagaaaggacagttcatcaaaggaacaacagaatgacagaagaattctcagtaccaaaacacaaagttacaagccagaaaacacaaataagtgtacacaaaaattttgtagagacaaggtctcacaatgttgctcatgctagtctcaaactcctgccctcaagcagtcctcctgccatggcctcccaaagagctgggattacaggagagggctgctgcgcccagcctggagacatctctgacagtcactactggaggtgctactggcatctaatgagtagaggccagggatgctcttaaatattctacagtgcacaggacagtccctcacagtaattatttgctccaaaattccatagtgctgagtttgagaaacctaaaggaattctaaggaatatacctcaagaaagaataaaatgatcctagaagactagtagtctgaaatgtaagaaagagtagtgaataaatgaactagtaaacttgtacatcgactcaaatcagtgttgtctcaataaaacaactctaatatcttatttatggagttttttttttttttaaaaagagactactgggaacgttggacaccaatattaggtaagtcaggaggagaaaattggaattgaagtattagaaagtcttcgtgttgttcaggaggatgtcaagcaattgtttaaacttatttaacaatttaagatatatagtaaaatttcaagggtaattgctgaaagaacagaaatagagaatggaaactagaggggaaaatgtcattaaggaaaaacaaaccagaaaatccaaagagtgggagagatagaggatgagaatgagtcatagagaaaaaacaaataaaaagatgttagaaccctgtctaaatatattaatcactaaggttgatggactaaacttggcagttgaaaagacagattgtcagacttttaaaaatccaacccaaacaaatagatgataaactgtgttgtttaaaatgccaataaatttggaggtaatttgttgagcaaaataataataataactaaacaatagatgtatgtctaaaattgttgtgccagccaggcccggtggctcacacctgtaatcccagcactttgggaggttgaggcaggctgatggcttgagtctaggaatacgaggcaacatagcaaaacctcatctctacaaaaaatccaaaaattagctcttcatggtggcataagcctgtagtcctagctacttgggaggctgaggtgggaggatctcttgggcccaggaggctgaggctgcagtgagctgtgatcgcaccactgtactccagcctgggcgtaagagtgagaccctgtctcaaaaaataataataatgataaataaaattggcatgacttcttggtggattaaaccttttgttattatgtggtataaacaaaactgtcatgccttcttggtggattaaaccttttgttattatgtggttaccttctaatacctaataaaatgtttctcataaatttatctgatactaataaaattatatcagctttcttttggttagtatttgcctgatatatctctttccttaatgttttcttaatgttcagcttttgtatgtccttatatctcttataaatagtatatgtctagattttattgtttaatccagtctgtcaatctttgtcttagtctatttacattactggttttattgatatgcttggaccattgtgccatcctaaattatttgtcccactttttctgcttctttataatctcttcttaaaaaaaaaaaaaaaaaaaaaagctttctgtattacccctgcttcccaaatgaactattagcacactctcacattactctctcctttggaaaatctatccattaactaacttacgtggtctggctcctttctgtctttctaaatatgctctcctttcctcactgtcctttagctatattgtcctttctgctttatgaattcacttgaattggttctgctttaggatcttttaaaattgctgtgttccctctgcctgaaatgtaggcttttccttactatcctatgccaggagtgtgctgcagccagcttataccagctcacaagagccagttaatgcaaatctcttcccaaaaccaggttcattgtcttcacattagtagtttgaaaatggccatgtgtgagtatttataccacagaaattgtcaagtactgtaagtcggatttgttttaattctttagaggctgttatcagcacaccaatgatcttacatgaagtcgtcattcccctccctagtcacagtctctcccagtacctatttgattttcttccttgaacttaccacttcttgaaattctttttgggtttttttgtttttattttgtcttttttgtttgtttttttttttttaattgctgttgttgtttttacttactttctgtcttctgtaacttcagtatatgcacagtaaaggcagggtctttaactgccatgtccactgctatatctctaggacccagaacagtatccagtacatcctaggaatttaataaatattagttgaataaatgaattactcagaagtggtgataattttaagctatactcttttttttgagacggagtctcgctctgtcgcccaggctggagtgcagtggcacgatctcggctcactgcaagctccgcctcctgggtttatgccattctcctgcctcagcctcccaagtagctgggactacaggcggctgccaccacgcccggctaattttttgtattttttagtagagacagggtttcaccgtgttagccaggatggtctcaatctcctgacctcgtgattcgcccgcctcggcctcctaaagtgttgggattacaggcatgagccactgcacccagcctaagctatactctttagaattttctggagccattaagaagaggaaaagaattacatttttctatttataactttttgttactgaaaatatcaaaggtacagaaaagtagaatagcataatgaacttttatgaatgcatcacccagcttcatcaatgttacaaatctgttttgaagaccctacctaatttttccctaaactgttttaaagaaaattccagacatcatatgattttacttgccctttttaaaaaaaagagtgatatattttctcttattttttgtttcaaaaatgcctttttacctttgatgtgttgagtcaggatcctaacaatgttcatttgcaattagttgatatgtcttttaagtctcttttatctataaaagttcaccttttaagtttatgccatttatttgctgaagaagtcagatcatcttgtaaaatttctcacattctgaatttggtgattagatccttctaatgtttaacatattcctcctttgtgttttccttgaactgatagttagatttcgaggcttgattagattcaacttccattcttttggaaagaatacatcatagcttgtacagtgtatttttcattgtattacaggagattgtgttgtcataccttcagagatgttaaagctgataagcaggctccagatcagcctgatccatccattgtaaagttttgcctcagcctttcacctaatggttttaacaaccattgattatcgttgcctaaatctgttattttattagtgatttttttctgtcattccatctatcattaattagctggaatgcttctataaggaagaaattttcttttaattattggttaccctgaaatacagttggcacaagaaaggcaagatgattgcttacttctttccatttttttttttctatttattaatgtcatttttcagagtcatgtgttgtttccttaaccccgcaaaggtgactttttcagaatatcattttgagtatttcataaatttgcatttcaatccatcacattatttatttttaatgtttgtattattccattttggggcattgggaaccccttcagtttggctctgtgccctttgatgtgacccagtaattttgatagtttattgactgtttctcaagcccatccttatacatttaagcttatagggtttttaattctttaatttttatattggtatttatttccccagtattgaaaatcttggcttttaatagcatttatgtttttttttctcttctctccttccagactctgtaattatataacttttgcataataatgaaacaaagttaaggaagtgctcaaataaagtttgctgtcttatgggcctggtctcctttttttcctcatagctctttcaccgaatttttgtcagatgcctcttttaacattaaaaaaaaatgtggaagggtttgtacaaaaataatagttaaatgacataattttttttcttttttcaactcccccacaaacctgccccgagacagggtctcaccctgttgcccaggctggagtgcagtggatcagtcacagcttacttgcagtcttgaactcctgggctcaaggaatcctcctgcctgaatagctagaactataagcatgcaccaccatgccctgctaattttttaattttttttgttgaggcagggtctcaatgttgcccaggctggtccagaactcctggactctagcagtctcccacctgggcctcccaaagttctaggattacaggcatgagccaccatgcctgccctattttttttcaacttttattttggatttagagggtacatgtacaggtttgttacatgtgtatattgcatgatgctgaggattggggtatgggtaatcctttcacccaagtaggaagcatagtgacacaggatttttcttggccactttgccagccagagacctccagccagcaacatccatgcccaggctttgctcaggcccgagctcaccagaagagatgccctgtctattcatcctgctgggctatgcctggcttgcgctccaatgcagatcctgcagccgtggcaattgcgcactggtgggagggggtgagggagtgagcgagtgcagtgtccagctggctgctccaagcagtgagacagaagcgggctgtatgtagggattgctgctggaccaggcatgtcacactgaggggaacatggtggcgcccagacgggtgtccgcaaccctgaaacctcagagggggtgttaccgtgtgctaatagctcttttagtcccaccatctgcagccccatggatggcggcatgttaacagctctgtctgtcctgtcgcccctgctcccgcccgctgctgcttcccgtcgcgtggggtagctgccctccactggcagagcgtggagggccacagtattacagccttctttgtacctgtgtttggtgggtcctgagttcttgttccacatccaagaagaatgaggttgtgctgatatcaaagggtgaggagggcggagaataattttattgaatgatgagaaacaattctcagtggagagggcatgcgagggtggtctctctcattggggctggggctggggcctttatgggctcagaataggggagtgtatgctcattggtttgtgagtatgcaaaaaaaggctaaaacaaaggcacacagtgtaaaaaaccaattagggaagggtagatatatgtaaaataggtaaagagtggagaatcaattagaggaaagtatgccaaacgggaagagaggttctcagttcagtccatggatttatccaggacttgtagctaggctttaaactgtctttggcttgaaggttgggtttcaattgtatgtaatgaacatacaagtgcatgtgtctttttggtagaatgatttattttcctttgggtatatacccagtaatgggattgccgggtggaatggtagttctaagttctctgaggaatctccaaattgctttccacagtgactgaactaatttacattcccaccagcagtgtataagcatttctttttctccacagccttgccaacatctgttatttttgactttttaataattgccattctgactggtgtgaaatgctcatcactgaaatcatcagagaaatgcaaatcaaaacttcatataatttataaaaggtcagacagctgtggaggcagagagcttttactgtcattatcagcagcaatagtgtgtaaaggagactacatctaacacagtattataccctgagtatatactcaatatctttttttcctcctaaacttaggtgactttaagagtagagtctcggctgggtgcaagtggctcacgcctgtaatcccagcactttgggaggctgaggtgggcggataacttgaggccaggagtttgagaccagcctggccaacgtggtgaacccctatctctattaaaaatacaaacaaattagctgggcatggtggtgcgtgcctgtactcccagctacttcaaggctgagacaggagaatcgcttgaaccagggaggcggaggttgcagtgagctgagattgcgccactgcactccagcctgggcggcatagcagctccatctcaaaaaaaaaagagtcttcatgggctggaattccaaaagaatagcgtctctaggggtcttgattattgttaaggaaaggaatgacccatgtttacttctcagagttttctttttgttcctgctggagagttttattttgttccatattctccaagcagtgctgattgagttctaagattaaatttgaatatgaaaatgggttatattaataccgaagcaacctgcacttatctggtgctgatgtttcttcgtcagaaaccagtgagaaactaacttggtctacttttttttttccagacgacggacataagaaagctcgaaatgcttatctcaataattccaattatgaagaaggagatgaatattttgataaaaatttggcactctttgaggtaatattttggagaaaactatggactgagactttaggaacagagatctcatgatagccatattttaccccatttggtttaaaaattttacaagctggataatttaatgttaaaagaaaatattgtaacttgttattatagtaaattttgtctgtgtaatctaattatagtgagtaactattaaatcaaattgttatgtagtaaggaagaggagtttgacttcttggacatatagattaccttgcaatctaattcagctgtgatttaattgtttttattagaataatctttcttctaactataaatcagtgtatttctccaccctttgtctggaaagactatcatttgccttagaactaactaaacaaggccgggcgcggtggctcacgcctgtaatcccagcactttgggaggccgaggcgggtggatcacaaggttaggagatcgagaccatcctggctgacacggtgaaaccccgtctctactaaaactacaaaaaattagccgggcatggtggcgggcgcctgtggtcccagctactcgggaggctgaggcaggagaatggcatgaacccgggaggcagagcttgcagtgagccaagattgtgccactgcactccagcctgggcgacagagcaagactccgtctccaaaaatcactgtaggaagcaggcttccagattagcaggaccttcatgtccttttttttaattgtcaaataataactgtatatatttatggattacaatgtgatattttgatatttgtatgcattgtggaatgattaaatcaagctaattagcatatatatcacctcgtatacttatcattttcatggtgaaaatatttgaatttgactttcttagcaattttgaaatatacaatatgttaactatagttgctatgctgtgcaatagatctcaaaaacttatttctcctgcctaactgaaactttgtatcctgtgactaacctctcccccttcccctacatacaccccaagcttttggtaaccaccattctattactacgagttctactttttagatcccacatgtaagtgagatcgtgtgctatttatctttctgtgcctggcttatttcacttaacataatgaagaggacttctatatcttatctgaataagacaacatggactctgtggccaggctccataagctgtggccaggttgttgaaaggagcctggtttatttcagcactacctttttctggcctttgacaatgatgcaagtgccacttctctcaatgtaccatttttagtttgtttttgagacagggtcttgctctgtcacccaggctggagtgcagtggcacgatcacagcttgacctcctgggctcaaaggaccctcctacctcagcctccctagtagctgggactacaggcatgtgtcaccacacctggctgatttttaaattttttgcagagacagggtctcactctgttgcccaggctggtcttgagtgcctgggctcaagcgatccttctgccttgccctcccatagcattgggttagcaggtgtgagccaccatgcccaactcaatgtaccaattttttttttttttttgagatggagtctccctctgttgcccaggctggagcgcagtggcgcgatctcggctcactgcaacttctgcctcctgggttcaagctgattctcccgcctcagcctcccgtgtagctgggattacaggcacgtgccaccacacccagcttatttttgtatttttagtagagacggggtttcaccatcttggccaggctggtctcaaactcccagcctcaggtgatccagccaccttggcctcccaaagtgctgggattacaggtgtgagccactgcacccggcctacctgtgaaatattttttcatttaatttgaagttttctggtagcaagattattttgatacttatgttcagtgttctttgtagctcatttcttccatgtcactggctttataggaagaaatggacaccagaccgaaggtgtcttccctcctcaaccgcatggccaattacactaatctgactcaaggagcaaaggaacatgaagaggcagaaaacatcactgaagggaaaaagaagcccaccaaggtgaggcctcagaataacaaggaatacatagaaagagccctgtatataagaaagaaggaaatacctaaggcaccattctgtgttcagcagctatttattaaatgcttgagaggtgcctggaactgttctgggcaccagcgtcatagcacaaagaaaacatatgatgcagtctaaattctgatgtggggatacagtccttaagctgttttaactgccaaagtatataacatattaagtgttgataaattcccgagcaaaaaattaagcagagtagagagactgaaattggcaagggatccagagtggagggcgttgctacttacataggttggacagggaaagcctttctgacaaggtgatatttgaggagagatctagctgatgggagggagtgagctatgtgggaaaagagcattcagggagagggaatagcttttcaagagaagagtgtccatacccatctgctgatgccatctgtctgttgtgaagttgttgggttttttaaacaccaaacatcagtttgtctcaaaatgaaaatataagacattcagtttaccattctggttgttcagccctttcaaaaagggataaaacggccctcagatcttcattttgccatctaatttatttactaactactgtgaagaatttatgccaaattctgaagaaattccatcaagtccttattgtttttaaatgaaaaaagccaacagctttgaaaaacaaaattttaaattgttgtgggtgcacataaaagtttatttgtggccaaatgcctatgtataataaacacatgcaggaacctttctttgtaaagttaaaatatatagctttaggaataataaaagtatggtgataaacacttgaaagatggagattttatatgtgcccttttgaagatattgattaaacttatgatttctgcttggaggttaatatggtagttagggagcaagttattacataaaagaataaaaacctctctttaggataactgtgtgattttttatcaatgtctttctttctagaccccccaaatgggtaccttcatgggtgtctacctcccatgtctacaaaatatttttggagtgatcctttttttacgccttacatgggtggtgggcacagctggagttcttcaggcttttgcaattgtccttatctgctgctgctgtgtaagtactgcactggctcctagagatcacctgaacgttgcaagttctcaagagcagatgcacatgacctctttgggaataaaacaaagaatacttagggaaggactcatgatctcaacagaagaaattattctgatattaaaatctaaaggattttcagttattcagtgcctgttagtcactgcttgctatctattatatgatgtactagaaattacaaagcaagacttcaactgaaaatggaagataaagttcctgtcttcagagaattcagaatccaaactatttgagcttgatagcaccaaagttgtgacagaaaatgtgttagaaaatgtgatgtatcactccagtatatattgagaaacaagacaggttattgcagatgtgaggggtatttggtttttttatttggttttgaagtttcttcccttatcccttccttagaaatttagatgttctttccaggtcttctctctactgagaacatttttatcttcctttaatttaaacttctcattatgtatcccagacacacctatgaattttatagttttctactgtccttttttatcactatgacctttataccctacctgtatattatccccagctgatgagcaaaacaggttaagcaggcacagttcatatttttaataacttaaaatgttcatggtaccacctttttttagtctcaggcttaaaacctcaaggctgtgtttggcttcttaattgcttttcacatctaatcagctaccaacgctaatctattctctgaaatcttttacactcagccctttttattcacactaccaccactatagtttttacctctcactgaactactatggtagcctgctaaccaatcactcggcctccagctactcctgtctgcagcacattctatactgtgctaccgggtaatatttttaaaatgcagttcctgtgtgctcagaagccttcagtgattccctttcttactgaacattgttcttgatattgtatttagtctttagtcaggttctaacctattttctgagttatttctctagttcttccttttgagtatactatgctctatttcctgtgtaactaggaaatccagagtgagattagcagttcttaatagcacctgacctactgatgtgggagcattttgacagaatcctccagatattagtggtatgactagcgcaatgaattggaccatatcatcttatttccataccattaggtatgactgtccataaaagtaggtagagttaaatgtttgccaagtgctcttggaacacaaatggagaagtagtatagaaatgtcatctttacacagtaacaatcctctcctttccttttctctgcagacaatgttgactgctatctccatgagtgccattgccactaatggagtggtgccaggttagtaggtcaaggttgtatttcaggatttatcagtgttgactctgtgtttatgctataaagctagaggtgcaaacttctgaagaatagaatactatttggtctgttctgtgctacaacagagtaatggtctataggacgtagacataatactacttgactttaagatgccgtctttaaaatctctttattttttaaactagaatgcattaatttcagtcacattcttagcttttattagttggaatatatatttttttatagacagagtctcactctgtcacccaggctggagtgcagtgacacgatcatagctcacacagcctccaactcctaggctcaagctgctttcccacttcagcctcctgagtagctggaactagaggtgtacaccactatgcctggctatttttttttttttgcagaggtgacattttactatgttacccagtttggtctcaaactcctggcctcaagcaatcctctcgcctcatcctcccaaagtgctaccattagaggcgtgaacctccacacccagccagaatatattttattgggctgtctcatgtcatagtaaatattctctaatttttttctaagtaaatgctggcaaactattgcttcatatggctcattacattagttgtgcagtatatcccacaataacacttttcaccttttacttcccactagcacatctttttatcacattgagggtttgcagaagcctgaaacatttaacctttatgtatatattttttcttatttctgttttattcatattcctcttgctaatacacactctttcttctattcaccttctgttttgtcttttagctgggggctcatactttatgatttcccgggcactgggcccagagtttggtggggctgttggcctctgcttttatcttggtaccacatttgcagcagccatgtacatccttggtgccattgaaatctttctggtaagtaatgacttcattgtggtctataatatagaagaaatattgatttaggtttattctttgctatgaaagcttctgagagatcagctgtgggaataaatcaggtgattgactgccaacgtcagttggcctcttacatgaatatgaggtggaaaggttgaaattctgtttgcctgcctgtcccttcctttctacctgattgccaccactctgccacctcatccaagaggttcaagtccaatggggaaaaagtaaaataaagtttatcttttttgatatcttcatccctatgaaataaaatgcttctcatatctctcttcactgagacatattgtttactatttaaagtagtgatagtagagtcagggttaaagatcatcattataattactttatataaccctatgaataaaattaataatttgttcctttcctttctttccatttggaaatgtagttattcagaacagcatgtagaccaaaaaaaaaaaaaaatccatgacatcccatttctgaaggcatttcagatcctattagaaactaggctaattccccagtcattttctctctcagctttgctttcttttgtgaaagtaaatgcaaacgaatacagcctttttacttaattattttgaaataacctaattttctcctttatttttacctaacaggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccgtacgtgtctgtctctctgcctagccatccttattgggtagtaattgaaaatatctggtggtgtgataattttaagtcagaatttcatagagtctctgtgagattttccctctcggataagcccagttagacttccttcctcatctaggcaggaagcctaccagcaaactatgtcccgttcatcctctttcttatgtcctaagcatagaactagtagctgtaaccatcatttaggttcagatattagatttttttctccctgataattgtacataatctttttttattatacacattttgaactattcataaagggctttgcagacagtgtagttattgccagcaacctttataaggcccaccttggcctcccgacgtgctgggattacaggcgtgagccactgcgcccagcctaggtcagggcttttatccattacccaaataatgtactttgtacccattaagtactctctcatcattcaccacctccttcaactccctagtgcgaatactttaaagtatgttttttgaagtagtaatggatttgtgcacatctgtgactcacaggctcacttttccctttgactagtggcatagggactagctggcactcagtgttatttgtagtcttgttacagaattatcttgaagagtcatctggattatctgaggatcaaactcatcggttctatgttgatttaaccagattacagaaaaaaagatttttcaagacaaaaagacagttccagtaggtttaatgacttacctcaaagttaattaatggcagagcaagaagatgaactgtgatttcctgactccccattcagtatttcttctatgctatgctgcatgatggcagaagtagattccatcttaaacttttaatctgcttatctagggactgtaatacagctgaaggtcctttttaggggcataaaatttctaaaggtgacattctggttatatctcaatttgggaaattccattttgtctcaggttcacctttggggcttctcctcttttttgattagtacacggtcataatgcatggtattttctttgagatattccagcaaaacaagacaaaaaatctagaataatacatgaaacaagactgggaaatgttgagagttgttgaagctgagtaataggtacatggttcataataatgtattcaatcattttgcaaattttagaagtccctttgttggacctgagaggtattttaactatggatgtattattcctttgtttatatttgtgtctctgggttaaagaaaaaagtaaaaccagcaggttaatatttatgttatccttaccgtcactcccactgagtctaggcttaaattcaaaaacagttttctcttaggccatagagggatctgccttttaattctgaccaagctgttttccttgcaacagtagccagaagattcaacctttagcataacattttcaaggtgtttgttatgaatgttaggcttttctaggccaaaaaaagaggagtgctttttactttataagaacaacaaaaggacttcagtattcttttagacctaacaattttagccaaaaattttggaagatgagtcagcataatgtcttcagacagttcttcaatttgacttccttcactgccaccacctatgaccttggacagataactgtatttccctaaccttcaattaactccctgtcttcctaaacttcagtgcctccatccacaacatagaaattctaatacattgtgaggttgctgtaagtattaaattggcagaaaatgtaagtcaccattcacagtgttaaaataaattataaataaataaacattagttcctttcccacccataacagtagaagctcttaaagatggggttcttgtttcctttactaacctgtttcctttttttttaatgtactttttttccttacttgatctttctccctatttcttttcacttagggtctgcatgctgggtaaccgcaccctttcatcaagacacattgacgtttgctctaagaccaaggaaattaacaacatgacagtcccatcaaagttatggggattcttctgtaactcgagtcaatttttcaatgccacctgtgatgaatactttgttcacaataacgtcacttcaatccagggcattcctggattggctagtggtataattacaggtaagttagggagttattggacaagttttttcctattttctggggaaaataggccttgtcatcttagattcctctactgtccataaagattcactgccatggtgctaattcccttcttaagcacaccacacagctcttaattcaccatatttctgcttttccattagtaaagctgtccttcttcagtactcctttacagagtgatgtctgctaaaattcacctccatttcagagcagagttgagcaaatcactttctaaccttacggtaaaatattccgtgtattcttgtaaaattgccaatgttcttcctgcactgacagaatagacctgttttaatgtccacatccacatgtatcttcctaacttagctaaattcctgaaacattccttaagtgtcttctattataaatgtttggtctataaatttctttgcacataagtaagtttacattaaggtgttagaaacagcactgatgacaaataataatgggatttgtggggcatttagttttagtctgtttaacttttactaatttgcattagtaaagttaaactatatttgcatgtaccaaatcattttgtcaaattatatttaaattagataagaaagaacattatgtttagctgggcgccgtgggttatgcctgtaatcctagcactttgggaggcctaggtgggaggatcatgaggtcaggagatcgagaccatcctggctaacatggtgaaacctcgtctctactaaaaatataaaaaattagctgggcgtggtggcaggcgcctgtagtcccagctactcaggatgctgaggcaggagaatggcgtgaacctgggaggcagagcttgcagtgagccaagattgtgccactgcactccagcctggtgacagagtaaaactctgtctcaaaaaacaaacaaacaaaaaaaaaactatgtttttatttatgtgtgttttattgtgcaatgtgtgtgtatacatgtgctcatgtagaagcaaacacacctttagaaactgtataaatgaggagcctgattttgaatgtttgggtagaaaattaattatctttttttttttcatactgctgctgcttaaattcccatttttcccactgcagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtaaacacataggctgttgtatattttagaagctgtcagacccatggagtgatttttctcaggaggcagaattctcagggttcctagatttgcttctactctttgctatcagtatcaatatcaaagtgtccaagaagttaacttggttttttcccccttatctctaaaggtatcatggctggatcaaacagatctggagatctgaaagatgctcagaagtctattccgattggtactatccttgccatcctgaccacctcctttgtttgtatcctttttatggatccagtctgagtcttagtcataggagcatccagtagaactagatgatcagtatttttatcctggtaacaaagatacctgctttctatcacttcacttcttgccagattatctgcctacctcatatagaaaattcaaaaaagaatttataggagtatttagcagctcattttactgacagaagaaagtgtctactgagtgtctactttctatctcatgttagagggtaaacaacagtttccttgactctcaatatggtagatttaagcaatgttgtcctttttggtgcatgtattgaaggggttgttctcagagacaagtgagtaatgaatttctttgtaacaattatgtgtgtgtctgccatgacttctgatcattccacatagctccaagacagttacagactcaacacagccaggcaccgtggctcatgcctgtaatcccggcactttgggaggccaaggcaggtggattgcatgagctcaggagttcaagaccagcctgtgcaacatggcaaaaccctgtctctacaaaaagcacaaaaattagccaggtgtggtggtgtgcacctacagtcctggctacttgggggactgaggtgggaggatcacttaagcctgggaagtcaaagctgtagtgagccatgattgtgccaccgtactccagcctgggtgacaaagtgagaccctttctcaaaaaaataacccaacctgagttatcaatcatgactaacaataagaaaatatatgaatgtagttcccaaaggggccagtattttcagtgaatatatgagacagttaaatacagtccttcaaaaaagcagtgaatgtgtctgaataatgaggacttccctgtccatcaagaactgttcagaaacgagaccaaaagtcaagaagggcaagtaaataaaatttcaagtgtctctagcatctcctttatgagagataagtatctaattgtgtttggcattctaaataaaagcctgaaacttactttcttcatattctgttcttttctcttctcttcttttcttttctacttatttatttagagacaaggtcttgctctgttgcccagactacagtgcagtggtgcagtgacagctccctacagcctcaacctcctgggctcaagtaatcctcccgcctcagcttcccaagtagctgggaccacaggtgcataccaccacacccagctagtagttttttttaattttttttgtaaagatggggccttactatgttgtccaggatggtctgaagctcctgggatcaagcaatcctcccaccttagcctctcaaagtgctaggcttataggcatgaaccaacacacccagccctttccgctattattttattaaaatttcccatactacacagatgtatcctctattctttatccacatcactcactttgtacagaccttcaggatttttgcctatgttattgtaataatctcccttttagttctagcctctaatccttcttccacactgccaccagaatgacttttctaaaacacaaaatttgaacatacaaacctccctgcttcagagcctgccaaagcctgttaaaatccatcactgtgatctggccctctctacctctttttactgttatctcctgccattccctcataagctccctaacttagagtttaatatgtcttattatgtctccacgtataaacacatttgtctgtgttatttcctttgcttagaataggttactcccacctggccaactcatattcatcctcttagagactaggctaagggtcttctctcctgtaaagctttcccatactcacccaaacagaggtaaacactccaccttgtgttcagcaactccatttgaatatactatattatagcatttatgatgctatattgcagctacttgttttcatattactctcccctacacgttgagctctttgaggactcgaagcctaacagatgcaatataaatattgttgacaaaaataaaaagcacaatatatatatgtatataacacagtatatgtgtgtgtgtgtgtgtgtgtgtgggtgggggtgtatatatgtatgtatatagtatagtatattactataccattgtagtaggaaattcatggagctttggtaagttacaccatgatataaaaattattattgagagtgtaaattagagtatcattttggaaaattattggttattatctcctaaagttgaacatgtgcttacctatgactcagcatttccacttctaggtatatctaacagaaatgcttgcacatgtgcatcaagactaattcacaagaattttcacagtagtgttattcttatttatttatttatttatttttgcctgcttcattttctcttcataagtattcttaatagccaaaacctggaaataatccaaatgtccatcgctagtagaatgattaaattatatattcatgtaataggaagccatacagcaaagtaagtcatagcaatatacacctccccccaaaaaaattcacaagcaatgctaagtgaagaaaaccaaacacaaaagtatgtactgtgtatcatttatataaagttttaaaacggtaaaactctatagtattcaaagtcagagggctgggtatggtggctcatgcctgtaatcccagcactttgggaggctgaggctaaaagattgtttgaggtcaggagttcccagaccagcctaggcaacatagcaagactttgtcactacgaaagtaaaaaattagctgggcatggtggcgtatgcctgtagtgctagctactgggaaggctgaggcagaaagatcacttgaacccaggaggttgaggctacagtcagtcatgatcacagcattacagtccagcctgggtgacaaagcaagaccctgtctcaaaaaaaaaaaaaagtcaggatagtggagaggaagaaaggactaatgagtggggatgggcataagagagaattttgggtactggcagtgttctgtttcttgacctgcatggtagtaggtcaacacctacagcatgggtgttggatttgtagaaatcttcagatgtgcatttgttgtttttttgcacattactttttttttttcccctagatggagtctcgctctgtcgcccaggctggagtgcagtggcgcagtctcggctcactgcaacctctgcctcccgggttcacgccattctcctgcctcagcctcccgagtagttgggactacaggcgcccgccaccacgcccagctaattttttgtatttttagtagagatggggtttcactgtgttagccaggatggtctcgatctcctgacctcgtgatccacccgcctcggcctcccaaagtgctgggattacagccgtgagccaccgcacccagccttgcacactactttttgtgtgtgatacttaataaaaattgttaaaacgagtaattaaactgatgctatgtttcacccatcaaattagaagtgaccttaattttttttaatacagaagactggtgtggagtgtgcatgtgccacaagacttgaatcttcttatatttccagtgggagtaaaatttagtacaaactttctggacagcagtttagtagtgattttgaaatgttttaagatattgatccctttggttagttattccctcttaagaatctgccataacttagctgggcacaatggctcatgcctgtaattccagcatactgggaggccaagaggggaagatcacacgagcccaggagttcatgacaagcctgggcaacaaggcgagatcctgtctctacagaaacttttgtaaaagattagtcagacatggtagcacacacttgtggtcccagccacttgggaggatgaggcaggagcatcgcctgagccagagaggtcaaggctgcaatgagctgagatagcgtcactgtactccagccttggcaacagagtgagacctgtctcaaaaaaaaaacaaaacctgccttaaggaaaaaaacctgaactgtgaatgtagatatgtgcataaagatgttaattataatattttatataatagaaagtcaacactagaagaatggataagaaattgtgatgcaatattattcaaatcactacaaatttttattcatagctttttatgacatagaaaaatgcttacatttcaagaatacagaattatagtgcagtgagatcgcgatttttctaaaaagcagatattttgataccctgaaggggaaagttacaactgaagcttagcttattttctagccccatatgtatttttttcctaatataggtcaatagtgccgtttgatcaaatctggctatcttatatttcgtaatattatttgtctcacttttgattctctaaaacttagaaaaaaaaaactgggtgggctggacgcagtggttcacgcctgtaatcccagcacttttggaggctgaggcaggtgaatcacttgaggccaagagttcgagaccagcctgggcaacatggtgaaaccccatctttactcaaaatacaaaaattagccaggtgtgttggtgcacacctgtgatctcagatgctcaggaagccgaggcaagagaattgcttgaacttggggggcggagtttggagtgagccaagatcacaccactgcactctagcctgggtgacagagtgagattctgtctcaaaaaaaaattgggtgaatatctctagtctttcagtctaaagttatttccagattaaatttcccactcctatttctttcccaggttcggtgatgctgtgaaaggtaatttggtggtaggcaccttatcttggccatccccatgggtgattgttattggctccttcttttcaacatgtggggctggacttcagagcctcacaggtgcaccgaggctgctacaagctattgccaaggataacatcataccgtttctgagggtgagtgaccttttattatgccctcttctttttttcccagctttaatgagaaacagtgtggtcttcatgggcttagaaattactagatcataaatgtggagacgtgggtttttagtacaagaacctctaaatcccaagcatgagtttacctgtgagtgctgtaaaggtatttaaaaggtatcacagttgtaacactgttgtcttccagatgtctgaaaactgtaggctagagaaatcagagagcaatgactcagtactcctgtgcctgatatttcccttctgtgtacaggtttttggccacagcaaagccaatggggaacctacctgggctttacttctaactgctgccattgcagagcttggaatactcattgcctccctggatcttgtggccccaattctttccatgtaagagccagtgattctcttcagttattcttgcttaaatgataaataatacatgtttatttccatcagtcatataacagtagtgataacagagtgggctaaatacagatgtaacttcacttaaataaaaatcattcctgagaacttccaagtaaggctaacttttgtaagttattaggttttttcctacctatttaacttcaaaagttctttggcttcatttctaattcattgtcaattggttgtagcttttaccaccactgttagtttttatttatttattcacctatgacttattgatgcttactacttacctggcactgtgtaatgtggtattctgggaatacaaagatggataagacacaatcttatggaactgataatggataaggaaaccaatgattcccatatagcgtgatgagtgccatgataaaggtgaacactgagtgccctaggaacaccagagcaaggcatctaaacagatggaaactcaagaaagattttccggaggaagtgatacttgtatcttgaagaataactggttatttgctaagaaaataaggggtgaagaacattccaggcagagaatgcatataaaggaattgagggatggcataaggtagcacatccagagaactggaagtagtttggcttggctagagtggagggtacatgttgagggaataacagaatagagaagtaggtagacccagatcacaaaggtcctggaacttttacctggaagtagtgggtaatccttgagcacaaaatgataatgctttaggatgatcaatcttgtataaaagatggattagaaggaggctagaattgagctgggaatgctaattggaaagaagaaatgagagcctgaactaaggtgattagtagtagagatgaaaaggaagagaagcagcttaagagatttttaaatagaatccataggacttggtaagtgaatttggaacaagggtaaggaagaggaaacctggattatcctaagaacaactgggtaaagagtggttgtgtcattgactgagagaacagagaaggatgaacagttttgtggggagaggtttaagtttccctacttcctacttaatcaagggttagttgtctagaaacaggcttcaatacagcaaaggtattcagttacttaaccttcaaagaatcatcttccagtaataatcattcctcttactctttattcttcaggttttttctcatgtgttacctctttgtaaacttggcatgtgccttgcaaacattacttcgaacacccaactggagaccccgattccgctactaccattggtaagtctgcttcttttattctttttactcacgtttggagagaacccatctttgaactagaaaactaggagagtctgggttctcgataaaatttttttcttggtcagccatttcatactgtttcaactttcaattcttatctgaatcctcatcctcctatcctattttcctatatcactttataataacttataacacccaatacgaatagagcaaaagcactaaatagagatatccagccttctataattttcaggttaaaacaaccttctcttgcatgtttattttcctgtttgtctcttagggttacagagtcagaggttctaaattccaatctcagctctactatttcctagctttgtaaccttcagcaaagcacataaccatgtaaaatttaattttattcatttgtaaaatgggactaataaatctaaagtgcttatcgtagtgcctgatacatagtaaagctcagctctcaatgaactgttgctgctgctgctgttgtagttaagtctccccagtcctgaaggggtcatcatgaaagatttttggctaccatcccatctctttcctcttatagctcagagctcattaattatgtcctgtatgtacccgttgctacattcttctttgctaactttctccttgttccctttctgtcttcacttaccaatggtgggcagtgatgtaacgtttactgggcaaaaattaaaatcttcaactgatttttaatgcctcaaatcctctttctagctttaatgttagttagaagttctttatgaggccgggcgtggtggctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccaaagtgctgggattacagctgtgagccaccgcatccggcccaaaaataatttttctcagtgagttctgcagttatgctaataagtatttataaaatttttagaaatatttatatgaaattttttaaaaagatcctagagttattaacatttctggctgcgtgtcccatcctggctttgccaagtaagtattaattgtcctcataactgcagatgactgatagtgttccgttatttatatggttttccagcagttggaaacatcttctgttgcaaaggacagtttggggtttagtgcacatctaccgactgtttcatgataagacaactatagaattgagaataatcatttagaaacttttgtggcagtttgacattgctacagcatccaggcatgtgataatttttcgaataattcatttttattgcattttacaaaagttctatttataatagtttcaaagtttttaaaaaataatacctcaccacagatagtttgagaagcacctttaacataggcttctttttcagctactttaaaagatacttttttgtttttaattttctagggccctttctttcatgggaatgagtatctgtctggctctgatgttcatttcttcctggtattatgccattgtagccatggtaatagctggtatgatctacaagtacattgaataccaagggtgagtgtggatttaatcttgatcactgctaaaagtagcaagactagctagtttggttagagccagctcagtgaaaatatcttaaggactcaggtaacttcattttcataactatattttgtacccctaattctttaaccatcttaatgatgcaagcttttcatcacaagggagatccattgagaaagtatgaatggatcaatggaaaataacaaaggacatttccaaataataataattagtactaaacaaagtacaacacaaatgtaaatatttttgcttatctcttcagtcaaggggttgtctctgaaatgaaaaagaaattagttctgaacaacttagtaactactaagacttacagctttcaaaaatgaggacgaaataacattcttattcagaagatcacattgaactttactttctctgcattattttcaaagtaacttaaactccaggtctgttataattttctaatctaaattgctcttttacattattgttttgaacaattacatagaaggactgaatgagtgaccccttcaggctttattgggaactgtttgtgcagtgcagtctgttggtgctgttgatctacctacatcaggttcattatgttagtaaagaacattatgtaaatcattaatctgagctttaatcttctaccttgcacatgtgtgatttttagattcagaaaaaaactttattttttaaaattatacttactatagtttaaatttgtctctgctcttttctttttctcacagagctgagaaagaatggggtgatggtatccgtgggctgtccctcagtgcagcccggtttgctttgcttcgattggaggaaggacctccacacactaaaaactggaggtaaagaaatcaacactagcagtatttggcacatggttaacacacaaaaatatgtgttttgttgattttaggataaggaaaccatatgtggctcaaggaattggtataatggacctgttttgaactattctaaatccttaatttttttattcccttttcttcatgtcgtttatgatcaagatttctacaatttattattcttccttgaagactgatcaacttgagatagtactgggagcattcaaaataatgcccttatcctgtcatctcctgtgatctcttccttctgtcaaattacctgtttcatacagatctcctgaattaaagggtggagtctgtcattctgttccccaaacccaaaatgttttctcctcccctccaacccccaccaacctcttcacaggcctcagttgcttgtattactgaaactagatgaagacttacatgtcaagcatcctcgcctcctcacctttgcctcacagctcaaagcaggaaaaggtctcactattgtgggctctgtcatcgtggggaacttcctagagaactacggtgaagctttagctgctgagcaggtaagagtcaggcttttgaggtattggaactcagtttacagctttgtgatgttaagtagtaagacctcaaacttctacttgaatcttgttcctgagtgatctaggaggtttctcacttagtgctgacctttgaaaggacactttttcccaaataataagatgagccaaaaatagttatttattatttcttcctgtttaaagcattactaaattataagattattaagtctaaaccttatgttcaaatatactccaaacattaatctaagcactgagaaaagtcatgtaaataaattgatcccttgaactatggagagggttcctctcaatcttgtgacaacaaggagtaatgaccaaattttcttcctctttactaatctacgtggtatcatgagcaagattcctttgccacttctggttagctgtattgaacattaaagttctactttaacaaggaagttgttttcactctaatacttattatatatgatagaactaatcctattgtttttgaaatgccattgtgttcaatggcatttcaaaagttttactgtggggggaggggggaaggatagcattaggagatatacctaatgtaaatgacgagttaatgggtgcagcacaccaacatggcacatgtatacatatgtaacaaacctgcacgttgtgcacatgtaccctaaaacttaaagtatttaaaaaaaaaagttttactggatttcattttggaatcctttgaaatcctaaacactagaaatgctgaagaaacattactccagaatgatggtaaaaattaataaaaggtacacaggattgaaaatcaggagagcctagttcttagccgcatcactgatttaatctgtgcctttgcaaaaatcattccattttccataccattattcccttccttttcccaccaagagggtggagtaagagtaaatgagatgatatctccaaattggtttgactaaataaaggaagagtaatgcaaatacaagtgtcatgaataatcaccattaaaatgtcaaaaagcatatgggaatgggagaggcgaaaaagaaaacatacctgagaaaattctaaagtgaaactgaatcatcatactgagtttctggtaagatgagtcagggcatgactggggctgaggcaggaaggagatcgtgttcacaatagtgaatcaccctggtcaactgagaaagaatgttgaatattcactttgtagagatccctgttcccagttttttggtatggtgcaaaggaacaaaagcagaacagaggaaaaagcagagaaactacatgtagacaaccagctacagaggcaaaaatacgtagtaagcaaaaagacaaaagatcatgaaattcctttgggataattttaactttttggacttttctgtagatgatatagtattatgaagactttggaaaaaggtgggggatataatatggagaaggaacaatgggttaaaatgtccagagtgaaccagttcagtgttgcggtcctgtgtctctttcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggtactaaccatttctcatacaaacctaaaggcccaagtcgagggtatatagttaaatctctgtcacccccagcctcctaaagtagagactatgccattgctgaagcatagtcttataaggcaacctgaaaaactattggtagtaatacccagattctacctacccccttcagcttcacattatgttcatgaattatttctgtcaagtcttgtgctaggaattatctccaaaattgccgtgttttcatttgtgattttccatattgatgttctcacaggaattgcaagaattgttcttcagcatcataatctctcaaattcacatatccccccttagaaatgtagtaatgggaatatacctagtaacataaactgtggttctcagtctgttagctattcagatttttcacaatggtttttgatacgtaatgagaaataacctactaagtaaataggaccccttgctcaaagaagtgtgaaaagagcatttccttgctttcctgacatgctaggaagcaaggcaagcctaaggattcttctctgcttattcttttttctccctaggcacagttcgagtgacaactgctgcccatcttgcactgctggtggctaaaaacatctccttctttcccagcaatgtggagcaattttctgagggcaacattgatgtgtggtggattgtgcatgatggggggatgcttatgctactaccattcctactgaaacagcacaaggtattttatacaactttttttttacaaaagtctttctcccttctgtcctggttcacaggacagacaaattcttcctctgattataatagtgttggggtttagaatcagaagagttggaagttattctaggctttcccatgatcccactttcaaacaagagaaatcattgtctttgtatttgatacctacttatctccaagtgaaattcagccaattaataaagttccatatgagccctaggggaaaacaacaagtgaacacatctttttttaaaaaatactgaaaacttaaggtatatgtatatgtgtgtattgcacgcatatatgcgctcattccgtggtaagactaattaaatgagatttaaaatagtaaatatatagtctgcatgttgtcattgatacactgtctgaataaagtaccctcttaacgtatcgtgaaccatcttttcttttgccagtgttttcttgttatgaaattaaggactccttaaaactgtattaaatgtggtgtttagtcaatcttttgccctaatacaataacatagcaagtaggaagctaggaacaaatagccttatactacatatagcaaggttcttctagaccacaatgtctaatgtcttaggaaataaccttttttgcctccttgctctaatttttcacatgtgtatgtcactctctcaggtgtggcgaaagtgcagcatacggatcttcacagtagcccaattagaagacaacagtatccaaatgaagaaggacctagccaccttcctatatcacttacgcattgaggcggaggtagaagtggtggagatggtgagaaagctgagtttgagatacaagaggttcattcccccattcctctccctgtcttccttgaatcttttctggtttgggaaatttttcagatctaaatgtggattaatcccctagtgccaaaaaaaaaaacaaaaaaaaaccctaatttgttgccctaagtagaatgtatatgtgatgcatgtttgatgttattttttggttttgctttcttgtttattacacagcccttatatttctgccagattctcatctgcttaatatagttttatgaaatttttattcatatattcagcttaaaatcacacatggcttttaaaaaaaacctaacagtataaaaaagagagactggagtttgtattttgtgtttcaaggcaacacatgtcttggttagattatggaaaagactctcagggcctctgaattttatctacagtcacaaaaacatttatgtagctcaatgactaaacaaagtaagggtgaagcttaggttaatatagtgatgctgtccctggtttaatttagtgactggaaataaaaatgtatggttcatccttctttctcctttgtgctttttgccccttttatgtgatgtctatggcagcatgacagtgatatatcagcatatacttacgagcgcactttgatgatggaacaaaggtcccagatgcttcggcacatgcggctatccaaaacagagcgagacagagaggtgagacattactgcatcaatccaatccgtgctctctaaagtctgtcactgaaagggatgatactgggctgggcatggtggctcacgcctgtaatcccagcacttttggaggccgaggcgggtggatcaagaggtcaggagttcaagaccagcctggccaagatggtgaaaccccatctgtactaaagtacgaaaattagccgggcatggtggcacatgcctgtaatcccagctactcaggaggctgaggcagagaagtgcttaaacccaggaggcggaggttgcagtgagccaagatcacgccactgcactccagcctgcgtgacagaggaagactctgtctcaaaccaaaaaaaaaagggatgatactatattgttttcaaggatgacaaattccttctcactctgtcagttattccactataacccattactgcttcaaaataaccaaagatgaagcataagagaaaatttggtagaataacttgtgttggaccttcttcctcaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccgtaagttttcccactcccaagtttatcataaaattacctaatcagtggcacaaatgtgactttgcctggacacacaggatggagtctgttcatttcaccctgaatctagccacctcattattgtttgcctgttcatactggctcccaatgaacactgtacacaagctaaccatcccctctatccacatagttcacctccatactgtgttcttactataaaataagccaacagagaatgagaaaacccagatattaatatcataaagaaaccattttagcctgggcacagtggctcacgcctgtaatcccagcactttgggaggcagaggcgggtggatcacctgaggtcaggagttcgagaccagcctgcccaacatggtgaaaccctgtttttactaaaaatacaaaaaaaattagccgggtatggtggtgggggcctgtaatcccagctactcgggaggctgaggcaggagaatcacttgaacctgggaggcggaggttgctgtgagctgagattgtaccattgcactccagcctgggtgacatgagcgaaactccctctcaaaaaaaaaaaaaaaaaaaatcattttatcagattatccatagtcaagtgaaaaagctcaggatctcaagtttttaacgttgactttatggctagttgtctttttaccttaacaacctttatttcttccccactcagggaccagtccaatgtgaggcggatgcatacagcagtgaaactcaacgaggttatagttaacaagtcccatgaagcaaagctggttttattgaatatgccagggccaccccgaaaccctgagggtgatgaaaactgtatcctttccaagagtggggcttccagtagggaaaatctccttaacctctttctgagataactaggtaacaataaaagtcattgtctatgccccactttccctctttaaggaagggagacttaaaagtcctaggcaaggatttttacaaagttataagattaaactcttttaggggagttggggcaaatataattcagttctagttttaggtggtgtatttgcaacatgacatctaatattcagtgtataaaacccttcctgacaatcctacagacagcatacccacatcctttcgcctttttaggttctacccgctttgcaaagcctttcttttggatagagttaggggagaagctgagatagaacctcctttaactgaggggaaaaaagagatagggattcttcctcataccttcatcccaggactcctgggatacgggaaacccttcagcattgacacataaattagcttattcccaccagtaccattaagaaagaagaggtttaggccaggtgtggtggctcatgcctgtaatcccagcactttgggaggctaaggcaggtggatcacctgaggtcaggagttcgagaccagcctggccaacatggtgaaaccccgtctccactaaaaatagaaaagttagctgggtgtggtagcaggtgcctgtaatcccagctactcgggaggctgaggcaggagaatcacttgaaccaggaggtggaggttgcagtgagccaagatcgcaccattgcactccagcctgggcaacaagaggaaattctgtctcaaaaaaaaaagaaagaaaagaaaaaggtttaaaaagaaaaagacaaaccgaactggcagaaaaatctgacttgagcagcttcacttagaaattacttgggttctctctaggaatcttgttagctgccctattgtggcttttcttcttctttcatcatttttatcttatttagagtaacacttctaggttttcccattttttaaatacacaaatgggagtctggtattatgtatgcaaaaggactggatctctggttacttcacagggttaaattcaatccaaagttcagacttttctgaatatataataattaagcagctaattttgtagctctatgatcagataacctcagattatgatgatgccaggttttaagtttgtgctcttcttttgcctgtctccttgacaagttttgaagacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaatactgtgtcagtgtatacttcaactgttttgtttctcttaactcaaaacccattctgtcattgtaacacaggcagtgttaccatggaaattgtttttggtaaggtaaaaattatttctttcaggttcctttcaaatggccgaactaagagaactccaaaaggaagctattaacatttactgaaatagtctgtggttctctatacaacatggacaaaacatacaagctgttgtctaagaaatgcaggtcatggtgcacattaatcaacaggttcttctccccccgcccccacccccgcgcctttttttatgccctcttattaagcacaggtcaaaaaatcttaaggaacaaatactaggaaaactggctaaacatccttccctgaaagcactggaccatcttttaaagggcacatctagcaatgggattggaagttctagagccacactctttctttagtgccaaagttactgagcggctactctccttacctactttactaaaatggcatacagattggcattgacctgttgaagaaattttaccactaagaaatcttttgcctcatctacaaagccatagttaagacttgaggcattcaacttaatgccaagtataagcatttccccctttttctttcaattttattcttcattctgactacagaaacttggccctgaactacgagattagccaagccaacagtcttctaatttgttttcagaaacttcaggccgggtgccgtggctcacacctgtaatcccagcactttgggaggccaaggcaggtgaatcacttgaggtcaggagttcgagaccatcctggccaacatggtgaaaacctgtctatactaaaaatacaaaaattagccgggcatggtggtgcatgcctgtgatcccagcaacacggaaggctaaggcaggaggatcatttgaacccaggaggcggaggttgcagtgagccaggattgcacctctgcactccagcctgggtaacagagtgatatgtttcaaaaagaaagttcagtgtgccaaggaaatacttgtgtaagctcagctttttatttactaatatactgatcaaacatctggcttacaagcatagggaaactacttatgtggctggctgagcagtaatttcaagtatgtgaaatcttcatttcttttacagaatagttatttagagaaacttttcttgcctgtattcatggctgtttttgaatttcaatttattagtcataaatagtgccactcttctttgattactaaataggacatggagcaagctgacctaggtgtcacaaattattcatttgacctgtaaggacagagaaaacccttcaatatagcttaagaaattgagtaattttgggccgggtgcagtgactcacgcctgtaatcccagcactttgggaggccgaggcaggcggatcacgaggtcaggagatttgagaccatcctggctaacacggtgaaaccctgtctctacaaaaatacaaaaaaattagtcgggcatggtggcgggcgcctgtagtcccagctacttgggaggctgaggcgggagaatggcgtgaacccgggaggtggaacttgcagtgaaccgagattgcaccactgcactccagcctgggcgacagagggagactccatctcaaaaaaaaaaaaaaagaaagaaagaaagaaattgagtaattttgatttgttccctttgcttgcttcaacctccaggcccactgaggatggcaaagcggataggatcttaagtctttttttctgttacttcctacagatggtag

SEQ ID NO: 16280 - DNA, 8401 bp, Human
catgtcatttttctttttccttctcaaaagttcaagatcctgcaaaatctgttttccacagaggagatgatatctgtcatttatgccaatgcttctcacactttaatgtacataccaagcaaatgaggatcttgctgaaaagcggattgggatggctcttgagattgcatttctagctcatttccaggttatgacaatactgcttgtccatgggctgcactttgagtagcaaggattggtgtagtcctatagtttaagttgttgctatgttctccatcaaagtatttgcctttgcagtcttgtctccacctggagtgagggcctctgcccccagtttaaagatgctcatctccccaccatcaagtgggcaagctacttttggcatttgttcctttattcactttggcagcaggggatccttttctggcctgaagaccagagtctgaatttgagcaaaaccctgcagcatggatgagggctacccaataactgggctggggtaaacctggtcccttctccagcaagacttggccaagctctcacagaaacccttttctgactcttccctggccagaccctgatccatgcatgggttggaactcgggtggccttggttaatctcagctttctgacctagatgagcccagcaccagctctctgagtaaagccattcaggctggcggggactagaccagaagggtgccctgtcctgggtgccccttttgcagccactcagatgtgctgctgcggtgtcctttgtgctggtggcagccctggaagatgagaagccgctgttgctcccctgctgccctggcccagctgtcaggacccctcagcagagggcagggcgccaagccttcccactgcatgtggcttattgtccccaaggctggcagggctgcggaggaccgaatccacagaccatccagggagcacccacaccccagaaagggggaggggtgggctggcgtcacttagtcttcccctgccccctacccttcagcgcctgcccctccccagctccctatttggccatccccctgactgccccctccccttccttacatggtctgggggctccctggctgatcctctcccctgcccttggctccatgaatggcctcggcagtcctagcgggtgcgaaggggaccaaataaggcaaggtggcagaccgggccccccacccctgcccccggctgctccaactgaccctgtccatcagcgttctataaagcggccctcctggagccagccacccagagcccgctgccgccggagccgagccgacccgccccgccgacggtgagtcagcgcccggccctccgcgttcactcctcgcctggtccgcgggccgcgccggacgccagccccgcgccgccacctggccagcccggcccgcattcagccaaggccccagctcctgccgctctgcgactgcctttttttttttttttttaaagcccacactttttgatttggttctaacttgttttgtcctgggcgttggtcctcgcaggacctcgcaggggctctaagaaggggaattttgtggctccccaaggggcttttgggtccctactctcgtgcgctttcccctccatctggggcacaggcatggcgatatggacagggctggagatcgagttcccagttcgtgaaaaggaagaaagttaaagggctggggaggactaaggggctgggtttcttgggtccctccttgcacctggcaccctagctggaactcctggccagggagcctgggtggattcctctgcccttctctgtccccagtctcctccgcggcttcttccctcccttttatgattcgaggggaagggaggtggcaggagtgttccccgcccaaccccctgtccagtccccacaacccccttctgctctgtcctgtcctctgggtgcggagaaggccagctgcacaggcagctaagcgtggtccgccctcccctcctcaacctgcagaaccccctgaagctgtgccaagatgtgtgacgacgaggagaccaccgccctggtgtgcgacaacggctctgggctggtgaaggccggctttgcgggcgatgacgcgccccgcgctgtcttcccgtccatcgtgggccgcccgcggcaccaggtaaacttcccgccgagccccccgtcccactcgggaccccttcagtccagcgatctaggaaatggctctcacctgaccctcttgttcgatgaactctttaggccaaattaagagaaggctgattgacttcaaatccaagccaaggcaagcaatactccacaaaaccccaacatactgaggaatgtacacctgagtggcacgcctctaaaagggtcccactccctggtgtgaaagccacctgcttctctccactaatggccttttggacttttagtctttagtgtcttctctgccttatacacttcattttcttccttgtcctctcttttcagtcctgtttaaaacttctaacaatatcacctctcccaaccaaccaggaccaaatccacattcctctctcatgttcacagccagtttacagggttccccaaaggtgtaatcaatctatctccttcctggctgttgcatttttagaagccaggcgtgacagaggcagcaagtgccatggtgatagcgacataccacctcgtttgttaaaagacatgccatgctctctgggtttgtcacatgcctggccagacaggctgccaagcaggagagcttagtcctcagagctggtgaatgactccagaacagctctggacaggctgaatttcactgttggagtgaggatggcatatcagcccatcattatgtgttcacttgaatgtcaaaatctttttcttaggagaaatacaatgtgtcattaattcagtcattccaaaatgcagtcatctatattccagttgacatgggtgatgagcttaataacttaatgaaggcatatgatatttttaaggtgaggtgaggctctgcttcttcagtggaatagcttcattctctcctgagttatattctcaacaatagaattatacatctttgggggagtggggagaaggtagaagattgatttttaaataattcttctaaattggggtaaaatcgtattgcttgttatttctggtatttaaatatgttccttgacttgggcagttagatataaatggacaagacactgattatattcctgacatggtgagagcatgattttctcattttttcttctcatagggagttatggtgggtatgggtcagaaggactcctacgtaggtgatgaagcccagagcaagagaggcatcctgaccctgaagtatcccatcgagcatggtatcatcaccaactgggacgacatggagaagatctggcaccacaccttctacaatgagctccgtgtggctcccgaggagcaccccaccctgctcacagaggccccgctgaaccccaaggccaaccgggagaagatgactcagatcatgtttgagaccttcaatgtccctgccatgtacgtggccatccaggcagtgctatccctgtatgcttctggccgtaccacaggtatgctgggctctggggacagttactgatgaatcacattcccaagtcaccgaccttgctgtgaatcagatcccccagttgaaaaagggataatccctttcctcccattccctagcaaggtctgtgctaagagaaagagttaacagtagtgccctgaggttagtttcggagcacaattattgttggagctgatagcttgtggagataggtccttccctcatttaaagctcagcgcagtgtagcaacttggagtgcagcagtcattgttatgtgtttaaaccatcacatcacctgggcaagcatccccaaggagaatacattccatacagggtctgagtcaaaagagagagaaacgtgtaagttcaataggagcaaagaaaaacacccttgggtgcttacataatgtgctcgtggctgacaagaaagatggtcatttgaaagtgtcctcgggaattttttctactataatagttaaaaagatgagctgcagtttgcttcagatttagtattcctgatgcgcatttttattctttgtgtgtaaggaatctaattttatctggatcaatgcccattgctagcatctcttagccaagattggaagcgggctttgccgtggctagagcagtggtgttgtcctcaggaatttaccttgttcttgtctacttccccgggcaggcattgttctggactctggggatggtgtaactcacaatgtccccatctatgagggctacgctttgccccatgccatcatgcgtctggatctggctggtcgggacctcactgactacctcatgaagatcctcactgagcgtggctactcctttgtcaccactggtgagtgtgtgtgtctcatctgccacagtgtgggtctgctttcctcctctctcactgaatccgcctacctccctataattgacttcttgcttcagagcatgactgtgatactctttatttctgtagctgaacgtgaaattgtccgtgacattaaagagaagctgtgctatgtcgccctggattttgagaatgagatggccacagctgcctcttcctcctccctggagaagagctatgaactgcctgatggccaagtcatcactattggcaatgagcgcttccgctgtcctgagacactcttccagccctccttcattggtgagttgtagggtctggtgcagaggcacgattttccctggaaatcttagggtctcccagagtaaaatctagaaggctcaagaagcccttgagttaaaagaagtcatagtttggattcccacacagctcaacctcaagtcctgatggctcattaaaggggaagtctatgttctgctctagtgatataataaaggatgacacactgagttcatctcaaaataaaggatgacacagagtagtaactgaatagcacgtatctgcaggaaaagggctagttcacaagagctgacttattcccgtaagtttcactaccaagtagctggactttccaagttcctcatcattaaatgcaataacattcctactcatattaataactgggcacttatatgtcaacaaatatccttcctaagcaatgctttccataaggaactttgtcaggatctgatttaagtccataaacaaaaattacattcattttagtttaaacgtgtatcttttccttttccaatacatcttcatacatctgagagtttcaggaggtgtttacttgaaacaggtgctaagcacagttgctcctttcttggcattgtattgtggattaactgtgaggcacccattccaccctgcagtgtgtcttataggggaacatatgtttcagagacaaatggtgacagctcccccacacaaagaagttctgttctcttccctctaccttgacctgaatgcactgtgatgtgtgtgtgtgtgtgtgtgtgtgtgtgtgtgtgtgtgtgtgtgtgtgtgactcgttcccaggtatggaatctgctggcatccatgaaacaacttacaatagcatcatgaagtgtgacattgatatccgcaaggacctgtatgccaacaatgtcttatctggaggcaccactatgtaccctggtattgctgatcgtatgcagaaggaaatcactgctctggctcctagcaccatgaagattaaggtaaagaacttttgtgagtgggagatccgaggcaagtcttggtattctaagcagaactacgttccaaattccttttccctcatactcagtttcttgtctcctacaaactttacctgttagcttttctaccactttttctgattttcttagcacttttcccaagataggtaacttccaaaatgcttttaagcagtgaataaaaataaatctttgacaaaaaaaagacacacacacacgcaacaaaatctttgaatacatttttaaagctcccaacttttgggctaggctccactacacatttagcttgttgccaaattacactctaggtaagtggagaaattccattttaataatagaatatatctttaataatataaatgatgaaatagaggtgagttcatataacttgattggccacattatttcgtggtatgacatatcccacattatagcgaattaatatctaatggtttttttctgtgaatcctcccaatgtgttatttgctcccttgcttggaacttcagagttcactggaagtttttgttttctttctgcagattattgctccccctgagcgtaaatactctgtctggattgggggctccatcctggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaacctataaaagcctctcgtttgtttttggggtaggcgtggggtggggcaggtgtttgctttgacaccctgagcattgtcaaagttcagtaccacaaggttcatccagatgaattaatatgacagttagctgggagttataatgctaacttttgatttcatattttgagacagaatcatgaatatatttcatacctgaaaagcagattaaggtttagttccatataagtaagaaatgaaattgaataagatagttctctagaattagttgctgcagatgacactgaagattattttaacatatgttccagttgtttttgtaaccttgcagaaaatacacatatattgataatgagaaagtcaaagattattttaaatgaattggcttaacttttcaattctttgaactcttcaattttcttcctgggggctatgaaagaaacatgaaggttagctgacagttgggccagccacatcccattgcaaataccctctaaacatatcaagaccattgtgtgtgtgcaaaacaaatgtgaggaagcaggagccaaacacttctgcctgatcagtgactaacttgcgagacagaagccttcaatctcttcgtttctttgaaatcttgagatcttgggttgagtgaactgaaggctgcgaggtcctgagggagcaaggggaggcgagagccacagtgtttgctttgctctgtgcagagctctctgcaaagtatggtgggaaggctgctaggggcagcgttgaaaagaattgaatgtgttccatcctcgaggagttcacacacctacacataatcccccagtgcgtgtggcctggaggctttaaggagatgtatgtgggtctgggtcttaaagaatggtcaggaattagggaggtgagaagagcagagaggacatctcagcagaaggaagtgtggcagaagccaggatacaagacatggggcaggctggtaggtgctgatgaattttagaaaatccactgggaaaggtagatttcaactagattgcagaagccttacagatttttgttttcaaattaattgccagtgaactgttagcattcacagaagtgtttgaatagacttaattgaattttattgatgaggattcaagacacagagattaagcaactggtgcaatgttataaactttatttgtggaatgtgctagacaggaactcagattttctgacacctactctgatggtgtctctaaaataatctttctaactttatagtttatcaagggtaaccccattctatcacatgccttttgagaatttgggttcaatatttggagtactctggactcatcagacatctttaataaattgtaatacattgccactgtcattcaaggtcctatgtgtgtctttttgcctattcataccaaaaatatcttttgatccctgactctgggtcgggcatagtattaagggcaggggacacaaagatgtatgagagcacattttctgtgaataaaaagctcagagtttggagttctgtatgtagcatattcaaatggaaggccttctatgcaataaaggctaaataatacatcaacttggtggcattttatttagataaggtgcaaacattattgtacatatgccccccgcccccaccaccccattgtatcctatagcacagttgaactggtttaaaagccatgcatggggaggtatgatttcactagtttttgtgtctctttcttttcctctgtacaattgagtgcataaatattatgaattgtatcctctgaacacagtattaatgctttaactgtagatgattggctggggtatcacctctggt

SEQ ID NO: 16281 - DNA, 28560 bp, Human
  misc_feature (1)...(28560): n = A,T,C or G
gcctcacagtgacccctgtcccatatcaaagacagcccccagtttcattttatccatgtgtacactcaagttattcccaggctatgcagagccaagagatgtaggacagaaaccatacgtgatgtctgggaagttgatctctcccaggatctcacaagtgcttttcagctcagggatacaccccactcttcagactgggaaagtaagcccctgaggtgtgccacgagggaaaagctgcagctccagtgcctctcttcgcaggcccaagagctgcggtgcacctgggacctggaattagagagtggtccctgttcagcatctccccgaggaggcccaccaacaaagagggtgtgtcttttttttttttttcttcctattgagggtgtgggataatggtggaaggaacatgcaaagagggtgtgtcttaattagcactggctttagggaacaaggaaaagggagaacccgggagtacgggaaggaggctggggcagacaggagtcagaggcccattccagcccaaacgagaagccagtgagcaaggtggagaccagggatgctgtgaccaaagcagagaggaatgggcggggtggtgctgacaccccagccccgttctgcctgccagagccccacttaccaggcccgagtccccagaggtcccctcctactccctgctcgattcccttcctcagaggcaggtctgtggcttggctgggaactccagggactgagggagcactgcagctgtgggaccggcgcatagctaaaagccggcgggccatagggccccgcggaggaggccccagcaggcggaccaggaggccgaagcctcccgacgctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtcgcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggccgggggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggcctggaccgccgctactcgcacagtctgtacagcgagggcacccccggcttcgagcaggcctaccctgaccccggtcccgaggcggcgcaggcccatggcggagacccacgcctgggctggtacccgccttacgccaacccgccgcccgaggcgtacggtgccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtgagtacggccccggcgcccctccggccgcgcgtacccctggccactggaaactgctccgggccccccgggcccctccttagaacttcctggaggcctccccggagctgctaagcacggagcagcgccccctcccgacttcccccgacccagccaacagcacccccctggcatctcacctcccagcttaacccgcacccaggcatcatcagtgccaggggttggccaggcaggtgtgggctctgatcctggctttggtggagggactagccgagctttgggaggaggctcgccttctgcacttggcttgggtcatctgaggacaaaaggaaggagcccctcatccaccttctccctcatttcaatgagggcgtctccttccccccttagagatgttctatgccagctcacagggtgaggcaaggagcatcagaaacctgagtcttcagggccagaaaggccttaagggatgcccctggaggtgtggcaggctgcccattactgggcatgtgtgaggttggcttgagtgcgcaggaggttagaggggagcgtgtgctccaggcaggagtccggacttcctcaggggagtctgcaaggctggggcaagagagaccagtcaggcactggcctgggtgcagaatttcaggggctaccaaaaaacacagtagttgagatgagtaatattgagatgtatttttttaagtcaaaattaatgcaaaaaaaaaaaaaaaaaaaaaaacctgtgataaaggaaatatccagattttaaatagagtcagtaatagtggtatgccgagccatattggagcctgaggctaactgaaaaatcagcaacacggatcctgtctttatttgatatttggatattttgttcattacagatagttttgcattaatttttattttaaaaactattgtgttaaatattatttatctccgttactgagtttttttggcaccccctaaaattttgcaccccgaggaaaaaaaaaaaaaaacacctcactggcctcattcccctcaccctagtcctggccctggcggagagccccagctgtggacaggactccctctggcttttcagggggtgaacatacgtcctcctcttgggaaggcccaagccctctgcacatgaggacacagtggaaaggcagcttccacacatgctgttagcagacagggctactgtgacaagggctgactggtgggtgtggccagtgctggacggccatcagccattctctgctgtcctagaatccccctccctgctaccctctccatacaggcagcttttgggccaaggttttctactcagtccccaatacttatgcagtccaactctgccttgcctctttcaagctgtcgtcagtttcctctacccataattctctgctccccattgaggttgctgtgcctggcccaccaagtaagggctgactgagccctccagtgcctcagagtataggtgctagtgccccagcctcctcctcagcctctgtcagcagagggatgatgctttgtctccagccaagctgacctcagtgaggggctgctgctcatggggtgcctgtctccctgggtactgctggaggccaagactaggggagaggagcgtctccactgggaacactcactctatcacatccaaggtgtcgcttttgagttgtgtgctgaatcccactttaagaacctgcaggagctcaggaaaaatcagatggcaggtccttctgtggtgtgatgaaggatgcatccacctgctctggtccttaccaggtacttgcagcatccctgcagaagggcgcattatagccatgcatcagctgctctagggccccttggagaataggatgttttacctagagggtgctaaacttttgcagtggcttttcttagaatgcaagacctcagcatgaggctcagcctgatgggccccacctctgggcagagaaaactgagctctcaaatgccacaatattggcagaggcatgcctgggacttggcatctgggcaccaagtcagtgggtcttctagggcctgtctttgggctgttagttcttaaggaagccagttgattgagaggggaatgggacagggcaaggccatgtctgaagtgggggtgcttggtgcttagcagacctctggccactaccctgagccccacagttcattttgggtcaaaaacatttctcccctgaaggtagcatcctaggtgccaagctgagtgtactcacatgcatcaagtccaggcccttccctggggcagtctaccaggaggggcatctcagtgctgtgattaggcaagcattggtggggccaggggctttgtgagcccagaggagggccctccctgtcaggggctagggctcagggagacttccacaggaagcaatgtctaagcattgctgcaagggatggtcatcagcaccatccaggtgccccttcccctaatcattgagggtgtggggtgggagtgtgttttttgctggggaggggattgcaggctagtttagggctcacaaagaggccagagagggagcagtagtctctcccatcattggttcctccctccccaccctgctaggccagaccgtggaaaatcccagcccagggaaggccaagccttgtgcttgagatcagacccccaggcctggtgtgggagcccaaggcggattctccgagactgacttcattcctcctggccacacacccaggggtctgaggctgggcgctggcagcctgtgagtgtgtgtgggcgtggacgtgtcctcacaacaccaagcacatgtgagcaccacccacctccctccatgggtgggtggtttccaagcgcctgtcctgagcccagtttcttcctcgggtacctgtgccctcttccttcctaccctgggcactgagactgcccaaggcttcctgcagtaccattctctccaactctgaaacatgaaactgaaaagaaactagaggaaacagaggcccagagagggtcacatactttgcctggctctcatagcaaatccttgaagagaggcctggagggtggccagccacttcccaggcccagctgggtctcctgcactgtgtcggctccctcgatgtgaccactcctgctattaccaaccaggccctcctctcctgggatcctcgcctcagctcctgcctccctggagtttcagcttgtctgagctgggggtcttagtgccacctaagaagccccacagccccagaagaccaaagctcccctcccaaggccttaccctcgcaccccccgcctgactcaccggctctggcaatcctgtgaaaggaacatggaacaggcagccctgggcatcctcccagggcatcttggatggctgtgctagccttgcctgacgtgtgtcctctatccctgacttcacatggccaatcagaggccaggagagaaccgcagctgcctcctccctggtcccttgctcccagtctctccctcttcagtctgtcctgcatgtggggcagataaacccctgcagtctgaccaggttactcctctgctcaagaagattctgtagctcctcagggcctttaggacaaaatctagtgtctcagcccagcactccagagttagaggcacctccttcctgtcctttcttcctccttttctcaagcctccacagcccccatgggaccatgctgctcgtgggcctagatgttacacctccctagacacatgcaagggtgtttctagggtacctccttctctgtccagcctcctgcacccaagaggccagacctgtctggaccctcagtccctgagagcagccctggctgcctgctaccacctctcctgcctgagcccctagctcacctgggcctgctccaccccacctccacaggctgcctgcccacctctgccctccaggtcactcgccttcccctgcagagtttggagtagatgcagggaaggaccaaagcaggcttcacccaacaagcttccagagttagagcccagaggcagggataataataccaacttggccatttgctgaagaccacttcctgggcttactgacttcaatgtgcagtttcattcatcctcacaacctcctaatgaggtgcagattatggtcctcctggtgtagatgagaaaacaggcctagggaggtggcacagaagggtacagccgagcttgaattcaaactgaacctgtgctctctgcatcacagtgagatgacccaggaggatatcatgttcagcctgcgggcagggtggggcagggcatgagcatggacccctctgccagctttgcctctgtggtcctcacctcccacatctgcatccagaggaagaattatgcttgcatttgctgagtgcgttatacatcatctcctttaattcccaggtcctagccaggtactgttatttgtcccgtgttacagatgtggtgacgagctcacttgctgacttttagtagtggaaccaggatttgagtctgtgtgactctctatcctgagttcttaacaaccatgcatttaaaaaaaaaatttatatattattgcttatcttgtacacctcatttattcactcattcatttggtcattcattcattcaacagatatttgagtgctagattctgggcactggttgtgacagggtgagatgggacagtgagtgtgaaagactttggaagcagagtctctccccagtgtggggttagggtgtagcctggtcatggtcattgcagattccagaacgtttgtgtaacaaacactcatatggtgcatactaagtgccggacactgttcttggagttttgcagttagaatcacttaatccctgtgacaaccctgggattgttatccccattttgcagatgaggaaactgtggccctgagaagttaagcgacttgccctggaggcagaatcacagatcagcatccctccttccttccccgaagttgtctcagattgttccttcagaaagaaaaagagtcttcaggcttagaaagctgtgtcggatcagacaagctgtggaaacggagggttctgggccctcctcctgcctccctgtttctcctttgagagtcatcagtgtctgaacaaacaagtggagtcctaagcagcctcattccaggcagacttcctgtctcctctcttatcagccacttgcaaggcaccttctctctcccctgctctcaaactggaccatccctgcaagaagagacagctcctgttttcaataataagaataagaatatctgatatttattgaacatacactatgctaagcattttatttttctcatttaattcccacaacagccttgtgagataaatagtattatcagctctattttatagatgaggaaactgaggctcggagaaattaaccaactcacccaaggtctcagggttaatgagtggccaagcttagacctaggctgactgtccaatccagtgggccccggcctcactctgttccgtctcttagggacgggtgttttatattctgtgtcacctgtctctgtgttcactgttcccctgaggtgtaaacacctgaaaaaaaccaaatttgggtttttgcctcaagtttgcgggccccacagagttgctggggatggtggcagagcagggttgggagccattagtaccattatgggcaccaggttactgctagacttggcctgggagctctggctttttgtcctctctccttcctcctaacctcaggggtcctcactgcagcatcctctgctctcagaaggtgtacccctctccagtagctccctagtagctcctgagtccattctacctcctttctaagctgggaacacatggaagacttcccaggacagtggctgacatgggcaggagaggaaaggggcagggagggagctggggtccgcccaggcggcccacacctccttccaattgctgtgcccagcattcctgcagaagagcagtcagggttgggatgctggaaagagaggtttagacttgcccctcccctggccctgacctagccgcctcatttccacaggcagctggaccaagggccttctttttgtcgggactcatgatcacagggtgagggttgggtctgggtccctctccctcttgctgatgggcacccagaaaccaggcattgcagtaccacttggaaatggggagaggggtgtcagaatgccaaagcaggaagagacacaggatgggaaagcgaggccccagaggcctttgccatccaaacctcaagagacaacccatccttccccctgcttgtgggccagctggaaccacaggttttccaaacccaacgcaaatctttctgcaaaagaaaggactctgggaatcgattccagaccctgcttgacaatgaagtctgtgctcacacaggcagtgccaccagacgttttatggagtgtgggcattggctcacgcacttgccaaggacatacaggtgctaggccctgagctgggcgtggagaatttcaggggcatcccagaaccctccctggcctcactgacgtctcagcctggcagtgagaaaacagacacctggggtggagagtggcccaagtccatgtctgtctttgccagctctcagcacccactgtgcacctgggagacgtgcaccagaagctgagtacaggcaaaagataataccactcacccctgccctcatgggctcttgcctggctgccgaaagcagatatcatctcctgaggaaatagggcccatatcatctcataaagaaatactcatttaacaaatatttattgagcgacttactgtatgctgggcaccgttctagagctgggtattcattcgtgaaaagaaagagacaaaattcttgcccttgtggatcttctattttcatgtataaacataataaatatgtaaaaaaaatagaaggtactaagtgctgtggaaaaatagagataggtaaggaagatcgggagtgtaggagagggacaggttgcaaaggtggtcaggcctcatgaaggtgacacttgagcaaagacttgaggcatatgagtgagccatgcagctgtctgcaggaagagcattccagataggaagacagccagtgcaaggccctgaggcaggagttccctggggttttcaggtgtgctccagtgtggttagaacagagtagagtggaaatggaggtataacaggggacaggtcagagaggtaatggggtccgggccatggggagcttgtcggccattgtaaggggtttgccttttattttctgtgcatcccttttactcagcgtttgagctgagtagaagcatgggtccctgactgctaaacagggcccctgactgctgtgccaggagtggacagtggagagtcagccaggggaaccgacaggaggctgttccagagagtaggaagagtggtagcaatggaggaagccagctttagggtatgttcttgagatagagctgaggggatttcctgctgggttggatatggggtatgaaagaaagagaggtgtcagggatcacacagtggtttatggctggtgtggctggaaggatgcaattgccttgagctgagatgggaaggctgtgggcagcgtaagttttgtaagaaatatgaaaatttcaggtcactgtgcagggcctgagagggcaaggagggaacccctggagtaactgaagcatcaagggaagcttctagaggtggggtagggggcaccaggcagggcctgcaagggcggggagggctcaggggcaggggttgggttcacgctgggaggaaatgtgcattaggtgtgcagagaggcagcagaggcttggcctctgagcagggagctgacctccgcattggttagcattgtctgcctccccctcagcccagcctgcctcctgggcagctggcgcaatcaagcacacacttacaaatcccttctgtgagtcaagcccttctgctgctgtctctccccattggtggggtggacaggtgagtgctgtaaaagggtgcagggtggtggtggaggggtgttcaggactgacagggtgggctttggagctaaagactgtgtgcctctgcataggtagagctggtgtgtgtgtgtgtgtgtgtgtgtgtgtgtgtgtgtgtgtgtgtgtacgcgcatgcacatgcatagctgggaattccaggacaagggcaccatggagtcagggggtaaaaaaggttggggtgtgctgccagagacctgcctactgatccttaggattaagagttctggaaggctaggtaaggtcaaaccacagacggctttagctgccactctgagacttctaggcttgattctgtgggcaatggggagccattgaagaccctgggcctggcttgatggctgtcctagctctcaggcttgagctgggttacatcttcattatggggcaaagtggaatctgcagccaccttgcctgcctgctcaccaagcaggtgtggcactgccaggccagtgctgacaagttaatttcctgattatgagataatcatttcctagggaatcgggcagccagctcccgccgtggaggcctctctggctcatctttattcaaggccctgctctgcagagctttctgcttctctgccacctaggggctcctctggagtctggctgcgctagccaaaacatcccgctcagcacatatttcacaagcaactgaccagttcctcctggactttgtttatcctccagccctgggctcaagagattagggctcttttgcattccactttccatcatttgcccctcatgaggaggaggcttggagaggaaagattccagagacaaggtttactgaacccacaaaaaagaggaagccaagagggaaacaggtgaggtgtggacgagcaatgggaaagcagccacagggctctcagcgccaggcagcctccctccaggaaccgctgggcaggagggaacagatttctaatgaagcaggaaggatttaggtcagaaggtgggagaatttcctgactgctaaagtatcgtctgtaggggttgtgagagggctcgggctcttgcccaaggctggggaatgaactgaacagctcctaaaaagtattttaatctccaagtgtttatcgatctatccaacctgtgttcaggggccagctagttcagtctccctcatcatccagatggggaaagtgagcctcagaaaggggactggggagactggacaagacagtgaactcgcctctggagcttcccccctgagaaggccccagctgcatcccaccagggaaggggcagatggtctttgtcctccggttcccgagggcgggcacgggagccgtcagcagctccagacccagcattgagcaggaggacagggtgggcttgtcccgagcacacgggccccaagagtcagtgtgacaggttcctcctactgtgctcctgcacactcccacagaggaagctccaggggcagagccaggatatagaacattggttctgtcttctcggctccgtgtcttcactgtcctggaggtttgaagggcatgctatagctaaaaggcttaccccacatcagtggctggctgtctccctgtggaatgaatggccctgggaccctattccctcgcacgcagctcctccccagccgagcatcctggctttggccatctcaagggtcttcgctgccccgtgactcagcatccctgccatcctggcccaggctctgtgcagcctgcatctgaggaagaatgcccacagaggccggcacagggcctcaggccccgagtcaggtggaggacaattagaagtggaagaatggaggccatgaagcctgaagtggggctgggtcaacccaaggccacacagaaggcctatgacacagtagggcaagaccccaggctcctgtctccctcctgggagcaagaaattgatggtggccagggttttcctgggtagtctgagcaagcccatccacccagtctttgggtggtgagacccgccccagcctacccccaccagtggtgctgggggcttgggagaagactgagcagggctgtaggtgacccagggagctggctgcgtaccttcatcaggcccaggaggggcacgtacggccgttcactgtagcgtgtttgtggagcggggagttagaggtgacctggaggtctaaaacaggaggctggccgggtgcggtcactcacccctgtaatcccagcactttgagaggccaaggcgggtggaacacttgaggtcaggagttcgagaccaggctggccaacatggtgaaaccccatctctactaaaaatacaaaatttagccagagcacacacctgtaatcccagctgctcaggaggctgaggcaggagaattgcttgaacccgggaggtggaggttgcagtgagctaagatggcgccattgcagtccagcctgggcaacagagctagactccgtatctatctatctatctatctatctatctatctatctatctatctatctaggtagatagatagaacaggaggccagctagaagggacatagaggatgcacatcgtggaatcctatgtagcagtgacaggcagtgaactagatagaccttaaaagtttacatggactgggctcggtcaccccataacctcagcactttgggaggctaaggtgggcagatcacctgaggtcaggagttcgagaccagcctggccaacatggtgaaaccctgtctctactgaaaatacaaaaattagccaggcatggtggcatgcgcctgtggtcctagctacttgggaagctgagatggaaggatcacttgaacccgggaagcggatgttgcagtgagccaagatcgcaccactgccctccagcctgggctgatggtttcccctgtatttggagtaagcaaaaagacctcatttgactgggtgcggtggttcacgcctgcaatcccaggactttgggaggctgaggcaggaggatcacttgagcccaggagatcaaggctgcagttagccatgttcacgccactgcattcctgcctggacaacagagcaagaccctgtctcaaagaaaaaagaaaaggtggaggtggcgtggggagctggatatgtaccttcaccaggtccaggatcttcctttaaaatgcatactttttgaggtgagggctgatcacacagtctgataataactggacttcacccaacattggccactctgcttggagggcctgttgtaccctacaagccaaaaattgcagaccagcctccttactcctacactgattgtgtccactagcccccaactcaatcaacccttctttatccccttccaacatcacataatcccccagccccaagccctgcagaggggccaagagcccaagcctgcaggcctggctgctgacgaaatgtcccctgggagagctgcccagagaaggagccattgttccttcctggaaaaacataccagctatgggagggggtctgctattccctgggacctcggcaaggatcctgagggtgaggcgggggggcctggcctgaactcctgaggctgctcctttccagcagcttccccgagctgctgcctcttgtgtcacccccatggccatgagggtgtgacagaggtggagctcagagagggagtcacaggaggccctggtgattgttagagatgtagaacaaagaaacttacaaaataacggtaagagtgattccatttaagttctagaaaaggcataactaatctacagtgattagaagcagagcagtggctgcctggggtggcggaggcggggagaggacttacagggaaggggccagagggtgacagaaacaatccacagcttgattgtggtggaagccacacggctttatacatttgttagaacttatcaaactgtacacctaaaatctgtgcatttcactgtgtatagagtacagctcaaaaagtttatttttataaaaagagtgacaggaggagtcctgggagggcaaggagacctaggatctcctcctggggtaccccagctccctgtgtgaccctgtgcagatttatgggcctgagcctcagtttcctccggtgcttccaaagacattatgtgccttggtgtcttgggggcaggacatggaaaacactttgggttgcctagaacagtcattaaagaggctctcctgacagagcctgaggggctttggaccagtcagtcaccctcaaaacaaaagttgctccactgagggcgagtaggactcagggcctgcccatagaatgccatctggagcagaggagacacacacaggttagtatggtgaaatctaagtgtagatcaatacagatggggtagtgagagaggagaattttgtgcagtctgagatatcattgcaatcaggggagacttcccgcaacaagaggcccctgcctgagcctgagattcctcaacagtaagaggaagaagatgatcatctgtagcgagggtcaaggctcagattgtgaccagcagccccaagctgtttgtccttagtctctcttccaattctccacatgcagtactctacaaatgcccctcctccataactctggcacttataaccctactccactcagttttaatcagacttgatgatatcacagcaattcctgtttttttttttttcctttagctgaagagctttagtccatcatcaggggacaaacagaaatgagactgagattcagaattgctgataggcatcagacctccgtctgtgaccaggatcagggctcggtgtgtgaccagcatcgggactcagactgggatcaggaacagggcttggtgtgtgatcagggtcaaggctcagggtgtgcccagggccagggttcagtatgtgaccaaggtcagcgcttaatgtgaccagggtcagaggtcagtctgtgaccaaggtcagggtgcagactgtgatcaggcacagggctcagtgtgtgtacatagtcagggctgggagaggccaggaacagcattggccctcactggccccacctggcctcttcctcccgctcctccaacttccctgggttgcatagccagctcatgaaatagcctagataggaagggtcaggccacaaaagctttgtggagccatctgtgcagtatttcttgaaactgggcctggggtgggggcagcaagctgtctgatgtcaaatgctgggtctcctgagtcttaaggcccagctaccccaccctatacgcagctgagggaaaggcactgggtgatggggaaggggcccatccctctcatcctcacccctcccccagaggcttccagggtccagagagtgagaaccagctcccagctggcttgagggcctatgggtcccttgggaaatgactgcaaacattcctaggggctcaagtaacagggcctaggctggccaagaagtcccccaccagccaggagccacctcatcctcacccacccttgtactccaagcttcctcatcattccaagtaggtgagatcaccctggctgcctggaccaggctcccccatgaggcccaggccccagggagagcaaagctagggtctgggaactcagggtggtgtggggtgggggatatgcaggcagacacttctgccgatggcttagaagccagccttcccctccttggcctcatcttccagacctaaaagctgatgagagggtcttggcagcaggaaaggggtgggaaatccctccatgggactcaagtcctcccaccttgcctgctctcacccttcctgaatccctcaagagcagaggacttcaaagaaactaagaggagcttacagcctcatcttatcacttacctgacagaatccctgaggccagagaggagacggaattagaggccccagaaccactcccctttaagtcagtggctgggctgggatagagcccagggccctggagtgccccctgcccacacccactgctgcccgcacccaccccagcccacaccccatcacgaacagaggagatattccctcttcattccaatgcggaatggagtctggacacctaagtttggtttctgcttattcctagtaactcctgctcagactcctgcatgcccagggaggaaggtggaggggcaggaacaggacggacaggccccgggctctggcacatcctggggaacaagggaccacaaggacgggggcagtctccagacttcccctgggcgcttgaccccaggccttgcaggggagagagccagggcctccctcaggttggtggccggaggttgcagacagaggagggtgtggtcaggtctagggtgatgatggcaggaagtggtggcaggtgatgggggacgggggtatggggaggagtggctgcaccaggcagaaaggaatcctgagaaggtcaggctgggtgcccaggctgagaatcctgccctgtcagcagcctgctctggggaagtgttttccttctagcccatcccttcctgcccaccctgactcctgccagcctgcatccacctggctctgcccatgaaccttcagggacacactccaggccagaagcccagggctctcttggtggtttacaaagaatgctgactgcagggatgagaggaacggagggtgtctgggggctgctgtccagaggcctggggagtaaggactcgagggagtgcctctgtcaggaaattacatggttcactcattcctgcctccaggtctttgttcatgctgttttccctgccgtggacaccctttcccgctctccgattctctaaatcctgccccatctcccagatcttgttcatgtccaagcttttccaggaagtcttagcagctcccacaccgcagagctcgagatgtaagctcttgctgcctgacttccctgaccccacacctgggcccaggacctaacacccaaggagaatggcaaagggttttggggtatgagaggatgtttggggtgtgaggaggtctctgggcattagcagtggccaacctgatgctctcaatgtcatgctcttcctccctccccccttctctcccactgcccactccaggtctccctgacttggtcccagaccccaactatgtgcaagcatccacttatgtgcagagagcccacctgtactccctgcgctgtgctgcggaggagaagtgtctggccaggtaaggagctgaggcagaagtgtagagtgttgggatagtccccgggagtcacccagaacccagcctagctgtggctgccagctaggctgtctgcaagctgatgaccctggccaagtgccccagcctcccaggaccctgaccgtttcatcagtgagccttgcctgccccgagggagtcaggaggggaggggagcaagcgggggcccagcatttctgtatactgtacctcactatacaaggaactccacttttactgtggcacttcatctttatatgagccctgaaggcatgggttaccccctcaggaaactgaggagcaatgaaaggaactcaaaccttttggatctgagctgtttaatgagaaggttccttttgggagcccaggcttccagtggtcatacggggacccaaggaagtcctattgggtggatgtacctgcaggatagagcccaggagtatggagccatgtccacagaggacagttgtggctttggctggtccaggctgcctctgcctagtcacagcaggggcagtgagcccgggggacaaagaagtttcagttatatgttgcactggaaagaggggaaggagaccagtttccatgcacctagaaggtgagcacagctggctcgccattattcatgggtgatcctgcctctcgcagtgtttgcttctaatttataagcagttcatattctgctggaacataggtgctttgcggatacctccctgggccaaaataattagttaagattatgttatctgcttcttttgttaatatccctttatgttgaaagcacctatttttcttaattacctgctttttggacatttgaactctctgtttagtttgactttttactatctaggaaactctttagaatctcaacattttctcatttctagaacttctagttcactgccactctaagtagctgatcataaacccttatctgtctgtaacaagataaagagcttgaactagaatgtaactcaactcactccttcattgagaaagtcttgctttaaaaaaagaaaaagtatccgctgaactaagcagagtgattagtaatgttgtcgatgtacattctggtgcaagttcccgatcccatcccagactggcatcagtgtgggaactgcccctggtccagggaccgcaggctgagtaccactcagccagcctgtctgggcagttcttgtcttgtttcagttgtcttggggaagagagcataatggtcctgctggaattcctccagcaatgaggaacttacagcctccatgacagcccttccagtcttaagagaattagtcaaagtcaaactattaacatcactgcctcttcatgaaggatcctgagtgcccggacctgcgctcccagctggggagaggaggcagcctgtcctctgtcctggagggtctcctggtacagctggagagaacagccctcacctgtaccccagtgacagaaccaagacacgagtgggaaaagagccagaaggactggttcacaggccagggctgctggaggtcagaggagggagggatcagcaagggctgaggcctcagaggaggtgggcgtgggagttcagacctggagaatcctgcaaaactggagccctggggcaggagggccctctgagatcatttcaagtatgggccgcaggctggtgccagttcacatgctgcaggcagaacccagagaagaaaagggaccaattccaagtctcaccaccagtttgtggccaagctgggcctagaacctagacccttatggtttcccacggtgtgctgagccgaacagaagggcaggatttaaccgaacagagggaaggaggatgttttgtttcaacccagacatagacagattccaagcctcccccagacaaggctgagggcctttcatcctggcagacagtctgagccgcctgttgtccagacattctctcaaagagagcgctaatccctacgactggccaccgctcccctctggccttaggatcggaccttaatgagtgccagggaagagcccctgaggccaacagagttagctgtcagccgtcagctaaagaggggaggggccttcagccaccccttcctgttcctaccacacatgtgtgtgcatgtgtgtgtatgtgtgcatgtgtgtgtgtctcccctcactgcagcccctcgttcctctttccacccttttccttttgtcacaaggcctacctcagttggaaatctggagtcagcaggtgacttgcgagcaggcaattcataccagacccatgttccctgaatggaaaagggcaggttgccagcctgaagccatgcaatcagggagaggtggtctggacccagtgcaagatgtagatggtatcgggctgtgctgcagtcagtgctgttagagctcacaggcaatccggatcctctatgtagagcaatcagggcagacttcctggaggaggggacttttgagttgaccctaggatactgggtgagttttggaattctgggtcaagcaaacagcatgggcaaaagtatgggtcagggaaaaagttcagcctgtttggaaaataggctttgaagcaggaacccagggtgtgtgggggagtggaagggcagatgggactagaaaagtgaagaggctttgaccagaggacttcacgtctgtttttcaggcccacacccaagacatggcatactttggtcaacaattagggctctgtcttgttatcagagacttatcagaatctcctggataggacttttttttttcttttttttagaaagggggtctcactctgttgcccagactggagtgcagcagcacaattatagctcattgcagcctcaaattcctgggctcaagggatcagtctccaagtagctgggactacaggcataagccaccttacctggctaattttttaattttttaaaaatttctttaattaaattaattttttaaattttaatttctcactgtgttgcccaggctggtctcaaactatgggcctcaagtgatcctcctgcctcgacctccaaaaagctctgtaattacaggcatgagccaaagtgcctggcccccgcaatagggctgtttttcagtggcccttcagagattgctatgtgctcctgcacctaggggctgaccccagctgagtcacctgcaggtatcagggacactgccatgcttggtaccgctttagaaagatgctgttggcagctggcggccacatggtggaggccagaaaggaggggacagccaggatttcacggggtcagaagacagaggaagaggcctgagcctccgccacagttcgaggagacagaggagaagatcttcagggacaaggagtggggctgcagaaccagtggccaagggctgggggtggggctgagggggcccatgctgggttctggtgtcactgtgccccaaccccccctcatctcccccgccgtccctgcagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagtgagtggggaggggctgggcccgtcctcttccacttctcctctgggccagggaccttggtgcctgagctcccctcccaccatgagcactctgggagacacagatactggattagagggcccggggaggtgttacctgccaactcttttcactggggcaagtgtttctcagagaagccttagccaaagctaggctggaagatggatatagaaggattggtctcaatcagggatggaaatgtctagaatacagggcattgcccagtgaggccattacaggtgggagcccaaaaaggaagtgaggggtctagagcatgtgctgtcctggagtgacccagctaggtggggagcacagaggggccaccccgcagtactcaggagacaggagaacctagaccagccaggaggctgtgccacagcagggtcacctgagcccatctcaggatggggacaggatgagaggcccagggaagactaggccctcttctttctccttctctcctctgcccctaggcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccaggttgggctggagagatggggtttggggcatgggaggataaggagttggggaggcaaagagcgaggcccgctgaggcccggcaagtgccaaggcttctggccactcagctctgctcacagtgaaggtcttctcaccagtcctcaggctgccacactgccctgcagggactgttccctccctgccccagcccctttcccatgttattccaggtgatctgctcgtggagagaaggaaacatcgcaacagtctggagagcaacacgtcctattggcctgttcacccacccatatccctctttccatcatccaccctaaatatccacaaactgtccatctgtcctgtctctttttatccattctgccatccatctcgtccctcccacctggctattagatatctgtctttcctctggtccatctagccagtggctttaggaaggtgtggacccaccctgagcagttgccctgggccagggtcaggggagaaacccaggggaaggtgggccagaaactcctgaaggtgggcgtggggtggctctgggaaacaagcagcatcacagccgctcctcttgtccctttcccagggcctgagcccaggctgctatgacacctacaatgcggacatcgactgccagtggatcgacataaccgacgtgcagcctgggaactacatcctcaaggtgggcctctgggtctggggctttccctccaacctgatgttcatgtccaatgtccccccgttcctgaaagaagcttcagcctctgggcctgttcccttctccccagctgccgagcagaggcagcatctgaggcatcacttgaggtttaggcttcccagccgaagatttaggtctcaggctgacatagcctctctttccataaagaacccagggaacctttgccccagctgtggtaatgccagaggcagtggtgatactgtctccctaagtgacagaggaccagggagagcaaggaagacttggagagccatgtggtctatcttcctgtcttcggacagggcagactttgtatcatttgggagacagatgagaggccctcagctccttatagggacccctgcaaagccaagggctcctgtgactaagacccttttagcctgaacccctcctgctctaatggacactcactccatcacctcttcccttggttgagggaaaagtagaaaagcatattaacaacacacatccagacttggtacatccgtgtaggccaggttgtcatgggcccacctggggaagccatgtctcagcctcctccacacaggtataaaatgagtagggatcattccaccagttcatctggacccactcagaagcagaaaagcagctcagtaaaggcagagcagtgaagccaggtttgcaggcggaggccttccctgcagaaagtcagcaggtggagagatgcatccggcagcggttctctgcagttccctcctgagtgctcttcagcaggctccaagcttgctcctccagggcctggggttgtccagtatattttttcttttcctcattcatccactcaatcaacatgtaggaagtcccctctgagttctaggcactagacacacaaaccacataagcaatgcagttcacagtccctgccctttgggagtgtaccaggatttgaaagttgcatccctgcatctgttcttagatgttctgcaaataaagctggccctaccctagttaatccaacatttaaaagtgttgtatcccaacagctccttttcagacaaaaagcacagatcatacttgggccatcatctcagtgaatgttgggcacgtggggctccagagcaggggatcagacaggccctcgatcagtcacctagacagggatgcatagggaatgactttgagccttggatttggggagaccaggtgttgaatcctggctcagctcctcattactgcattccctcaggcaggatccaacctctctgaccccaaatgccccatgcggggcccacctggcataggctctagctctagggaaacatccaatcttctgataagggggattagatgatgttttcttggtttaccagctgcctcttctttcccctctgtgtctctctagcagtgtgtctctgttctccctctctctgtcacctctctgtctgtctgtctgcctctttaccaccttctctggtgagcagttgaggtgcagcccccctgactagactccctttctccctgtttctcttcttcctcaggtgcacgtgaacccaaagtatattgttttggagtctgacttcaccaacaacgtggtgagatgcaacattcactacacaggtcgctacgtttctgcaacaaactgcaaaattgtccagtaagagtttgcccaccacccttcctggctccgtccctttcctgcctggggagcaggcaaggccacctgagatacctaagatacctgcactttaggtcaccttgatggccgaacgcagctgcagcagggcccatcaaaaagagccttgtccgtgccaaccccaagctgagtgtttacggtggggctcaggccgtagggtgttgatctggggctgcatcctgtggctccctgagatgtcccaagtgaaaaccagcagaaggcagagtcatttgatgcaaggccatgagctctgcagtcccagttccacagcttcctcgctatgtgacattgggttacttccctgagctactttcctcaactataaaataggtatttccacataggctggcaatgaggatctacaggcctgatgtctgcatgttcacagtggcacacagtgaacagcagctgtgatcattagtgtccttttcaagtggactggattaaacagtcacagattagaagtgattctggttcaaaggagccatcttcagtccctaggcccccattgtagaagaagtgcctaaaatctgggcttgggattttggcacatgctgctgggtagggtcctcagtctttctcctgattccccatgtgaagtagtttgcagagggaccccttgcttacaagctcacaaggaaaccccaccacactccagatcgaagcaacccttttccattaaaaaaaaaaaaaaaattagtcctagagctttcagctttagttcatcaactgggagaaaggtggtagagatcttaaggcccagagaggtatctttccctaaaagtgtgtacttattaatggatggcaggtatgagagattaagcctatgactatggtcagggtgtggtgtatggccagggtcaggattcagtctgtgacaagggttagggctcagtgtgtgacaagggttaggactcaatgtgtgaccaggatcaaggctcagtgtgtgaccaggatcagggttcagtgtatacctagggtcagggcccagtgtgtgaccagggtcagggctcagtctgtgaccagagtcagggcccagtgtgtagccaggctcagggctcagtgtgtgaccaggatcagggctcagtgtgtgaccaggatcagggcttagtgtgtggccagggtcagggctcagtctgtgaccagagccaggctcatttagagacagccctctcacacttggttgctaccatcaacctaactgttcacagcatgctgccaccacatcatgaatattaaaaatgggaacagcagcctccagttcagtgcagagattaggttcctcatgagtagaatgagatcagaattccccagggcacacagcatgtttgaaaggacgaactcctgtcccatcactggcagtttggctctttagcaggcctgggtttccagcacattcctgctcctcagggcctgtcttagccattcaagacccagggtcacctaagtggtagaagccattctagggaaggaggaggaaggaagaagggggtatccaggaaacaaaggaggctgctgggggctcggggaggcagggaatccctcctgctgctgggaaagggggatgggaacagaaacagcatcccacgtgccaggcgcctggagcagccaggagggctgtcggcagggcagatggagaagcagcctgcgcggccctcccagctccccgggggcctgtgggcagcagggggagccaaagcccttccttccaagagctctttacataagtgcttggaaaggccgggccttattagagtgtctcagtctctgtgaccctgaccgcaggcaggcagctgggccagcgtgcacaggaagctggacagagcgttcccagaaaggccacgggactgacgcctgtgggtttccatcgtgtttctggaggaaaaaggaggcttaaaaaaaaaaaagtactgagttagaaaaaacaagaaagtatttccagacagtagcagctctgctaatggcctagaaaacaatctgggactagggcatggggaggggaatgtgctgagactgtgccctgggtgggtgggagtccatcaaacccctccttttggagctgggctgagggggtcggaactttctcttgagggaaatgtaggcccatgcctgccctgccacgagggatctgggctgtgggagggacgccctggctgaggaggccacgggggcctactttgcagcccctcattgacccactgtctttccttcctcagatcctgatctccgggagggacagatggccaatctctccccttccaaagcaggccctgctccccgggcagcctcccgccgaggggcccagcccccaacccacaggcagggaggggcatccctccctgccggcctcagggagcgaacgtggatgaaaaccacagggattccggacgccagaccccattttatacttcacttttctctacagtgttgttttgttgttgttggtttttattttttatactttggccataccacagagctagattgcccaggtctgggctgaataaaacaaggtttttctactctgtggctctgcatgcggcctgctggctggctggccagccacagctagtttgggcctgggggatgtccttaggcatcatccttcccctcgccaaatgtggaaagggcagccaccacccggtcaggaccacagtgaccatgagggcgctgagcccatcgtggaagcctgtggggttgagcccttggccaagcctgtcgcatgggaatgggaccacatccgactaggggagggccctgcagcggggtgggcggcaccagcctgctctccctgctcagcccctgctcctatctgggctcgtgtgcccactgctgccccttctcagccttcagcctcacactcccaccggtccccctcctggccctctcactctcacaccgttcactctccaccagccacccactcccttacaattgcaggctcccgaactcaagtctcctgaaggccaggtgctgtgctagggcacacgcaggagcatcgtagcttctgccctcagggagcgcataaccacagggaacggggagcacgcgttgcccagtgaggcagcacctaggggttctggggagccttcacatgggagagagcctccttccaggcagggaggggagaagaggattcttggcagagagacagcattgagcagagatcatgaggtggggctgcaggccgacagggtgtgagtgggagatggagggaggccccgcagccctgcagcccccgtcccctgccctggctgtggcatcccagaggtcctggacactggaatggaccaggaagaagtgagagggtggtgcctctcctcctcgaggccctgaacaacgagccctcgggatgcctccagacccacctgcttccctgtgggggcaacaccagtgagaaagggaaagagactttgtccaagtaccagggctctgggttccagggccaatcctgctcactgctgtgtgactgtgggcaagtcagacttcatctccgggcctcagtttcctcatgagtaagatgggaatgctctcctgcctggctcccacactgacatggagagttgatgagctactgctgcaggggaggtgccgggggagctacagggtgtcagcacccacccctccagatcttggtgagccccagcccatttgcagaggtcctccaagaaggtgtcccctgcttttggctctgatgcgatccttgcctcagggtccctagtagcaaggaggttttctggtgcagtagagagggagggcttcttggagccatgctatgcatccaggagggttctggcccagtcccctggagcccttgggccactcaccagcccaggcagcagggtggagtgggtgtggctgcagccctccctcggcccttcctctgcaggtctggctgggatttaactctgctgacagggtaggtgccgcagctctgccactctccctctggagctggaccaggacgggtgagaggagtacaggcacatgcctgtcatccagggctgccattctgctgcatcccctgccggtgtgtgcttcccaagatgctgtccttattgcagccccaccccctctccttcctagatactcccaggagtgagcttgggagggggtcagacaaggtcaaccaattccagactgtcaggaggcccgtatgaggtagagacaaaagcccccatttctcaggtcagaaaactgaagcctgtctgagaccacaggcaagttcaaggcagacacagtgctggagctcacgtctctaagccctaggccagggccaaatgccgggtgtgtgcagttttctggggagatctgtaccctcagcagatgagctatggccctgaacacagaattggatggaaggagagagtaagggtggcttttccaaaaagcccacacatcacaaagtgtggggaggtggggagcacacaaggagactcccagacacagtgctcccgcgtgcccatgaacctttggcctgaagttcagattctaggggggctggtggatgtccccaagcctg

SEQ ID NO: 16282 - DNA, 6727 bp, Human
  misc_feature (1)...(6727): n = A,T,C or G
nnnnnnnnnnnnnnnnnnnnnnnnnnnnnnnnnnnnnnnnnnnnnnnnngaacaagagtgaaactccgtctcagaaaaaaaaaaattttttttaatggcttattgcatagtattttcaaaatattaataggaaatttttactacgataggagaatatggggcagtggaatttgtctgaagtaactgttgaatccactaagtccttcatcaacacaaaaggaaatgcatgagtactgatgttttgcttaactacttctcttgaatagctgtggttagtgcttactgtttgataccctgtaaaaagtattatctataatatatagatggagaagaagattatttcctcaatgaccacaaagtgccacttgtcaaccagatcagttttgtttttttgagagggagttttgctcttgttgcccaagccggagtgcaatggcacaatctcagcgcaatgcaacctccgcctcctgggttcaagcgattctcctgcttcagccgccctagtagctgggattacaggtgcccgccaccacgcccagctaaattttttgtatttttaatagagacaaggtttcactatgttggccaggctggtctcgaactgctgacctcaggctatccacccgcctcagcctcccaaagggttgggattgcaggcgtgagccaccgcacccggcagatcagttttttatgtacactgctggacaaacagtattttggactgactcattgtagctttggaaatgtttggattttttaatagctttaacctttcttgaccaaaattccactataatggctgcttagatttggatgaaaactcaacagctttattttttaaaagtttgatagctttataaatgcttttttaaaaaattccggatgtgaaaatatttatgtttgtagttaagattgacccaagtgggactctagatcggtggattccaacagaaatgtttcttcagagatgattattaaataatgggatggactaaacaaagaaggtgcccccccccccaccaaaaaaaaagatatatatacatagaactaactttccggtaaactaagcaaattccacgaggaatgcaaagatgaccatttttgaaggtaggaatttaaattgggtttagataacaaataacgggttgtagacagcttacccataatccctccttcccccaagcactaggcagtgaagttagacttctggattccacctccacgctcaccgcgcggcactatgcaatcttcggttagttaccaggtctaagttaggcttctggattccaactccacgctccaccgcgcggaactatgcaatcttgagttagctaccgggtctaagttaggcttctagattccaaatccacgctccactgcgcggtaactacataatcttgggctagtttaccagctctaagacttaattttgccatatgcaagatggagataacatccaactcctggtgtgtgaggattacgtgaatccttgcagaatgtggctcagtgcctgggacatagtaagcgctctacggcttctgctagcataacgctgttagtttctctcttcctcctacatctacctatctcaaccaaggtcctgcgctaagcaggggcctccaagctgggacgcagcccttactctcagggtcagcgccggctgggaaggccgcgacctaaccaggagattacgaacaatgtcaccagggccacagcggagctcctgccaagtcaagcaactcatggaaccaacggaggcgaagtccgaatacctaggcaaccctaacctaaaagtgtttttaacgttctcaggtcctataatttacccaaataaagtgggaccgtatttgcaggcgctgagaaactttctcaacagtaagaaccaatcaggcgcagtgcgcaggcgccttcagtgggtcctgggtccgcctcttccgcccggtgcgggcgccgattggtccgcgtggacacataagaggctgcgtataggcgcgagagcccctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggtgagtgcgggcgcgggccggcggccgggctgcctgtgggcggtgactttcggctctccatgcggttcccggctccaggccgttcgactgagcacttccggccggggccaggccgcgaacacaggccgcatagggcgggcgctcctcggggctggggcctctctccgggcaggtcctgggcccccgggaccacgtgcgggcccagcgggcatggagtgcgcttgaggctgggcgctccggctccaagagccttcgtgtagaaaagctcttccgcagtgcttgggcaccctgacccgtgcctcgtctctctcagggacacttactcggacctctttcggtgtaattgccttgaattcccccggtcgtggaggaaggcgcccgagctcggctccacctcccaggtcttgtaacttaaaaatagccgcgtgactcaggcaagtcccagcccgtgaaacagcagtgatgggctcgcctcattgcagggcgcctgccacacatctcttttgcttgtgatagaatatttgagctggttaaacatgttatgtacacttattgagtgacgtgcagcattttggagatattacatacgctacgttttgatggattgacgtttttatttgttgtaggaggataagatcaatgccctcattaaagcagccggtgtaaatgttgagcctttttggcctggcttgtttgcaaaggtaaggtgatggtggcaaagtgattgtggtaaggcctgctgatttacgagggcagttgtacatgctaaagtacccccagcggtgccataacgccccacatgccgctggatctcctaggtgtttttcgttgcatgtatatctctaggagctaataagatttcagcttgtcaagtcttacgtttccttatcagactctggtttcccttttgctctgaaaccatggttaaaaaaaatgtgaatcaggtcatttattcccaaaaagggtcactcgggagataggtactacgcatgttaagttgcaagcaaattctttttctttttcttttttttttcttgagacggagtcacccaggctggagtgcagtggtgcgatctcagctcactgcaagctccgcctcccgggttcacgccattatcctgcctcagcctcccgagcagctgggactacaggcgtgcaccaccatgcctggctaatttttgtgtgtgtgtttagtagtgacggagtttcaccatgttagccaggatggtctcgatctcctgacctcgtgatccccccgcctctgcctcccaaagtgctgagattacaggcttgagccaccgctcccggcccgcaagcaaattctttcagtaaattcttgcattaaacctatggtttgatggacatttgggtttagcggacttcattgacacagtaggtactgtgtgttgggatataaaagactaataaagaggttcctggtcatggagcttgcactggctattttccattgtacaggttacttaatctctgtcaagtgaagctaatagcatctaactccagggttgtgacctctaaagagttttgaaagattgaaaacattgtacctatgtcatatttaacaagccccttttgaagtcctatatttgtttagtagactgaaaatttgaattcactgttaagaggagacatggaactgtggaaagaatattcatttgagtgtttcaggaagtttggattttttttttaccaacatattatttgtaaaaggagggaaatcagctgcctcaggaggttcttaacatataggaatgtaattatcagattcaaagctgaacagtagtgcgttgccctgtaacctaagtcttggctgttagcaaagaaaagccagtgtctggggtattggttccaggaccttccactaataacaaaatcccaggatgttccatctcttatataaatgtatttgcatataacctatgcacatcctcctgtatactttagaagtctacatgtttggtacacatgcttatttttccactgttgaatccatggatgtggaactcactgtatatagtgttaggggttgatcactgtaacctggaatgggggatacttttcgtttttggctgcgtgagtgcttaacaaggacagaactgggcgtttacctatgcatgcacatgtattgcaggccctggccaacgtcaacattgggagcctcatctgcaatgtaggggccggtggacctgctccagcagctggtgctgcaccagcaggaggtcctgccccctccactgctgctgctccaggtaggaaacatggagtttttagtattgggaggagtgtagagatttttttaaaaatagtattatagacaaaattgccattaatttttcacaagtatatgaagtatggaaatcctaacacctgattgactttttttttctagctgaggagaagaaagtggaagcaaagaaagaagaatccgaggagtctgatgatgacatgggctttggtctttttgactaaacctcttttataacatgttcaataaaaagctgaactttactgctgttggtcttgtccatagttttggaatgtgctctgcaaaaatggtctgttttgtaatgttggctttcagcctattctgccatgacacaggctggattttccctgccaccattgccggatgtgagatttagacaatcctgatgctaacaagaaggcacctcatggtacagtgttgaaaactgcactggggtggcaggaggaaggatcagagcagatgctttgtccaggttacctgtgtaaacttgatgattataaggtgtgtcccctacactgggggtggagggtaatacagaccagctttagaaagcctcctgggtatttaccctatacaaccctgcctaagaacgaactttgacgtatgctgaatgttgactgctacatcccaaggttgtaaaaaaacaagacttagctatgtaatgtctcaccaaatgtttgggagttttatgataacactgaaggagtgcagaaagtttacttaatagtttattaaggtctccagttacacaaagtggaaaaaaaaaagattcaaacctgtgttccaaaaactaagagctttttttgtttgccaattaataataccatgaatggaattttcaacttttcaggcttggatttatataataaaccgtgggtattgtgtgttcagagcagctaatgacatgccaggcacatgaatgagtcttatccttacctccattagcatttagtagatgaagacattcagtgatgaaaagcgtgacttctagccgggactcctcgtgtcaatgtgaaaaagaccatttgtgtaagttactacaactacttggggaaaatggcagttctactttgaggcattactcaagagaaactacatgtggacataggatacatgcctgggaatgttcaaagcaacacttggggcttctcataagctcaaaaaagacattaaatatatgcatctgctaagagtaataaataccaaagacgggatagtgaacaatttaggaccttgagcaaggtggagttgacaatgggtaggagtatgtaggtgtcagtattagagttttatgttttaagttttttgagaggggttcttttgctgtggcccaggctggagtgcagtggtgcagccatggcttactgcagcttcaaactcccaggctcaaatcggtcatcccacctcagccaccctcaagtagctgggactacaggcatgccaccatgcctggctaattttttgtaggaaaacctcaatctcctggtgttaagtgatctgcacgccttgacctcccgaagtgctgggagattgcaagtatgagccaccatgcctggctagttttgtgtttttaatacatggcttgagcatcccttacccaaaacccaaaacgtaaacgtgacacgcaaaggaaatgctcattggaacgttttggattttcaggtaaggaatgcccaacctgtatattaaaaccataggccaggcatggtggttcatgcctgcgattcctgcactttgggaggctgaggcaggaggattgcttaaacctatcccagcctctacaagaaattttgttttaaattagtgcagtgtggtggcatgtacctgtggcttcagtgagccgtgtttgtatcattacactcaagactgggtgacagagcaggaccctgtctaaaattatctaagatcataaagtatacataaaaaccttaagtatatacaaatattccgaagtctggaaaaaagtagaaatctgaaacacaaatggttccaagcatttcggataagggatgcttagcctgtacgaaagggcaattgtgaactagtgaggatggtgtcacaagacaaagataagggatagcctatatccacatgttaagtgcctgcttttccttcacccattaacagctaacattagctaggactgctcatctgtgtggcatgtcattcttcacaacagtcccatgacagtatgtccccatgttggggatggggaagtggaagctctcaggttacaaactag

SEQ ID NO: 16283 - DNA, 21384 bp, Human
cacaatccagtttcacggaaaatgaaagacaaggattcctgctgatcaaatcgcctggctccctccacagaatcccgggaagccactctacattcacaaactttgcactcaattcttggcacctatcaacgccatatctccagggccaagtgaagagtctcatagcaactaagttaatatttgaaaattatgtaaagaaacaaaattacatcaatgggccccaacagatacaatgcacctacagaggcacaaataaaagcttcttctttgctacaaactccattttgtaatggtcctaaaaatttaaaaactttattgctgctttcttgcctaagaattccctgtgacatcaacccaaaacccacataagcagaagtacacaattttctagaatcttagaacaagtaagtctaaacatgaatcatatttgtttgggtgaaattgactgaaataaatagtaaagagtgattttgagatacatattgcaaaaatgtccactaataacttatccttgtatttatctgtatattttcaaatgtaagtaatgtgatgtcaaggccgacacaatcacattaaactgtgtcctgcttccccaactgtaactctaatactattgccctcagagattgcagagaccacagaaccgaactccttcccacaaacccccggatttttctgtggcaaaatcccttgtaggaaatgaattctctctatatctcaaaacagcctcacttacccagtaggccctgtaagcacagtgtctcaggtccacaatacttttagatgcccaggaaaatgtttccttttaaaataagaacaaaaaagaaaaaaattaggtgttggttaaagaaaatgtttaaatatataatattaagatatttatctttatgtcagtgttggtataaatgcgtgtttatgaaaaagggacccaccaaggtgaaatgccgtaggacccacaaatgtcataatgctggctggcctcaaaatgtccttcctattaaactattttgaatgattcctaggtatgccagatgccaatttttcttggccagccagggaacgtctcatgtctttggaagaaattatctttctcttactggattcttctgagaaaagtgatttgttaaaagttttggttatttcaaatcaatatgtactcaactaggacgtctcctcacccacgttaattttttaaagaggaggaaagtaggagaagatgagcgcttcatgtaaggctctgccagcctacgaggaaatgcaatcctccaggctcgaccgagcgtgggctgcgggcaggggactgtggcgccgttgtctcgttttattccacggccgtgcagcagagggcgcgtgcctctcagcactcatgctgcgcgctcccctgcgcctctaggatcgtatccctatttgccccaaggtcatagctcctaacccagcttgccagccccaggccggggacaccagagactgagcccttcgcgctggagaccccggcgcgggtggggcgggagggctccggggccaagagacaggtcacaatggggacaggggacgaaaggcgccgggggtccgggtcccgagcagtccccgccgccgccagactccgcagccgggagggggatggggtgcgcgtagaggctccgcggcccgggttggacggaggagcccaggagccaccgcagccgccgcacgcccagagctccgagcttcgctgccagcccaggacaccggggccctgccgtgggccgaggggagccgggcggcgggagaggagccccggagccccggagccccggagccccgccgggcgccagccgagagggcgttttccccgcccccggagactcgcccgcccggcccgccccgccccgagcgcggggagttcacctccgcccgtcaccacctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggtgagtgccggcgacggccagcgcgggggcgccccgatccccgatccccgatccccgatccccgagcccggatgccggcccggggcccgcagcgcccgcacatgctgtttaccgcggccgcggggagtgctggaggctcaggtgcgccccgggcgctcgctccgctcgcggctccgcggcgccggggatgtcccccttgccccagctgcgaggccactgtggaggaatccccgcgtccgccggaggcgcgtagggcccgagggaggggaggcgcagccctggccgcgggacccgaggacagtccctcccgggtcccgacctggggatcattttaaccggacctaggaggaggcgggaaagggttgtaacggaaaattctagttgttgatcgcagagaaattaagagactcccctcccccctcccccaccttccacccccaccccacccctccagcttcagcaccacctgtggctaaggcgctcagcacgaactgtcccggggcattttccagtgctggtttgaatccatggctctgatttccgagttttcccttcatctctcgacttctaatgttagggggtcggacatcaggaatcgggttttatcttggcctcagatctggttcttcggagccagcggagcagaggagcatgcgtctggcgcacctagcgcatctttggagggtgtggggcttcccaggtagtggggaaccctgacggttaaaggtggggtgggcccgggcctgggcagtgaggaaaggatccagacctccttgaatgtcttaagtgagcttgcatatcccaaaatcgcaaccacaagccctgacattagtgtctgcccgatttcagttgctgaatttcagtaaaacgaccttaaaatagctaatatttatatagcactcagtgatctaagagctttacatatatcgattctaattcttacagcgacatctatgaggtagatttctaattatcccatattacaaatgtggaaactgaggcacagattacgtgttttcccaaaatttagcccattgttaagtgatgcttctaaaattggaactgagcagattggctccggaatgattgctcttctctaggggtctgggtgtacctttccccacaatgggggattcacatgtcttctttcccccaggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcaggtcagtgtttagaaaataacttgtgtcttttagccagtagctgttttccgagcttaatggaaggagccaggaacagtggcaggaaccctcttaataatacagtttgtctcaggactcaaggatgccaccctgatcattttcattaggtctcagattctgagaagtaggctaattagtttgaagtgtcccggggccgtttcttccctgtaaaacccttggcttctatgaaggccattgaataactgcgatatgcctgtgaaaaatcacaaaaggtgcaaagtcccctcgcaataaagatcagtcacgatgagatttgcaccaattgaacttttaagattgtaaaatattttgtcttgcagagctgatgcatatccattaaaaagtatatcttagtgagccttatcttcaagttagcagcgagaagagtaacaaaaacgtgccaatttaaaatactgaaattctgggaaaatgttttacttatgagtatttcttagtattgggctagtgtgataaagatggcagcatgttttgatatctactcagaaattcatttcacaaacgaagatgttttagagttggtgaacatacctggcccattactgacaaaaccaattaccgtatttattggtaatagagctgtttacaggatgctcactgtaaaaaaaaaaaaaaagaaagagaaagaagaaaaaaaatcctgcttttttttttttatctctctctcttttgaaacaagagaacaatcccattcacacatagtagctgccttctttgctaagcagttaatttaattgccagtgccctattttcctgagtgctttcctctgaaggtcatagaatgaaatggtgctgcaaacacattttgtttggtggtggtgtgggagtgaggggagtggtggaacaaaatgagaaagttttggagtagtgacctacggtactaatatattatataatatgtaattataaccatttagtcaggtagactattctttgtcagcagctatcctatatagtcaacttggttttgaaaaaagaattcttccctcctttcaactttaaaaaaatttgcaaacacctggctttctgaaatggtgattctggaagacaatttgatgggggataatgtggagatcatctgagaaatgttttcaacctacctgtgcctgtctgtgtgcacccctccccagtacacacatacatacatacatacacacacacacacacacacacacacttacaatcatactcacactttctggcatagtatgatgatttattagaatcaagtaaaggttgtacattgaaaacagttcggtgattctgctacattgctttcccaagcattcctctcactccaaaggaacagtgctcatataattaaattaaacaatttttttcttgtaaagaatactgtatatttataacaagacaaggccaaaggtctcaaggtattacacatacagaaagaatactataacatttcacgtctagtcatttacaaaccaaaagaagtgagctactttagtctgtagctgtacttttttaaagagccacaatgatgtcattgttttcaatggatgtaatgtctgccaaattatgtatctcattggatgctacatagaaattggatagtttaagtcttttttggagcactgaagaaacaaatctccaacaaatgaaagcagatgaggttcctaatagtccttaaaaaatggatagtgaaataaattattctagtaatatgtattactggaaagtggatttgaacacatggtctggtggctatcagcatagactggggtcagagagacctggatttgagttctagagctgccggcaactagctcagagactttgggagtaatactgtctaggttttaattgtttttaactgtaaagttggagtaacaatagtgtctgccacagtggaaggatgaaatgggacagtatatgtaaagcccctagcccagtgcctggcgcatagaagttgctcaataaatggcctctgttgttgtcacaacttgaacccttcgaccacctctgttagaccattgctgtagatgttgcacctgcgataagatttctgaataaactttttctttaacagctttaagattagttcccatcatttgatgtattttaaatttttatttttatattttctgaagcatactgtttatcatactgaatatgtacttattttatgtatgaagttattatatagttacatattttaccatgaatctgttaaactttgacagatttctctataagcagtaactaattagatctagctacatttttcacagctatttcttctggagagcaatgcatacatttttaaagaagttggccatgtttagattgtgaaacagatgaaaaccacagggtttcggtaggagctcccacccatgcctttagagacacatgtattatccacctagttctacaaaaaagtcattattaacaccacttaaatgcatgggaagctaagcatcatgaaagcagggtggaggcctggtccctctcctgttccccggagcccatgctggaaatatctaaagtagaaagacatagaaatagtagaccctgactgccactttgataagtgcagaaaggaagtactccaaggaactatggaaacgtgaaggaggcttggcagtttaactgataagacaggaaagactttccagggtaaataaggcttatgtggaggcttgaaggattttgatgtcttggacgagagtccaggcaaagggagataggaaataccaggagacttaagagagcacagcatgtgctccagaaaggcaagaaggtatactaaaagcaaggtcagaaaggacttgccctcctttgcatatgaaagattcctttgtaattttgcctctcttttccacattttcagttactttggttaaacaagaatgcagaatatattaaaatgtcaatattaagagaaaagacatctacagaataaatttttaaaaatcataccatgtgggggacaggcacggtggctcacgcctgtagtcccagcactttggaagactgaggtgggcggatcacttgaggtcagaagttcaagaccagcctggccaacagggtgaaacactgtctgtactaaaaatgcaaaaaatgagctaggtgttgtggcatgtgcctgtaatcccagctactcaggagactgaggcaggagaatcgctggatcccgggaggcggaggtcgcagtgagccgagaccgcaccactgcactccagcctggtgacagaacgagactccatctcaaaacaaacaaacaaacaaaaaaccacacacacacacacacaaaaccatgtggaaaaactccctttagactttctttcttttttttttttttaaataaaacaatcctaggctctcaaagccaaaacaaagaatagagatactctagttaaactcaccttaataaacatgaagaaacagaagctgaagagtttaaataacttgctaagtcgtctccttgctagtttgctggagggactaagtagcaatcacttaaaaatagaattttgaataaaaatatttgaaggataaccttatttgacatttagtttatacataccatgttttttaaaagctggcatttttttctgtacacaagtcaaaaagttatttattttagtcacttaattttaaaaaatcggcagtttaacatctctttttattaggagttatttttgtggtggtaacatttttagatttcctatacctcttatttcctgcatttaaatgcagttcatttacctgtcttctttgcctcaatgagatttcagccttctagaacttctcatagattgaggttttccaatatgctttaaatgttctcttatatccaaacttaagaacttgggtatcaggaactgagcgggttgactttattgctgatttaagcttgagagaattttttaaactacggagttaataggatttaactagaaacttgggttagagctctcatcaatcttctaaattcctttgaaaataagccaccataaattcaccttaagttaatgaaaaattgctaatccctttaggttcttaaaaaacttattaaaaaataactcaccctgcttgagatgttttattaatggccttatctgggagaaaataatagtagtcaaattattaactcctgctaacttattaacttttattaatgagtttaatactctcctgctttattgcaaagttagggacaaatattgaaagtcaatgccagaattattgggccaactcttatccaagtcttacatcatttctgtttttcagaaattggaattttttaaatctgtttgttatttcaagaaaagagtaaaggaagctggatgagtttacctgtgctctttttaagtgacccattgtctgtatgacgtaatggatcttcatacatggatcctgcttgactttcagggacttgcttttgaagctctaaaagttttctttcacagcagtcctaagttaaaagaaagcataacaacaaatgaaagggcttgtcatgcacgcagtaatggtgtcagccgaaccttaaatatctagaaaatggaccaacatattctaaacactgtagttactatattcacatcaaaacagcttctttttttactcctatataattgccacatagtttaaaccacgacttctgttgaatttcaactgtgtttactctagcgaaagtgacagctaaacatcttattgctttaaaacaaatggaatacgtgtattttttccccccagatttgtctatattggcacgtagccctaggattattggctgctgccaacaggcaaaacagtaatgcatgatttaaaatttttcaggttatttatagaaaagatggtaccgaaaatgacatgttttctgtagaattaatcttttgctttattagtaggaaatcatttaaattttatttttaaactaaagattactgggactagtttatttatattttggacttaggagaaactgttgacattcattacggtctttagtctgttactccagtgcatcttaatttagtttaagtgattagggagaaaaaattaaaaaatattaaatgttcagcttttaatttgtataagtaatgtgattcatttcaatattactggatttcttatttttctcaaaaagtaatttatataatttcctcaaataatatgtataggaagaaagattattctataacattatacttagtgcttgttttgtgttatatacagagtatgtataattgatgacaatcatgaaaattaaaattggctggagctcttggtgttgagatttgaatttaaattaaattggggggggtcttgaaaaaaacattagagtagaaaactgtatttatgtctccatccctcacagaacccatttctggggtacaatgaatcattgactctttaaagcaccactgccatggctggattttacagagaaaaaataggcagttagcaatttctgctattttttaaaattatttttacattagaaaatagatttcattttaaactgcaacagtttagaaaatggcatgtagtcatttaaataaataagtagatccagaatatagcataaagtccctaacttaaaccaagatattatgttttatgtttctcaaataaaaagtttgagtttatggcaatttattataacaatgtttttgaaggacttcattgactaaactccatgctaagagtttgccagaaatgctgccttctgtagcaagtaaactttaaggatttaataacattttctagttacagtgggtttctaatcttcataggaacaagttttattttaacaggggctaaaacaggtatctggtgataacagattagcactgaatgtgtttaatcattgagcccagagcactttatctttttttttttttagtgttagctgttagcaagtattgtttactaaaggtttgcacacactcttgcctaattctaaatgtttttagaaacaaattaagatgaaactttaagatttgttagagaaagaataagaaacagcaataaactttattctccttaaaatgtaagatcctgctatgattcttcactggggggaaagaagatacatttagaaaattggttatctcagattcttagtatggttttagttagttagttttaccacttggtagagttaatgatttgacaaatgacatttgcttcttattatcagccagttggttgctagctttaaagagttattataaaggatttttttcagtattaatttatttcataaacatatatttaatttttatatattattatgaaaaaagggaattatttcattcttttttaaaaaagtctagaattagaggctaatatttccttatagaattgtcaggaaacaaactgttgtaataagttgtttttgtgttccaagagatgtgactttgtcagaatacatccaaattcatatttcttagcagatctttaacataacaccatttataattctttctgttttcattcttccttttttctcctggcctattgtaaagcagatctggcagccagaggttgtatcaggaaccacagaaagaccccactgcttaaatatcttcaaagcagtctttcactttgaatagatgaatggatattgctaccatgtaaggatatttaggtgaagctcatgaacaaatcttgttgtacagaagttatccctttgttctgcaatgccaaagtaaatttgggctcattattttatggaattataaagtaaagctaataaaatacacttatagcaacaaatgtttaattcccagtactagaaaaataaaatttaaattgtagaactaaactacttttaaaagcttttgaatatattggttaaatcccattaatacatacaaagttaggcacagagtttcttggtggatggaagaaagactgatttcacactattttaatcctctgtcaagacgcaacttattaattatatacagatagtttgtagccgatggatgtgatttttgttactgattttgcttaatgcagttacattaatgccagaatagtagaatcgtggaatagttatcaagttagaattttaagttcttggagataatagagcacattacactgcatatagaagatgatccataaattattagtgaaatagtaaatgatttagtgtgtccacagatgagtaaattaaggtcaaagaggtttaataaaaattttcggccgggcacggtggctcatgcctgtaatcccggcactttaggaggccgaggtggatggattactcaagctcaggagttccagaccagcctgggaaacaaggcaagactctgcctctactaaaaatacaaaaattaactggacacggtggtgcacacctgtaatcccagctactcgggaggctgaggcacgagaatcgcttgaactctgcttgaggcggaagttgcagtgagccgagatcgcaccaccgcactccagcctgggcaacagagcaaagctctgtttcaaaataataataataataataaataaataaataaataaataataaaaaaaattaagggaacaaagctagccagcagcagtgagagtctaaattctaaagaatttgggaagcctatataaggataattggattttgcaatgttaagatcaatggaatactgatttcacaaattcgggtgtctaagaactggtatcagaggttagcaaagcaggctgtatggcagcaatcgggccttggtggaagagagggtctcacgtttgcaagtgtgtgtagcagaccaatttattggccagtagctgcatgggcacttcctaaatgtttcacagattattagtttcacttagaattttctctctctggacctgaatctatgactctaaaacaaacccagaaaaaggaatcagtatgctcagaaagaaagatgtgaaaaacatccattctccagacaacgcatgtgaggaataaaaacaggtaaagtgattttgttcagcaccgtagactaaacttgactctggattgaattttcagagtaaaatgtgattaaaggcaaacatttagtactgtaaaacagaattaagattgtaatatttaggcatgtgtttcatgtgtgtgtatgtatgtgtgtatacctatgtatatatgtgtatgcagatacatacatatatgttacatatatatatatgttttaattttagtgctcaagggaggacccctggatggcacttacagattgattcagtttcactttcactggggttcacttgatggacaaggttcagagcatactgtggataaaaagaaatatgctgcagaagtaagatatacttttttttttctttccagggaaaaatgtttataagttgatatttagcattaatttcaaaagcttaatttgtaaattcaactcacgcccagtgaaccacttcttttacaaaggaccttcacatttgctttttataacctttaattgtgacatcatacttaacgctgcaaaactttctctactgtctccaactccaccatttgcaaaaagtaaacggactcaaactggaggatcctgttttaacagaaatttagaaataaaatgtgtgccttctgtcaaaactgtacatttatttgtcttagagttattgatgaaaacacttgctgttataccaagtactgtgtggatgattagaattaaaatgaaaggaaaattttgatttaaaattatccatattttcaatttcctgagtaacctttattgtgagaaaaagaccattgaataaaatctgtcagctttgattatgtaaatcactcactgtggctttgtctcttcggccttagcttcacttggttcactggaacaccaaatatggggattttgggaaagctgtgcagcaacctgatggactggccgttctaggtatttttttgaaggttagttgatgacccaattcttttttttccctatttttaataaagaatgaccagacagagtatttgtaacatacaggacattctacaaaagagcttaggaaatgcctttgtccctgaaatgttttcaagtttatctcctcctttcatatctgctagttgcagtggagatggagggcagaaagacaataggagaggtacttatttggtaccttttggatgtaaatgtgaagaacataaagagatcaacttgggtgactgctaggtgtttgtttgttttcttttcatttaacctgaggctagacagtactatattatgataaagtaagatcaggttctgaagaggggaaggacagtgaatttcaggcaacagtgggacagaaccggttgagctgccctctaaacagtggtaaaggggaatggagaaaggtctgggctggagatttatgagctctgattcatatgttgaggtggaagctacaggtgtgtatgaaatcatccaagtacagcacgaagagggagatgagaaatctgcccagggagcaatcctgagaaactgcaaaatgtaaggcctttacaaggggagagatgcaaattaaacaacttaaaaggggccaggtgtggtggcttaagcctgtaatcccagcaccttgggacaccaaggcaggaggatagtttgaggccaggagctcaagaccagcctgggcaacatagcacaattccatctctacaaaatttttttaaaaattagctgggcataaaaaacaaactaacaaacaaaaaaacaaaacaaaaacaaaaacacaaaattagctgggcatggtggtatacacctgtagtttcagctacttgggaagccagggcaggaaaatcactgcagcctaggggtttgaggttgcagtgagctatgatcatgccactgcactacaagctggatgacagagcaagactctgactctaaaaaaaaaaaaaaaaaaaaaaaaaagcgagagtcaagagagatttgggttgctggaaggcgtagggaaagccaaagaagaaaataatttttaaaaagaagggaagaccatagtgtaaagtcctacaaggaaatcaaggcaagcccttgaggagtatcctttggcagttagaggtcactggggacaattgagctggtggtttcaggactactctctgagtggaattagaggcgagttgaagattcagtgaaagtaggcaagtctatggtgtcagtgtcatcaagccagtactgatgggggtcatgtatgaagtggagaatttgggctcactatttggatgttttctaatagagctacccaaataaaaataaaaactggtacagtaccaactgggtgatagtatcttgccctttatgtttttctttaggttggcagcgctaaaccgggccttcagaaagttgttgatgtgctggattccattaaaacaaaggtaaatttgaattttctgccacctccttagggtaccaattttcaatactccattggttttagaaatttcttttgatcaaattgcacagtctcaatgacatgtggtgtttggatgagcagttagtaaaggtagaatattccttaaatatttaattaacgtttctttcaacaaagttgatcctaatgctagcataattctaagacttgtatttatttaatcttgctcccccatcatttggacatccatatgtaagagtcagagaatcttatgcctgcaaggaggttcaaaggtcctctagtcaaattattcactcattcatacagcagatatttgttaagtatgtactatgtgccagtcgctttgcaaactagtagacacaatggtgaacaagataaacaaggccctgtttcatggagatttctattctatgacctctttgcattcatccatcctgcatttaaatcctctctgcagcatagttgtgttgaggtcgttgagcatctgtttaaacactacagtcacttccggtgatggggaacttatcaccaggggcagccctggctttataaagctgatcttcacattgaagcagcatctatcctctgaaatgctcactcactggcttgagccccttgaattcatagaataaacctgatctctcttccaaataactctactctgtctctactttgttttttcacctaccccaaactaattatctttagtttcctttaactattctcatatgatatagttttctctctttgccaccaccttgtcattcttccagtaaatcattcctgtttgcttgaaaagtgtagtgtccaaaacagaatgtagttatttgattctgacctagagcaagaaaatcacctcctcatcaggataccatatttctgttattgcaacttgaagtcacctcattttagtggcagcagtctcactttaaatactgggtgtgatcagctaatgacttaatggagaatgtaagggatcattttagataaaaggccaagatgaaaaatggacatgtgaaaatagtttttttttttttttactacgacttgccacatattttcaagttgaatgtcttctgttaatttctttttattttgtttgccagtgaatatagaacctcttttttaaaaagtgtttttgaccatcagaggggagtatacctatttgtgtctgctgctctcctaccttcctcctactctgtcaatgtgatagtttgaagctgcgtatttgccttgttctagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtttgttttgtaatgacaggtctgtttacgggtggagcatttagtcaaggcagaagaccttggcctccagagtgagagagacctgagatttaatccttctcctgctacttcttgctatggaaatagtgcctttgatggtgcctagcaaataaacagcgttcagtaaatctttgttgttattaactataaacttagttcgtttagtctctaaaattgaatagtcattgtaaggattcaatgagaaagatgtctgtcacctaataaatgccttttttttttttttgccagttatgaggaaactaaggcttagaaaagtgagagttcatattcaaggttacgcaggtatcagtgagttaccagcctactactcactcacataagggctttctgctattttatttatatcagaatgcatttctgaatcctgacagatgagagtcatcccttggagaacatgtatctattaaaactcactccaggttgctttagaggcttagagcaggtattcttacatttccaataaaatatagtgtgtgatcgtcaagtgattagtgcagcttctaagtcactgatgagcagccactaaagtggatacaaatgagtttttcctagacttacctcttagcgcacagttgaaatgtagaaagtgaacattccttaggattcacaagaggatggatcctgaataatttaaggatagctttaggagccaacagtcttgaaaatggtaactatgtgagtagtggtagtgtgatttaaacctacaaaaatgctgaataatagaggtttagagctgcaatgtgcaatagagatcatgttgtccaactttctcatttcactggcttgaatcacattgatcaacagtctgagatgcaggaaaattgaagtgttttccactcagctaccttgcaacagaatcaggcctgggagcaaggattctattcctgtgtcctcccttagaatatgaacttatgaatgctgaagatacttcatatctttctttaaaggaaatatgtatctgactggaaaattacttgtagcatatcaaagtgggcctaaaaaatagcatgcttggtatgtcacttgaagattgaccttgtagtaataacatatttgagtaagcttcttgaagtgtagcgtaaggaaagattataatgcccttctttttgtagatgcagtgtttacattataatttaaaacatgaatttttttttcttctttcactgagagcaatgcaactttaaagcaatagtctgacatttagagccattataacaaatggatttatggtgtatacacacccacaggcagaaatacacatatagataagggcagttgaacctactgcattaatccctgtaccctgagtttgctctttaaagttgaaagtggtattaaactaatgatgttaattgtatatattggcaaaataccaatagggctcttttttttgtcctataacatggaatctggaggaaggatcatgctcagctcaggaagctagggctgcaggtcctcctctatctgagtcccttgacttggccttgccaattggtgacttcatcctcaaggtggttgtaatagcattttgagcatcacatctagatataaccacttcttgaggaggaaatgaatacctcttccattggcttcctaagagcagagaagctctttcctgaaggcccctagaaaacctttcacttctcactggctagaattgtgtttcttgctcagtccctagcccgggaatgtgatcatcacagtcagttaagacctgcaggtttaccccactgaggcttacagggagagggcggatgtctgttaatgaggaagtatgggggggcgtggattttaggtaagcagtataaatgggtctgctaattctgctacctttattttctatacccaggctctgtctctgtgatgctaaaacaatgagtcaagttgactaatgtgacagtgtagtttaattggtgcagtgagtagcagaaatcggttatactggtttgatcaaaagtttgacctgtttacactttatgaacagactctctttcagattgctggaattctgttgtaacgaatcaaccctatatatccttagaatgctcccttgcattcagtaaccatagctgtgcatgttataatgtatgtgcatggaaggtggctctacgggggtgattgagggactattactggacaaaagagatcaggttaaaggctgttgattcatgggctgctatattactgtccaaaccacccttttgcatttggatcacgtcttggttagaggggggaaagtagcactttttgagaaccttgaagaagtgggagactgttcaacagctgcctgtatctcagtggtggccagtaaactgaaacaagtttataagggaataaaaatcaaccagtgacaaggggttctaatgttaaatgcatatattggcaaaatgccagtagggctatgtagggtggtgagcactcacaattgttcactaaaatgctgtttttaaaacaggaaagtagaatggttgagtgcaaatccatagcatgagataaattgagcttcttaaggcaaatcagcctaggcaaattcatttccgtgtttttgtgtatttggagatgccagctcgtcactcagcccatggagcttacaggtcctgatcacttgatctaattgtatggatgtggtagtttgtcttccctggggcagaaaacaaagctttaatttggaactaaaattgttattattttgcatctaaaggtatgagtttatagacttttgatgttagatttttaaattagaaggtcactgaaaatttcccttaaaaatgaccccaacgaatttgtgtattttgtataaattggtttgttatattaaagcatacatacataatctatatgtgattatgtattcattaggaatcaaactgaattttggccattgatgcacagcactgaatgttgtggaatgtaatttttgtttgtttttgtttctgttttttgaggcagagccttgctctgtcgcctaggctggagtgcagtggcgcaatctcagctcattgcaatctctgcctccagggtttaaatgattcttgtgccttagcctcctgagtagctgagattacaggtgctctaccacgcctgtttaatttttgtgtgtgtgtgtgtgtgttttttttttttgtagagacagggtttcaccatgttggccaggctggtctcgaattgctgacctcaagtgatccacccgcctcatgcctcagccttacaaagtgctgggattacaggcatgagccactgcgcctggccggggaatgtatttaaagatataacacaagtatataactgaataccattgtgaaacattaattatcaatgttttattgtgtcttttaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattctattctgggttatttatttatttatttttattatactttaagttttagggtacatgtgcacaacgtgcagatttgttacatatgtatacatgtgccatgttggtgtgctgcacccattaactagtcatttagcattaggtatatctcctaatgctatccctccccactcccccaaccccacgacaggccccagtgtgtgatgttccccttcctgtgtccatgtgttctcattgttcaattcccacctatgagtgagaacatgtggtgtttggttttttgtccttgtgatagtttgctgagaataatggttcccagtttcatccgtgtccctacaaaggacatgaactcatccttttttatggctgcatagtatttcatggtgtatatgtgccacattttcttaatccagtctatcattgttggacatttgggttggttccaagtctttgctattgtgaatagtgctgcaataaacataggtgtgcatgtgtctttatagcagcatgatttataatcctttgggtatatacccagtaatgggatggctgggtcaaatggtatttctagttctagatccctgaggaatcgccacactgacttccacaatgattgaactagtttacagtctgaccaacagtgtaaaagtgttcctatttcttcacatcctctccagcacctgttgtttcctgactttttaatgattgccattctaactggtgtgagatggtatctcattgtggttttgatttgcatttctctgatggccagtgatgatgagcattttttcatgtgtcttttggctgcatatatgtcttcttttgagaagtgtctgttcatatcctttgcccactttttgatagggttgtttgttattttcttgaaatttgtctgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcttgaatggtattgcctaggttttcttctacggtttttatggttttaggcctaacatttaagtctttaatccatcttgaattaatttttgtaaaagatgtaaggaagggatccagtttcagctttctacatatggctagtcagttttcccagcaccatttatgaaatagggaatcctttccccatttcttgtttttgtcaggtttgtcaaaatattctgggttattttattgtgtactgagtggtgggtaatacagtaatggaggaacaaatgtctacttttacaattcacaataattccttattaataatgagccatcttaattggcttactgataattgaaaaagtctccagaaaaggaaaaactctggaagtcatttacttattatgccaagtacggttttaagtgctgtctgagcattcatgtgatcttcctgacaatcctatgaagattaatcctgcaagagaaatgattacattaaaagtagcaaggtagagaagggggaagagtgtgcacactgaatcaatataagccccttgggaaaaaaataaataaaagttcattttattcaaaaagggaattctagtgatatccagaagtgaaagaataatttgaattttaaaaagagaaattaagctgagcatggtggctcactactgtattcccagtactttgggaggctgaggcaggatgattgccttaggctgggagtttgagaccagcctaggcaacatagcgaggcttcatctctacaaaaaatgtaaaaattatttgagtgtggtgttgcatac

SEQ ID NO: 16284 - DNA, 29717 bp, Human
  misc_feature (1)...(29717): n = A,T,C or G
ggatcacgaggtcagaagatcgagaccacagtgaaaccctatctctcctaaaaacacaaaaaattagctgggcatggtggcgggcacctatagtcccagttactcgggaggctgagacaggagaatggcatgaacccaggaggcggagcttgcagtgagccgagatcgtgccactgtgctccagcctgggtgacaaagcaggactctgtctcaaaaaaaaaaaaaaaaaaggaaaataaaaatagtgaccagcctgggtggctcacgcctataatcctagcactttgagagaatgaggtggagggatcccttgtggccaggagtttgagaccagcctggccaacatggcaaaaccctgtctctactaaaaatacaaaaaattagccgggcatggtggcaggtgcctgtagtcccagctacttgggaggctgaggcaggagaatggcatgaattcgggaggcagagcttgcagtgagccaagctcacaccactgcactccagcctgggtgacagagcgagactccgtctcaaattaaaaaaagggtttcattctgttgtgtaggctggagtgcagtgacacgatcatagctcactgcagccttgaactcctgggctcaagcaatccttcttcctcagcctcctgagtagctgggaccacaggcacacatcaccacccctggctaatttttatttttgtatttttattttactgtatttattttgaaacagagtcttgctctgtcctccaggccagagtgcagtggcgcagtcttggctctctgcaacttctgcctcctaggctcaagtgattctcgtgccacggccccctgagtagctgggattacaggtgcccaccaccacgcccagccaatttttgtattttttgtagagacagggttttgccatgttggccaggctggtctcgaactcctggccacaagggatccatccacctcgttctcccaaagtgctgggattacaggcgtgagccactgagcctggtcattatttttattttactttttttttttttttttgagacggagtctcgctttgtcacccaggctggagcgcagtgccaggatctcggcctctgcctcccaggttcacgccattctcctgcctcagcctcccaagtagctgggactataggcgcctgccaccacacccggctgattttttgtatatttagtagagatggggtttcaccgtgttagccaggatagtctcgatctcctgacctcgtgatccacccgcctcggcctcccaaagtgctgggattacaggcatgagccaccgcgcccagccgcttattttactttatttttaagatagagtctcactctgtcatccaggctgaagggcagtggcgtgattgcggcttactgtaccctcaacctcctgggctcaagcagtcctcccatctcagcttcccgagtagctaagactacaggcatgagccaccgtgtgcagctaattgttgttggtattttttttttttttttttggagagatgggggctccctatgttgcccaggctgatctcaaacacctgtactcaagtgatcctctggcttcagcctcctaaaatgctgggattacagatgtgagctactgtgtacagcctaattcacaaattttttggagacaggatcttgctgtgttgcccaagctggtctcaaactcctggtctcaaggaatttccctgcctcggcctcccagagtgagacccagacttaaaagatttccagctgcctcagcctatagcataagatcagatattgattgagaggaggatgggctagccaacaatactggtggactgcagttttttatttttaccactgaagctggttaagatcctgtgaggaaatatacagtgtagtaaagttatcagatatggctgtcaggttagcaagatgaagactatttaggtgtgtcagcttctgtcaggcaggctgcaatgacaacggtactgtgcttatttacttttgctttttctctaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggtaccatacccgtacccttccttaggcccttgccctgtcactgcttttgctttcatcaaacaacaacaaaaaacataaccatatgagggatgatgtctctcatcagttttggatttccaacagctcatgatatccagtactcagtaaacctctgtttaattgacatgaatatgattttttcacatttacaaaaatgaaaattgaattcataatgagaataattattatgtatgcacatagtataaagaacagcaataaaagtaacacccacgtacccccccacccagtgtaagaaatagaacaacatccatttttctttttttttttttttttgagatggagtttccgtcacccaggctggagtgcagtggcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggnnnnnnnnnnnnnnnnnnnngtttaattgacatgaatatgattttttcacatttacaaaaatgaaaattgaattcataatgagaataattattatgtatgcacatagtataaagaacagcaacgcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaaaaaagaacagcaataaaagtaacacccacgtacccccccacccagtgtaagaaatagaacaacatccatttttctttttttttttttttttgagatggagtttcactctcgtcacccaggctggagtgcagtggcgcgatctcggctcactgcaacgtctgccatccgggttcaagtgattctcttgtctcagcctccagagtacctgggattacaggtgcctgccaccacgcccggctaagttttgtatttttagtagagatggggtttcactatgttggcctggctggtctcgaactcctgacctcaggtaatctgcctgtctcagcctccccaagtgctgggattacagacgtgagccaccgtgtccggcttttttttttctttctttcttttttttttttgagacaggatcttgctctgtcaaccctggagtgcagtggcccaatcactgcagccttgacctcctaggctcaaaggatcctcccacctcagcctcccaagtagctaggactacaggcacgcaactttgcctggctaaattttttaaattttttgtagagacatggtctcactatgttgttcaggctggtctcaaactcctgggctcgaatgattctcccacctccccctcccaaagtgctgggattacaggcgtgagccactgcacccagctgatacctatatctttagtagctccttgcgtttccctccccaacagataaccatcatcctgaattcggtgtttattgtttccttgcttttccttatagttttactttctacatgtatatttctaaagaaaacatggtttcgttttcatataattttttgcttttatgtaaatggaatcccactcatgccatttgcttttatttttgcaacattacgttcatgagatttatccatgttgatgcctgaagctgtggttcactcattattactgttccaagtattccatggtattccattctcctggtgtatgggttgtttccagtttctgctgtgaatgctcttgtgcttggcttcaggagaacatggacgtgcaagattgtcttgtttggcactgttaggtcttagggtatttgcagcttcaacttctctagacaaggacaagttgttttctaaagtggttgtgcagattgaaacacctcgcagcagggtatcagttctggatgcccctcatccttaccagcacttgtgatgatcagactaacatttgcatatagtatagcctctcagtgcagtttcagtatgcagtaccctgattacacaagataaggaacacttccatcacccccaaaatgtcctcatgctactttcttatagtcagcctcctctcccaacccctgtgtgctaatatatttctttacatccattccattttccacccaatggctagttagcattctggagtgctgaggctcccattgttttgagccttctttctggtggcaatgcactatgcctgcagttgcctggactctgagcttccactgggctttaatggcagaggagagtgcaaaggtagacttggaaggctgaggatggccactggctaaccacaaggcagaattccttggaaatgttcagttctgttttattgaattcatgcaaactttgatttctatcctaaaatgtctccatgtttataaattttaaaattacaagttatctttgcctccctcctacccctactgtatgaagctgtactgtttttttgtttgtttgttttaatcagtggcttcatagtagccctttcacagagctgggtgctattttacttcagaggcagggttttaaaaccttgaaagtcccttctagcacttttaagacctgatgtgaaaatggagtcgtatacaacacaattaggaggtaactttgttccagggaggggttctgagatgccattatgtcaaagcacttcatgccttctcactgctgcacagtaagcgcgactggctgtgcccatattttgttttgttttgttttgttttgagaaagggtctcactctgtcacccaggttggagtgcagtggcgtgatcttggctcactgcagccttgacctcccaggctcaagcaatcttcccacctcagccttcgagtatctgggactacaggtgtgcactgccatgcccagctaattttgttgattttctgtaaagacaaggtctcactatgttgcctaggctggtcttgaactcctagactcaagcaatccttccaccttagtctcccaaagtgtcaggattacaggcgtgagccaccgcacccttatgtccggcctgggtatgcccatatttgacttgcatactgtcttttaggatcagatctgttattcaaggccaggagcacctagattctctaaacaacccctcagagaaagttgaactctcagaggctgagtctgcaagattcagcatcatcttaaggtcactgcatctcttagacattttgactatggagaatgacattatttctgtctttctcaatccctggatgctgtgaaatcataaaagaatgttagaggctgggcgcggtggctcacgcctgtaatcccaacactttgggaggcccaggcaggtggatcccttgaggtcaggagttcaaggccagcctggccaacatggtgaaaccctgtctctactaagaatacaaaaattagctgggtgtggtggcatgcacctgtagttccagctacttgggaggctgaggcacgagaattgcttgaacctgggaggcagaggttgcagtgagccaagatcatgccactgcactccagcctgggcgacaaagcgagactccatctaaaaaaaaaaaaaagaatgttagagtggttaggtattgttaggtatgtatgtggagtttagcaatctagtccagccccttcattcgagaggtgaggaaacaggctcagaggactcactgaaagatggcagcagagctccagtgaggtttataagtttcttaaaagttgtgcagttttggggtcccatactttttaggtcaaaatcattctcatggcttcagcccctatcaaaatgctgaaggctcccaatctgtatatctagcctagcactgtctcctgccatccaggcccattgtatgtctagcctagcactgtctcctgccatccaggcccaataaccttctgcccactgggatgctcacagccactcagagcctgctcttgccttccttatctcagggaagccagacccctgggagttatccttgccagcagccactccctctcacttacagccaggccgtcccaaagcctttggatcctgcctcatcagggtctcttggactcatctactctgccctccccaactagggaggaggcctagcccaggcctagacccctgcagtggcttcctgtcatgtctccctccatcctgccagtcctttgccatgcttcccattgcaggggagtaatgtttctaaaacacacatctgattgtgtagcctcatgctcaaaagaatatgtcagtggttccccgaacttctcaggatcaagaagtttagtctccttgacagggatttaggtcaacttcatcacttcccaccttcccctcacaaaacaatctttttttcttacctaattcctattttttaacttcagctgtctgtgtatctggccctgcagacagaaagctttctctgactccctctaaaagtctgaattctctgactgggcgctgtgctcatgcctataatcccagcagtttgagaggccaaggcagaggatctcttgaggccaggaattcaagaccagcccagacaacatagcaagatttcacctctacaatcaatcagtcaatcaaccaatcagccaagtgtggtggtgtacacctgtagtcccagctgcttgggaggctgaggtgggaggattgcttgaactaaggaggtcaaggctgcagtgagctgtgatcgtgccaccgcattccagcttgggtgacagaactagaccctgtctttaaaaaattttaaaaaatccccacagagtctgaattctatcccatcagtgtgcctctcccatgaattactgtgtcctttcctcatgatggcatctggcgccatatggttaaagcctgcttgcttgtctgttttcctcagtggactcggagctttgtgattcacactcacattgcatccccaggacctaacataaagggtctgcttaatatgttctaagtggggttaatactttgtagaaacaagcaaaaaaaaaaaatttgttaaagctgaaattcatgtatctgaagaaactgtatcttcagtgttaccaagaagcctctagtgaagctgccccagtccctcaccagtgatggatgggcacagctgagcacagtgtattttttcccagagtttgtcccttttggctcagtcctgagctctttatctttcacaggctcccctgtgaggaattatgttctgagagaaaccgttcatgagatggattctactttgtttctcactcaggccatggagagtaagttgcttgttggaggaaaaaatatagtagatcatacgaatgaacagcagaaaatcctggagcagaaacgacaggaaattgcagagcaggtaacttttcattctttttcagggagaatgggtgaggtaaggtgtgtttatgctgcagagcaaacgtctcatattagactctcttcaaagagaatgagagcaaggtgtgtctgcctcatcctagctggagactctgatcctagcttggggaacccagcatagacacagtctctagggcaagctgatgaattttgtcatgttgctcagaaacgtcgagaaagagaaatccagcaacagatggaaagtcgagatgaggagaccttggaacttaaagagacatacagctcattgcagcaagaggtggacatcaagaccaaaaaactcaaaaaggtatgaaaggaatgaggccagatggagttgccttgagacttggggaaagggagaactctaccctttggacagacaccctcctcacctgcctctcccctcattccagctcttctccaagcttcaggcagtgaaggctgagatccatgacctccaagaagaacacatcaaggagcgccaagagctagagcagactcagaatgagctcaccagggagctgaaactcaagtaagtgccaggccttccatagtgcccccaagccacttgctgagtcattgatctcgtttgtttagttagaaacagccctggctgggcttggtggcctacgcctgtaatcccagtgttttgggaagcggaggcgggcagatcacctgatgtcaggagttcgagaccagcctgaccaacatggtgaaaccccgtctctactaagaaatacaaaaattagctgggcgtggtggtgcatgcctgtagtcctagctacttgggaggctgagataggagaatcgcttgaacccgggaagtggagattgcggtgagttgatatcgtgccactgcactccagcctgggcgacggagtgagaaaaaaacacaaaaaaagaaatagccctgaggacaggtccttctccagctcatctcctgccaccccatgttctgttcattcctgaaaaagtcactttccatctctggatcccatctgttaactgaatgacttcatcaggtgatctccaagttcccttctaaccctaccttctcgaagcttttaaagattctggtcttacatctgtctgatgataagagggaatattttattaacttgactttttattgtgacaattttctgaatggtataataaatacccaagtacccatcacccagattcaaggattaacaagcttttgccatctatctttcacaaaaatattttaaagcaaatcttaacctcatgttatctcactcctacatacttatatatatatatatatgatcacagtggttttttttttttttgagacagagttttgctctatcacccaggctggagtgcagtggcacaatcacagttcacagcagcctgtaacttgtgggctcaaacagtcctcccaccttagcctcccgggtagctggaactacaggtgtgtgccactatgcccagctaatttttaaaaaaaattttatagagatagagtctctctatgttacctaagctgatctcaaactcctaggctcaagcaatcctcctgtttcagcctcccaaagtgctgggattataggtgtgagccaccacacccagcccacaatactgtttttaaaaaagcttaattgagacatacttcacataccatacaattcacatatttaaagtgtacaaatcagtccgggcatggtggctcatgcctgtaatcccagcatttgggaggccgaggcaggtggatcacctgaggccaggagttcaagaccagcctggccaacatggtgaaaccccgtctctactaaaaatccaaaaattagctgggtgtgatggcgtgtacctgtaatcccagttactcaggaggctgaggcaggagaatctcttgaacctgggaggcggaggttgcagtgagctgagatcacaccactttactcaagcctgggtgacacagcgagattcttgtctcaaaaaaaaaaaaaattaaaaaatgataaagtatacaaatcagtgtttttttaaaagcatatatatgcatagggctataaaaccaccactacaatctaattttagaacatttttattactctcctctaaaagaaactctaccagttagtagtcactcctcattaccccctttcccaacccgaagtaatcactaatctgcttcctgtctctatggctttgcctattctggccatctcatataaatggaatcacacactgtgtggcctttttggcctggtgtcttttgcttagcatgacgctttcaaggatcgtccatgccgtagcatggatcaacagatatctggtagtcccaacatcaattgttctttattatgactgaataatattgcactgtatgaataggacacatatttatttatttttcagtttatatacattccgattatttctagtctttggctattatggataatacttctataagcattcatgtataaggttttgtatggatgtgtgttttcatttctctgggatacattcataggagtggaattgctgggtcatatggtaactcagtgtttaactttttgagagaatgccaaactgtttgccacagtggctgcactattttacatttctaccaccaatttctccacatcttcttttttttttttttctttgagacagtctcgttctgccacccaggctggtgtgcagaggtgcagtctcagcacactgcaacctccacctcctgggctcaagcgatcctcccacctcaacctctggaatagctgggactatagcggcatgccaccctacttggctaatttttgtgttttttgtagagatggggtttcaccatgttgcctaggctggtctcaaactcctgggctcaagcagtctgcccgacttagcctcccaaagtgctaggattacaagtgtgagccaccatgcccggcctctccacatccttgtcgacacttgttatttcctgtctcttttatcatagacatcctaacgagtgtgaaatggtacttcattatagttttgatttgcatatttctctgatgactaatgatgttgagcatcctttcacgggcttattggccatttgtatgtctttggagaaatatctatacaaatcctttaccccattttaaaatggggttgtttcatatatatatatgtatatatttcgtatatatatgaaatatatatatttcatacacacacacacacacacatatgtgtatatatatagtttttttttgttttgtttttgttttttttttttttttttttggagttggagtctcgctctgtcatccaggctggaatgcaatggcgtgaacttgactcattgcaacctctgcctcctgggttcaagcgattctcatgcctcagcctcccgaatagctgggaatacaggcacccgccaccatgcccggctgatttttgtatttttagtagagatggggtgtcaccatgttgcccaggctggtcttgaactcctaacctcaggtgatccacctgccttggcatcccaaagtgcttggattacaggcatgagccaccatgtccagccaataattaagttttaagagttttttttgagacagagtctgggtctgtcacccaggctggagtgcaatggcatgatcttagctcactgcagcctctgcctcctgggttcaagtgattgtcctgcttcagcctcccgagtagctgggactataggcatgtgccaccatgcccagctaatttttgtatttttagtagagacggggttttaccatcttggccaggctggtctggaactcctgacctcaggtgatccacccgcctcagcctcccaaaatgctaggattacaggcgtgagccactgtgcccggctgagttttaagagttctttatattaatatattatgaataccactttctcatgagattcatgatttgaagatgctttctgttattctgagttgtttttaaactttcttgatggtattacttatagcacaaaagatttccgttgtgatatagcccaatttaattgtattttcttttgtttattttacttttggtattgtatctagatttgccttttctggacctttcatataagtttataaatgaaataatgttggaataatgtggccttttgtgactgctttcttcatatgtgtgtgtgtgtgtgtgtgcatgtgtgtgttttgttagtttttttttttttttagagataaggccttcttctgtcaatcagactggagtgcagtggtgccatcatagctcacagccttgacctcttgggttcaagtaatcttcctgcttgagcctcctgagttgctaggacttcagttgcatgctagcacacctggctaattttttaaaattttttcataaggatgggtcttgctgtgttgccaaagctagtatagtgttttcaacagtcttccatgttgtagcatgtatcaatactttattcattttttatgaccaaataatattctgttgtataaatataccacattttatttatccattcattatttgatggacatttgggttatttctacttttgggtgttatgaataatgctgctgtgaacattcatattcaagtttcttttgtggacgcatgtttcattctcttagatcctctaagaggcttatagtgttaggtcttacatttaggtctatgatccatttgagttaatttctgtgtatggtatgaggtagggtttcaagtacagtgttttggatgcagatatctagttgttccagcaccatttgttgaaagggcttttctctcccatttcattgtcttggcatacttattgaaagtcagggccgggcgctgtggctcatgcctgtaatcccagcatttgggaggccgaggtgggtggatcacctgaggtcaggagttcgagatcaccctggccaatatggtgaaaccctgtctctactagaaatacaaaaattagccaggtgtggtggtgcacacctgtagtcccagctactcaggaggctgaggcagaggaatcccttgaacctgggaggtggaggttgcactgagctgagatcatgccactgtactccagcctgggcaacagagcaagactctgtctcaaaaaaaaaaaaaagaaagtcagttgaccgtaattaagcatttatttatttatttctggactttcaatactgttccattgttctatatatctatcctcatgctagtaccattctgtcttaattactatagctttgttagttttgaaatcaggaagtgtgagtcctccagccttgttctttttcaggagtgttttgactgttcagggtcccttgcatttccatattcaaacatactttgttttactgcactctgctttgttataattcacagatattacattttctacaaattgaaggtttgtggaaaccctgcataaagcaagtctgttggcaccattttttcaacagcatatgctctcttcatgtctctgtgtaagcatttattagcaataaagtattcttaaagtctatactttttgtagacaaaatggtattatacatttaatagactacagtatagtgtaagcataacttttatatgcactgggaaaccaaaaaattgtgttacttgctttattgtgatacttactttattggagtagtctggaaccaaacccacagtatctctgaggtatgcctctacattttaaggtcagcttgtcaatttctgcaaacaaagccagctgggattttgatattgatcacattgaatctgtagatcaatttgggcaatattgtaatcttaacagtattaagtattcagatccatgaacatgagatgtctttccatttatttattatttctttaatttttctcgagaatgttttgtagttttcagtgtataattcttacacttttgttaaatttatacctaagggttttttgggtgctatggtatatgacattgttttcttaattttatttttggaatattaattactagtatataaaaatactggctgggcatggtggctcacacgtgtaatcccagcactttgagaggcccaggtggacggatcacctgaagtcaggagtttgagaccagcccggccaacatggtgaaaccctgtctctacaaaaatacagaaattagccaggcgtggtggcgggtgtctataatcccagctacttgggaggctgaggcaagagaatcgcttgaaccctggaggcggaggttgcagtgagccgagattgcgccattgcactccagcctgggcgacagagcgagaatccgtctcaaaaaaaaaattttatatatttatatatatttatatatatatttttatatatttatatatatatttatatatttatatatatttatatatatttatatatttatatatatttatatttatttatttatatatatttatttatatatatatttatatatatttatatatatatttatatatatttatatatatatttatatatatttatatatatttatatgtatatttttatatatttatatatatttatatatacatattcatatatatttttatatatttatatacatattcatatatatttttatatatttatatatacatatttatatatatacatatttatatatatacatatttatatatatacacatatttatatatacatatatttatatttatatatatttatatttatatatttatatatttatatttatatatatttatatttatatatatttatatatttatatatatttatatttatatatttatatatatttatatatttatatttatatatttacatatatttatatatttatatttatatatttatatttatatatttatatatatttatatttatatataattgatttttgtctacacaatgatatttttatacctaaaaaaattaagtttcttagtattttctagtacccaatccacattcagattttcttggtttgctcgttttaagatctacatattaggactacatgttacatttggttattaagtctcttagacttattttaatctgaggcaattctttttattttttattttatttatttgtttatttgagacagagtctcactttgtcgccagactggagtgcagtggcgcggtctcggctcactgcaaactctgcctcccaggttcaagtgattctcctgcctcggcctcccaggtagctgggactactcgagtagtgagccaccacgcccagccaattctttttatttttaaaaatatttttcagccgagcatggtggctcgtacctgtaatcccagcactttgggaggctgaggcaggtggatcatgaggtcaggagttcaagaccagcctggccaagatggtgaaacccccatctctactaaaaatacaagaattagctgggtgtggtggcgggcgcctgtaatctcaactactcgggaggctgaggcaggaaaattgcttgaacctggaaggcggaggttgcagtgagccaagattgtgccactgcactccagctggggcaacaagagcgaaactccatctcaaaaagtatatatatacatatttttcatagttgacttgttgaaaagactgaatcagatagcctgtagaaatatcccacattgtaggcgggagtggtggcatgtgcctgtagttccagctacttgggaagctgaggcaggaggattgcttgagcccaggagttcaaggctgcagtgagccaagattatgccactgcattccagtctgggtgaccgagtgagacaccaactcaaaagaaaaaaaaaaaagaagaaatatactacattctggatttgttggtctctttcttcatggtgtcaattaacttgtatctctatcccctttatttagctctaactgaaagctatctctgaagcacgggttcccaaccttggctacaaactgagaagttttaaaaattaatgatgtctgagccccacctcagagattctgatttaattggtctagggcagtagtccttaaactttagcaggcatcagaattacctgaagggattgttaaacacagattgctgggtatcacacccggagtctgattcagaaaggctggggcagggcctgagaatgttcatttctagtaggttccaggtattgcttctgctggtttggtgaatgcactttgagaactcttggtctctcatgaggtctgggcaagatatttttcaaaactctgtaggtaacgttaatgtgcagcctggcctgagaaatgtggagctaatagtttcagccaacagatgatctttgtctggatccattatttcattagtggggttacaaaatgaccatgcctggccaaagaagaagttttcaaagggattcttttaatgatcaaattttaaatttggaaaagagcccttaaaattaaatgtaggcaaggtgcggtggctcatgcctataatcccagcacttttggaggctgaggtgggcaaattgcctgagctcaggagctcaagaccagcctgggcaacatggtgaaaccctgtctctactaaaaatacaaaaaaattagctgggcatggagacatgtgtctatagtctcagctactccgggggctgaggcacgagaatcgcttgaacctgggagacgaaggttgcagtgggctgagattgcgccactttactccagcctgggcgacaaagtgagactctgtctccagaaaaactaattaattaattaaatgtgtgtgtcggtcagtcctctttgcaggtatgtacatctagaaaaagatcaggacaaaatataccaacataataataatagttatctctggatagtgaaattgtgggtgattatgttttttacattttctttttgttgttgttgttgtttgagacagagtattgctctgtcacccggattggagtgcggtggcacgatcttggctcactgcaacctctgcctcccaggttcaagtgaatttcatgcctcagcctcccaagtagctgggattacaggtgcaggtcaaccacgcacggctaatttttatatttttagtagagacagggttttgccatgtttatcaggctggtctcgaactcctgacctcaggtgatccacccacctcggcctcccgaagcactgagattacaggtgtgagccactgggcctggcctgttttttacattttctaatgaataaatagaatcattgtaaccagaagaaagccaaatatgtgttataaaaaatagtttctgaaatgtcaaagagaaaattttagctccccaaaatatttttttttctaaggagtctattttcattattatctctctctctctctcttttttttttttttttttttttttttttttgagacagagttttgctctttggcccaggccagagtgcagtggtgtgatctcggctcactgcaacctctgccctctgggttcaagtgattctcctgtctcagcctcctgagtagctgggattataggtgcctactaccacacacagctaatttttgtatttttagtagagacagagtttcgccatgttggccaggctgttctcgaactcctgacctcaggcaatccactggctcggcctcccaaagtgttaggattacagacatgagccaccgtgcctggcctatatctctttttatatcttttgagtaaacagtgagtcagcctctttctcacagtaccctatacctctgtgctgtttgctttgtgtcccttccatgttcatttccttttggcattgttttgtcctgaggctttagaagagtaaaggcagagatataatgggagacagtcatcaccatagagagacaccaccagtgggttccagtttccttgtttgatgtgtttcctgggcacttgtcagacagagactgttagtaggaatggtcttcattctcaggggctgaaatccacttagtcctgctttttatcctggtcagttagaatgggaaattttccagcttggacaacgagccatgggattggagtaaggcagtttaatttcttctgtttttggcattttggaagttaatgaccttggttatcagcaccagtggccctctgaaagatacttcaggtagcaaatgttcactccaatatagcccaggggtcacctccctcttgagcctgttcacatcctgccccttcccaggcagaagtgacctctccatatttctaagacagaccactgtcagtacctattatacctaacagggctgcaccattaccctttgtttcaggcaggagccagatgtcatttgtgtctgtatctcagctctttgtatgatgttaggcccatcgtacttgctgagtaaatgtttgctatgtgccttgactcttacctgattactcaccatgcatgagaccagatagctgacacttcatatgtattctgtatctgttttcacctgttatgtgtgctcttacaggcatcttattatagaaaactttatccctctggaagaaaaaagtaaaattatgaatagagccttctttgatgaagaggaagatcattggaaactacatcctataaccagactggagtaagtcactattaactttaagtatattttcaagtatgagggaggaaaagaatgttgataacaagagccctctggtcaacaaaggggtttgataagaacacagtttggcttatttaaactcaaaacccactgcattactgattttctagctgccatagatccaccaggtaaaagtttgatcatgagtgtggttttaggaattgggagactttgtcactagtgagtgagcaagtgacctttccaaagttcctgcatttctgtttctccagctgtgaagtgaagtatgctaggtcacgtaaggggcaattcagagctgttatctttgtgtgtcattctgacccacagtgttgagaaggattctcatgctaagtctgggtgctgctggaaagatgggagacacctggcagggatgcagaggtggggggtgttgacagctatgctttgtgaatgctgtctaagaactgggtgatgattaaaaatctcttctggcttaaaagatgcatgatgctctgaatcagaaagcaactcaagcagaaaacagaagcatttcccgtcccacttacgtcagcctgcagtccagggagttacttgcttcaggttctgtcagtgtcttccgagtgctggttccacaggactccagccagggctttaacactgcagttcatttccaggaaccagcagatgatgaagcggccagtctcagccgtgggatataagagaccattgagccagcacgcaagaatgtccatgatgattcgtccagaggcccgatacagggtgagaagatccttcttgggtttttctcctgtctcttttggagtctagatttgtgtaagcccttagatactattccactcagagttcataccttctttccagaggtacttgaagacatttataccaataacaattataacaaataataaataaataagccgagcacagtagctcacacttgtaatcccagcagtttgagagtccaaggtgggcagattggttgattcccaggagtttgagaccagcctgggcaatgtggcgaaaccctaactctactaaaaatacaaaaattagccaggtgtggtggtgtgtgcctgtagtcccagctacttgggaggctgaggtgggaggattacctgagcccaggaggcagaggctgcattgagccaagatcatgccacagcactctagcctgggtgacagagtgagaccctgtctcaaaaaataaataagtaaatataataaaaataataactaataggccgggtgcagtggctgatgcctgtaatcccagcactttgggaggctgaggttggtggatcacctgaggtcaggagttcgagaccagcctggccaacgtggtgaaaccccatctctactaaaaacacaaaaattagctgggtatggtggcaggcacctgtaatcccagctacttgggaggctgaggcaggagaatggcgtgaacccagcgggtggagcttgcagtgagccaagatcgcgccactgcattccagcctgggcaacagggcaagactccgtctcaaaaacaaaaaacaaaaactaaaaacacaaaaattagccgggtatggtggcaggcacctgtaatcccagctactcgggaggctgaggcaggagaatcgcttgaacccaggaggcaggaggcggaggttgcagtgagccaagatcgtgccactgcactccagcctgggtggcagagcgacactctgtctcaaaaaaaaaaaaaaagtcagtactagagaaggagagtacaaacatcctgtctgtcatggccagtaaatattaacaatgaacttcaaaatggctctgtgggaaggctggagagaacacagatgtgtagtgacaggagatggacctgtcgtaaagaacttcaggtactttcatctcacaaaatgtgtgtcagtcatgtagtcatttaaagggacatcattgaggactatttaatgaccccaaaatagaaaaatagaaactctgccatgagagcctctactttttaattaaattaaattaattaattaatttgttttgagatggagtctcgctctgtcgcccaggctggagtgcagtggcgcgagctctgcttactgcaacccctgtctcctgggttcaagcaattctggtgcttcagccttcctagtagctgagactacaggcacatgccacgacacccagctagtttttgtatttttagtggagacagggtttcaccatgttggccaagttggtcttgaatgcctgacctcaggtgatccacccacctcggcctcccagagtgctgggattacaggcatgtgccaacacgctcagctaatttttgtatatttagtagagacggggtttcaccatgttggccaggctgctctcgaactcctgacctcaggtgatccacccgccttagcctcccaaagtgctgggattacaggcgtgagccaccgcactggccttttttttctttttttttttttttttgaggcaggatctcactgtgtcacccaagctggagtgctgtagcacagtcatagctcgctgtatcctcagactcctcggctcaagtgatcctcctgccttggcctcccaaagcactgggatgaccatgcccagctgagcacttgctgtgtgctgggcattgtacccagcacttgactgctttctctaattaagtttccccatcttctctatgcattcagtcctgttgcttaaaggtcaagtagtggggcaagtggctgaactaggatacacaacgtattaagttatagagtaatttacaccagaagtatatatatgatataaaatttgatgtaaaatgtattgaaatgtaaactgtttttctctggttggtggaagcacactcaatgttttttttctttttgctcatctgtattttataactatcaatagggaacttgtattatttttatagtgaaagattttcacttgaaatatttttagatgtttctgagtctctcttggcagccagagccaaacagaagattacggttagttagctctttgggtgccattcttcctggctttgagttatttaaaagaaagaaagcaaaagcaaaaaattaggtggagttaggtgttgtaaaacggcatcacttctttcaggcaggctctttcttgataggccctgaataacaagcaatttgcacttctattcttggaggggccctcgattgcttgtactgcctgtgtccagttggaggctaacctagctggtgatggctgtgcttctgcaggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggtgagtggctttgatgacgtgtgtttaaacagaacatgtttgaacaaggacaaaccaaagcaagaatgcttgtttatcatggaatactttgcagaacacactagaaaatattgccatattactcctatgtttacttatttattctacaaatatttatggttgagacactatgctgggtataccgaataccagaatacctaatgtccccagtcccttactataaggtgaatgtgttctagtgaaatagcagtcagttcttctgttctcatgaggtgtccggtagttctaagtgctttacaaacattctcttaatgatttcctgtaaaaacttagaaggcaaatattataatcagtcccattttatagacaagaaaactgaaacttagagaatttgagaaagtagccatctctaaggaaacccagcaagtaagggccaaagcaagaattcaaaaataggtcaatccagatccacaacccagtctctgggcctccatgctaagtttacctcacccatgtggtgcaaaactagtaattctgtcttattacatcctggattaaaagttgtaggaaaacaattgggtggaaaaccaaaatggaagaaattctacctgcaaacttaatatttttttatcaatcaggaaaggacagtacagtcaagctttggttttaaagaagaacaattgctaagcatcagagtctccttctctcaggttccacacctctgttctgaggccattttcaccatccccaaaggttcaggctgtgccagtgtagtggttttacagttgaacttgtcgttttcaggccattgaagaatggcctgaaatgaaatgttaatgacatctgatgtgtcagggacagagatggggacatgtaatataaacatgtgtttgacttttgcaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatcttttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccccctcaaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctggtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaaggtgtcctcataaatgactaaggcttttgaaaatgacatgcctgtggctgacacactgccattttcaataaacattttaactgggtgggagtgggaaaatgaagattgagttgggatgctggcattatttaatatagcaacaaggggcagggtgcagtggctcatgcctgtaatcccagcactttgggaggctgagccgggtggatcacttcaggtcaggagttggagacgagcctggccaacatggtgaaaccctgtctgtactaaaaatacaaaattgagtcgggcgtggtggtgcgcacctgtcatcccagctactcgggagactgaggcaggagaatcgcttgaggccgagattgcagtaggccaagattgcacaactgcacttcagcctgggcaacggagcgagactccgcctcaaaaataaataagtaaataaaaataaataaataatatagcaacaaggaaaaggacacaaaatgaagaatgatagagtgacaaataagtgtttttcatgtttttccgtggaggttcctgagactggcctgggcaacggcatgaaatttcttttaacttttgtgttttgttttaaaaattcttttaaatttactattatacatcatactttaaaatatatgtgcctttttttttttttgagacagggcatcattctgttgcccaggctggaatgcagtggcgtgatcacggttctctgcagcctcagcctcacaggctaaagtgatcttcccacctcagccaagactacaggtgtgcaccactatacctggctaattttttattttttgtagaaatggggtctctctatgttgcccaggctgatctgtgccttttttaacactaaagtattttatgttgtttaccatcaggaaaagaagatacaaaaaatgggccacacattgtcttttggatttccatgctcgtaggcctgctggagtgaccctggggggttgtgccccttagttgagaagtgggactgggtggaaggagcacagaccctggattccaagctgggtttgaattctagtattgccaccacttactagccatatgactaggaggaatttaattgacctctctgaactttggggcctttgtctgtaaagtggagtgattatccccactttgaagggccattttgaggatcagcgatacatttaaagcagcaagtacagtatgggatagagcaaacgtgaaaaaaatgtggttattgctgtgataaggcactgtgtttagaagacaccatgaacactttgtgtcccgagaaactagaagtcagtattggacataccatctttagaaaatcctaaagaaaagctgttaactgtttagtaatgtgtattgagtacctactatgtgtcaagctgttctaggcactagatatatagacgtaacaccaggaacctgcctacatggaacttgcactttaatggggatggaggatgggtaaatgttaaattaaccaaatgcacacaaatatatgattatgaattgtgtcaaatgtcatgaagttataataggtttttgtttttatttttgttttgagacgagctctcgctctgtcacccaggctgaagtacagtgagtggcgtgatcatagctcactgtagcctcgacctcctgggctcaaacgatcctcctgcctcagtcccccaagtaacggaccaaggtgcgaaccaccatggctgactaattttttaaaattttttatagagataggattttgtcattttgcccaggatggtcttgaacttatgggctcaagtgatgctcctgcctcagcttcccaaagtgctggaattatatgtgtgagccaccctgtgtggccaatataatagaatattataaaaggagagtggagacctaatttagatggggtgggtaaagtaggaaagggctctttgaagaaatgacagttacagtgagatctagaggacaggagttagctgggcaaggaggagtgaagggcatttgtgaaggga

SEQ ID NO: 16285 - DNA, 19228 bp, Human
ctcattcactgggctcctttcaccaatcccctgccatactcactctccctcctttacctcccaccttggctctgagctacttcagttcttcaattttcctcaagtatctttgctcacttcctggccttcgtactggctgattcctcagcctgtgaatgcctcagaagcaaggaccctgtgtgattccttttcttaatcccagcatggcacctgttcattcatttcacaaatatgattgagaggccacaatgtgccagactctgtgctaggtgctgggatacaggaatgaacaagaaggacaaggcctctgcccctaaggcactcacagttcactgcagagacactaaacatgtaaacaaatacatgaaaaatgttgataattgccagaaagagatgaaaaaagtttggtgatagggtaatgaggagattacttgggtagaggtcagtgaaatcctttctggtgacatttaggctgagatctaaaggatgggaaacagctggtcaggcagaaatggaggagaggattccaggcatagggaccgccacctgcagcagtgcagactggaagacctgagcatgtgtgaggaacgcaaaggagttaagtgtggctgcagctggaggatcagcagagaagggagttgtggagatggccagtggaggccacatcattcagggccctgaaagtcatggtcaggagtctggaagccactgggggccttaagatcatccacttccacaatgatgatccaccatacccatttcaactgtgcacctggcatggtctttagattctcccctaccctgctctctttattttcccttagtattcatcatcctctatgaaactatgtatttattgttttatgtttacccctttttgggtttgcttgtttcgagacagggtctcactctgtcacccaggctggcagtgcggtggcacgatcagagctcactgcagcctcgaattcctcggctcaagagatcctcccacctcagcctcccaagtagccgcccagataactcccaagggactacaagcacacgataccacgctctgcttttttttttttttttttttttgagattggattttcactatgttgcctaggctgatctcgagctcctggcttcaagtgatcctgcctcggtctctcaaagtggtgggattacagaagtgagccaccgcgcctggcctacttattctcaattgtttgtcttccccaactaaaatgaaggctctacaaggacacggagtttatcttattcactgcggtattcccagtacagagaacagggcccggcacagaataggtgccccataaatatttgctgaatcaatgaaaaatcaccaggagccagcgtgggtcagtgacatcaagtcctgccccactaactccatttactggaccctggactggcttagacctcaagcaagtcacgtaacctctcccagcctcagttttctcatctgtcaaatggaaagttggacacgttggcccctctgtgcccttgcaactaaggcagagaggagaagagcatgccccgtcccgctctgaggttctctcctggacctgtgaaggtgtctctgggcgcatctgaggagtggcttttcctctcccggcctcagtttctccatctgagcagagggcttgggaggccttacccatgcaggggcagtagagcaggtaaccggccgggtcccaggagcccgcgggcatccccgggagcggcagaagcagcagcaggaaagacacgctcagcggccgtgcccacgcggcggcgcccatgtcggcccgggaacccgagccagccgcggcgcacagtcggggagggaaggagggacgcgagcgcccgccccgctcccagcggtccctgcgcgccgcccgcgcaccgccccggccgctctagcccgcgggcgggcgggaccatagagatcccgcggcaccgccccctccacgacccgagcgcccgctcgcgcggctcccacaatgcaccgcacaatggcccgaccgccgccactaccggggcctgagggggcctggcggagcccgagcgcggcccggcccgcagcgtggggccccgagcgcggtgagtgccggcgagggccccaggggacggcggggagaggggcgggaggccgtctcgctgcgtccgcgcgccctgtacccggagcggcggcgcgcctcatctcgggcccctcagcgcggtcgcccacacccccgacccggggcccggtctgcgccaacccggccccagataggccctggggtgacgaaaactctccctggaccccatacctgtgtctgggggacccgaggaagccaccggtcccctcccttccgagacctggagacgcagtcctgagggtcccccattcccgacccctaggctccctggagacccagataaggcgctgctgaccttaccagggacccgggtctgggggacgcagataagctgcacctgctccctccctccgacacgcctacccagacccacataaccccctttcctgctccagatagcccgctctgtaccctgtttcattttccagacttacataactccctttgaggcttccctcaaatatctgggtctggagaagtcgaataagccccacctgtagttccctcctcagtggccatactcccaggctttcgacatcttccatcccgttacccattttgagaccctcttgaaattcagaggatacacttctgactatccccatccccccagccttccaacccttataatcccccatttcattcttgtggggatcccttagagacccaggaaagttgctcatgattccttcccatcctcgctcttccttcccatcccagagactccctccagacttctccctggatttcctttgcttctccagccctcatccactcccatctctcccaggctcggggaattgaacctttcccacaccacagtggggtgatctaaaagttggcctgggaccaggctgtggcccaccttggtggggagaaaggggcctgttaggtggaggatatggggacacctgtgtgggggaatcggtgctttcacctgcaagcttagcctgtctcctggcttgtgtgtttttccacctgtcagccatgggactgtgtgtagagtctggtcttgggtttctaacctttctctcctaaggtgaggccaccagattgggagcgggggtgtcgaatcacgttttctccccatgaaaatggggttgtgatgagttgcagccatttgttcaaggcctccccaggagtgggaggcagcaggaatctgaggaaatagtgaatcaaagagactccaaagagggcccatctacactgacagaagaattagcagcctgagagtaaatccaacccctgttaatcctgtttgatgtttcttggaatggtgcaagtcattgagactctccagcctccctgtaatttaattctcccaccactctggagtgggcgggggggaagggggcgacagcattcccatttcccctcttctcactgttttccagccaaccagtgtgttttaggatttgtttctggttctgagatcaggatctgttttttgttttgttttgttttgttttttctttcctctaagtctatttataatttcccagttgctattttgggttctgcttaagggaagattctatcccaaggaacgttctgggtctatttcctccggcaggtgttgaattgagttcttcagatccccaagtaactcttgggcaggaggataaaagctattttagggtagtcactgaagtggagctgttaatcctctgtgggtctctttagttaagaacactcaaagattaaccctttccttgtgcaggggtgttatctctcaactgttttttaggggggagtgaggagaatttgagtgtggcagcagaaggtggaaacatgcaactcaatacaaagacaaagataatagctctcttttgttgggtacttctagcaggccaagctctgtgctgagccctttgcatacctcactaaaataatccttacagcaagcctgtgaggtaagtatttttagctttacagatgaggaaacaggctaataatggagaaagaacgcagtttctatagagatgatgtaacaccataaaaactatagtttcatcagagagcagcaggcatcatggcccataacaggggacggacagactggggagaaatatgtctcagtttcagctttcaaagaggaccatacagagtttttagcaagcattcctgtttgggatatggagccctaataatacaagagagtataggaaagtggctctctgcttaagagagaactctggcccaggagatggtgcctggagggaggtaaagtaaggggctctttaaaggggatgtgccgagggttagttgtgagggaaaaggggaagactgcattctgggggagatgttgggaaaggaaggaaactcactctgaggcctgagaagtaacattaaagaggaaaaaaagaagtactattcaggcctcatgcggaaaaagaggcagacacagccgagacctcagagaaggcactgcatgtattcagagcacacattttgtatcagccactttcaagagtattatttcatttaatcctctatacgaatcttacaggtaaggaaaataaatccgtattttagaaattgaggaaactgaggttcagagaaataaagtaacctgcctatggtttcccagccagtaagtggcagctcttctgatagcaagtccaaggttctttcccctttcagatcaggcactagaaagaatcttaggctgaaaatatactgagttgtgccagtaactgggaaggattgtgtttgttttatggaaacaggttctgtcagcttctctatagtctatagttgttaagattaaaatgtgagaccagaagagcagctttgaaagagaagtagaattctttcacagttttgctgaggaaggacaagtctgaaggaacaggccttctgcttatgtaagacaaacccaggaatctttctggatcagaggagttttcagacaaagggcagagagagactagatccccaaaagggttcctaggtaacactagcagctttggttatccaagaggctgctggtgactgtaggtagggacttcctgtgccttttgaaaagtgtaggagagtaggatcagggtgttggctcttttctttgtgaagacatagccccattaaaagcagatcaaggtgagcacatggctgctgctttcctcctttggttctatcagtacaagctccttagccaccaccagcctctttcctagaagcccattactcactctttcagtagcagcctactaaactattgtgtcttgtttgtgcttgttcaggagaacagatgaggtggacgtgtgggaggtggggacgtaatgttctctttctgagtttgtgtggagtttccagggctaggctcctctctcacatcagccaaattgatgtgacttgtttccttctggctgccattcccaactttccagaggctgaggtgcatgatttcaaattgaagggggagtagaatttgactttgaaggtaggggtaattccctccaatctaaacatgcacactcgagcacactctctgctcaattccaaggtgcatagtaattgctggtattacaaacaggtaattccacccttgcaaaggaggaggggacttaaacaatgaaagccagacgtcacaggcctttgaggtttatagtgaagcaggcacatatgccataatgacttgaaggctcaagtgggactagtttttagtgctacctacccctccccagcatgtgattcatgcaaaatgcagccaccttaatgcagatctttctagacaaatctacactcgtgatggggacgtgtttatcatattacatcgcagtgtttcttcaacaagaggaatggttcctgaacaggacgtagctcatgttaatgatgagcaaagctctctggggcatgaacccgctgatcccatcatcttgttcacggccagtctgttggatgaatggtcactgtaagcagcaggtgctaatgagctgagcaagcattctgtggcccacagctagtttgtgcagttggagccctccccagattctcgtggataatccccagacacccccttttctctcttcacatggaaaagcctcatgatcaaattttggcaccatctcttcaaagggaatccccctgttgtagcaggttgcatcgtggttggtaatctgtggtaagcttgggagtatgaatgtgggtctcttgtccccttttgagagtcagtgtggtaactcccatcctcttcctctggattagtatctggaatggagttgtgtcgttcttgcacatctccccttctattcaacaagagaaagaatcagactttaagatttcggctccccacttgggaatggctgcgaacccagtttaaaccagaactacctgggcctaggttggtccctgagaatcaacctgcattcagtgactagtttacctatctgaaataaagttagggttccttttctagatattaggtatatagagatgaaagagagatgatgcaagccctcagacaatcaggctggtggagaggagtaaattccaatgcgagctcgctaccgtcttctaaaggagatgtgcatatgtactctgaggccctgtaggaggggcctctcagcacctaggggtgttggacaggctttgctaaagagggatggtctgggccctgagacacagtgacccagagaagtggtggtggtcaggatgggaccagttctagtcctggtttagggaaaatgctaagaatctgctgttgccttcccatatagaccctcctgatgttgatgcactgctaagaaacacatctggtaccaggactgactaggatgtaaatttcctaagtagaggcttccccttcctcctctcttgccttttgggcattttattgctccttagcacctccatgaggaggacaattgtggaaagtagtggacgaggaggtgccagggtaataagaaggaggaaccgctatctctaggttcaatggaaaggatataaaagtgaggtccagaagaaaaagtttgaagttttggggcttttggttcctcagtttatcttgtttcttattagcctagatggtactagtaatagtagctaccactaagcacttaatggatgcccagccttctgctgaatgctttatattcatgatctcatttaatcctcaaaacatttttataatttaggagattattatgcccattttataaatgaggaaacagctcagggaagtaagtaattggctgaaagtcacacagcttctaagtggaagggctgggattggaacgggatctgtctgcttccagagcccatgttctcatggtattgggctccctaacaccaggtgttctgatgtttcaggtgaagagattgttttctgaaagctgcgttggaggctgtgacagagctgagagcctgtgtggagcggatggggaggctttctcaataacatggccctttgccattagccttgccatgaccacatttttcaccagcgtccccccctggattcaagatgcaaagcaggaggaggaagtgggctggaaactagttcccaggcctcggggccgggaggcggagagtcaagtgaagtgccaatgtgaaatttcgggaacacctttctcaaatggggagaagctgaggcctcacagcctcccgcaaccagagcagagaccatatagctgccctcagctgcactgtggcaaggcttttgcttccaaatacaagctgtataggtaggtgacactctcatatctcttcctgccctgaggttcccagagggaaaaagcagagagactctgcctagtgtgggtttttaatctgtggcagaagagtggaggttaatttgtcctacaagtataccctgaatgccaaacagttgaagtcactcactaaaaaatgattcagattgcttgattcagacactagaatctgatgggttgcctccccaaagtattgggattgctggcgtgagccactgcacctggccttcttacaccttcttagtgacgatctgggtgccaatgtcaggcagccttgagttttgtttgtttgtttgtttgtttttttaagaaatgggagtcttgctctgtcatccaggctagagtacagtggtgcaatcagctcactgcagcctccaattcctgggctcaagtgattctcttgactcattctcccaggtaactaggattacaggcttgaaccaccgcacctggttgtttttaattttttgtagatatgggggtgtggctgtgttccccaggctggtctcaaactcctgggctcaagtgatcctcctgccttggcttcccaaagcagtgagattacaggcatgagccaccgcacttagccctgaacatttttttttaaatattgctttcctcacctttgtcagttgatggtcagaattttagctagaagttaggaatcagtattcgaactttagaaggaaaagtagaccttctggcccagtctgtaaattttaaagtagaggttcagagtagggacataacttacccaaggtcacacagcttcagaggtcctgcagtgcctcttctactgaatcagcctgctacttactcatttaactatgtctgtctccctgttgcccactggggcagctgcttttctgaaacttgtaagcccaagaacccctacttaaagtgaaattaaacgtaaaagccctgacataaggcagatagagaagagcagctttggttgctttggtgaggatggggaggcatggtcaaaagcaattttgggccaggcgtggtggctcgcacttgtaatcccagcactttgggaggctgaggcgggcggatcacttgaggccaggagtttgaggcaagcctggccaacatggtgaaaccccatctctactaaaaattttttaaaaattagctgggtgtggtggcacatgcctgtagtcccagctacttgggactctgtggcaggagaatcacttgaacccaggagaaggaggttgcagtgaactgagattgtgccactgtactccagcctgggtgacagagcaagactgtctcaaaaaaaacaaaaaagagcaattttgattttatccttttcgcattagaggaaccatgaacttgccctttagaaatgagatagatcagccgggtgcggtggctcacgcctgtaatcccagcactttgggaggccaaggcaggcggatcacgaggtcaggagatcgagaccacggtgaaaccccgtctctactaaaaatacaaaaaaaattagctgggcgcggtggcaggcgcctgtagtcccagctaccgggaggctgaggcaggagaatggtgtgaacccaggaggcagagcttgcagtgagccgagatcacaccactgcactccagcctgggcgacagagcgagactccgtctcaaaaaaaaagaaatgagatagattggcctgatgcacagtcatccaaccatccattcatctatccaacattattgagctcttgctctgtaccaggcacagtgctcggtgcaaggggcggagtagtgagccagacagatgggggtgctggtcctccttgggtttatggtcttaatagtgggtacagacagtaaacaagtaaatacatgaacaagatgaccacaaagcctcagttcctcatctggaaaacagttaataggaagggactaaaataggcaacagggtagcatggtagtcaggattgccctcttgacaattctgtggtcctcaggagtgcttagattctctgtgtgctcctataagttaagggaactccagtcaaggccatactcttaggctttcttttttttcttttttttttgagacagggtctcacttttgcccaagctggagtatagtggcgtgattataactaactgcagcctcaaactcctgggctcaagtgatcctcctgcctcagcctcctgagtagctaggatcacaggcatgtaccaccaccacacccgctaatttttgcatgtttcctagagacaggatctcttccctgtgttgtgcagggtgatctcaaattcctggcctcaagcagtccctccaccttagcctcccaaagtattgggattactggcatgagccactgcacccggccttcttagactttcttaatgatgatctggttgccagtgggcggctgcaggaaaggtcctgggtcaggaggcaggagccctgactcatcacatataatttactgtgtgatcttaggtgagttgctagacctctttgggcctcagtttcctcacctgcaaaatgagggaaatgaaaagtggatcactcagcacctccctctctacattaccacgtcagttccatcacaggaggttgacagtaacccacataggcacgagcactcttgagcatgcatatgtgggatgtgggcagggggtgtgtttgataccctccaggtagaaaggatcacagagtgctgtacgagagagagacagctgttgcatacctgactgaacataggtcttccgaaggcctgtttaaattcagcctctgctagggtgagggggctgccttttttttagactcctttccttgtctggagatcaaggttaatgacacagcttatgcagagcctggcaaacagtgggtgctgagttgattctgaatatgctctggagctgtgaattgcagttcctggattctgagccacttttcaaccatataggatcaggtaaaccaagggacactgaagtgccataccattaaaacatttcttaaagtgttactggtttatatgacaagcaattcaagtggtacatactggcatgcagtgaagaatgaatgatcctcacactcgaagtcactattcctctccccaaaggcagctggtgggttggtttttgtgtatccttcctaagacattcaaacatgtatattctctttcttttttattttcaaaacagattgtatcacatgtactgtattgaacttccttttttgacttagccctgtatatcttggaaatttgttctagataaggaagtttatttatttatttagagacggagtcttgctctgtcacccaggatggagtgcagtggtgcgatcacagctcactgcaacttcaaattcctgggctcaagtaatcctgccttagcctcttgagtagctaggactacaggtgcatgctgccatgcccatctaatggttaagattttgtagagacaaggtctcgctatgttgttcaggttggtctgaaactcctgggctcaaatgatcctcctgcctcaccctcccatagtgctgtgattacaggcatgcaccactgtgcccagactgcacgtttaggtatattttattttctctttattgtatcatttaaaattatttaaatgtaatgtttaaaaaatgaaatactttcacgtaattcaaaattcaaaaagtaccaaaacttatacgatgaaaattctccatgacacccatctataagctgttcggttctttttcgcataggcagccactggtatcagtttcttgtatgtccttccagaaatattttagccatatacaagcaaacatacatatatttttccccttttcacatagagtcctagtctacatccactattctgcctccttgctttttttctacttcctgtctcttaggagcatgttccctgtaagtacacaaaaagcctcatttttgaaaagttgagtcattttatggacttatcataatttatgtaaccagttccctattgatagattggacgttcagattgtttctgattttttttgctactacaagcaatgctgcaaagaatgtcggtacacattattttgcagataggcaaggatatctgtagaatataactggtttggtattgcattgcaagcctttaccatggtttttatatctagtttcctgttaatggacacctttggttgtccagtcatcccttgtgatctcccctctttctgctttctcccctatcccctgtctctacccccaggcacatggccacccactcagcccagaaaccccaccagtgtatgtactgtgataagatgtttcaccgcaaggaccatctgcggaaccatctgcagacccatgatcctaacaaagaggccctccactgctctgagtgcggtaagaattacaatacgaagctgggctaccggcgccacctggccatgcatgctgccagcagcggtgacctcagctgcaaggtgtgcctgcagacctttgagagtacccaggccctgctagagcacctgaaggcccactcacgccgggtagcaggcggtgccaaggagaagaagcacccctgtgaccactgcgaccggcggttctatactcgtaaggatgtacggcggcacctagtggtgcacacaggccgtaaggacttcctgtgccagtactgtgcccagcggtttggccgtaaggaccacctgacgcgtcatgtcaagaagagccactcgcaggagcagctcaagatcaagacagagcccgtggggacatgttaggcctacttagctgcagctccacagtcagtgtgaaggaagagctgagccctgtgctgtgcatggcctctcgggaagtaatgggaaccaaggccttccctggcatgttgcccatgggcatgtatggtgcccacatccctaccatgcccagcacgggcgtgccacactccctggtgcacaacacgctgcccatgggtatgagctaccctctggaatcctcacctatctcttccccagctcagctccctccaaaataccagcttggatctacctcatacttgcccgacaaattgcccaaagtggaggtggatagttttctggcggagcttcctggaagcctgtctctctcatccgctgaaccccagcccgcctcacctcagccggcggcagctgcggccctcctagatgaagcactgcttgccaagagccccgccaacctctctgaggccctctgcgctgctaatgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttcagtctctgccatcttccatgactgcatttgttcctgcctgcctcggcggtatccacagaagacaggcaagaggattggagcagttttctcacaggtctgcaattctgtttttctccaagtacattatgaccccctcatccttctcttgaactggagaggggaagaaatgaaaggcatgcccacgtccgtcacctccccatcccctagtccccaccttgaacatcatgagctgttgttattagtcttggaagcagagtctgggttggtgtggatagcaaaggaggaagtctgagcccctcattggtcttcctcccacctgtcccttttccgggaagttgtggaattgttggaagaagagtttgcagaaggttaggaatgggtagatagctaagtcctaatctatgggtacattgttgtgtcccaaaccaaaattttccttatccacaatgtcccttctgtctcttccactttacagtggactcggccactgtgcataggcttctctgctctccatcaaatcacttccactttcctgtgcccccacccccgcctccagttttccgctagtatccggcaaggtttcttgcaacaaatgattagttcttttcttctgactcgtggggctccctgctgcagagagcacagcccttgcctggagcccaggaaccccatccttgcttcatctcagttcttcatgggcttcactcttcccactcacggaagggaggtagctcagggacctccactgtgggacccttgagacgcttccactctgattcagaaacacacttctacctctttactgttaactcttaacagatgcagtcagcagtttctgggcacttctctcagtaggtgcctcatgctgacttctccactagggtttcaggacaaactaccaaggaattgcctcagcctcctaccagtcctccctcacccaccttctgtctaggttcacttggtttgtcatcaggaactgagcaggtccaggactcagctttctgcttcagcctaagccagtactccttgtttgaggtaaaagccttaaaatttagctccctagctcttgattagaagcaatttggagtaagtgtgttttgatttaggcagggtagcttgggatacctttttaaaaacaccagatattaaaatgtctggcaaggttagaatcagactagatgatttgcttctaaaaattagtttcagtgagtcccagggactaattaaggtttattttaaaaagtgtctaccttggtacgcagccacctcctgcatgctgtgcatgttattgggacttgtattataggcgatggtatgtgagaatccagttgggactcgctgttgccatcctctttgttgtatctggttttcatcactagactcagcaacccttctcaccttaactgccaccttccctacactctcagtttacagaggccactgggcctctggctgcagaatacaaagtcccgggctgttagaggagtcctttcctctctgcctgccctttcctgtccctccctcgaattctctctccccgtaagtgatgctggaaaagtcataggactggcaaagcaactgtttaaaccctttgtaaccggggccttgcccccacctcctgtcttttctccttgccttccccactcctgtgtcctcccatctatcctgtctttcctttcctcctctcagtgtcctcagcacccacaaggaattttcctatcactgtgaactttgctggtacagaggaataatatctgccttcacctttttttttttggaccatagctagccagtcatttcttaaacctcccttcctaaaatctggggggtcggggggaaagaaaaaaaaagccttagtggcctggttgttcaaaggataagaatagctttatcctgcactcagtacccgaactcacttcagtatgcttactgaggccatgagaacctgaggggcatctgcccaggacaggagccatggcatatgacaaagaccaatgagggaccaggaaaaaaagtgatgtcccctttccctgccacctccagcctctgccagcaatgagctgtccccctcccaccctacacagtagctggtcagggctgagtacagtcctgggggtaaggggatgacatgcccaggtgtcagctcaaaggatctctgcatcatcttgaggtgggaggcagggaaaggagcgccaatgaggttccctgcaacccccgccctccagcccaccgcccaaccttttacaaatggcattttcttaattgaaaatccgggaagcaggtgtgattacttttttgctcgtagatattgtcctaagttggaattctcccactgccctaaaactttccctagtagtcctttaaactcccccctccctttttggtagctgttttctccgtcctctctccacctgccctcttatctaggagctgtttgtaagcacgatttttttaacaggttatattgtacaggatcaatattttgctttttaacaaggatatttatgtaataagaaactttgccttaggcaggtgttggccagaaaagtccagattcctctgggatcccaccctggcctctcctggaactctgaacctgctgtggaaggaattggccatgaccttcacctctggagagtagggtctatggcgagggaaaagggtgttcaccatgataacctagtgcctccatagaggggtttggaaaaattccagtccgatttctttgtgtgtcagctgacttccttagctgattgttcccacttgcacctctccacctttggcactagaactcctgagacaccacttctcatgcttctccctccctaccagcggtcaaggctttggagccactcttttgtaactccagattatttaaagagaaaagtacaagacagaaatcttctagcactttgtaaacacagtgaataacctcttggagtatttttggctttatataaaacaaggtttttaattgtaaagtataagtgccattagaaaatgcacagggcatatctttgttaaagtagatttttcaatgttttacagaattacattttcaaaaaaaggtttttataatgaagttgtttattaaaaacttctgaatgatgtgtttgggagttgtgaacctgtctgattgggaaacggttggagagagcctcgaattgggaagaattggagtctccagacatctttagcatccaggatgatggtgagcgtagggcagacagtaaaaacccctcccatcagcacctataagctttgtacttttaagttaaatatcatatttgcatgtctttgaggtaagtggcataattctatcagttaatcatcttggatgcaagagtcagacagccaaaatcaaactggctttaaacactgaaattgcatgtaactggaaaatgccagatgtagagcagtctttgggttaggcttgatccagtggctccaacatggctggcctcagcattcctatttctctctgctctgtcttgtgtagttgtgacttcatccacaggccctacaaagtagatttcccctttgtgtgggagtgagcagaatgctgcctggattccagacctgccattctcacacattgccagccagaaggaagcaaccctttctgggctctcaggagaggactcaccacagaagccccaataagcatcctgtttcattggccttgatgggattctgtgccatccccaaaccagttaccatatgccagtgacaacaagactgaaacaggagtggtttctcaaaggaaatttggggcactcttaagatgaagaattgatgctggttgtccaagaaaggacaaatgttcaccctagtcactgcccaaggtgtacagctggtgacagctaggacctgaccttacctatacttgtgcccaaccaccgggttcaggcagactgctgagaggcttacatagcttcacctgactttggtggtctctaatgaaggtcgttaccaccatcctgggtgccagcccttgtgctgagatcctcccatcaggggctcagactgaactggcttttctgtggtctggagccagtgtctatggccaagcagtgcaagtcacttgcagtccagccaagagcctatggggccgttaacaagtgcaggtgttttatgtacaaaggaagtgggctgacccttcatttttgaccttccacttgacaaatgttcactgtccaccccagtaggttaaaaccctagctaggaccctaaggaaatccaccttgctccctagggagtgtataccacagtataggtctgagggctcaggtgagggagctgttgtatccatttgtcaggaaaaggctgaaagctttctggaagaggtggcaaggacttccacgcagaggtggagggggattggaggtactgacctccataggccacagtttgggagctgagaccacaggaacacagatttgcaggatcgaggactaagagggctggccaatccagctcttagcctgccaggtacagttcctgcacttcaagctagagtccacctttggaagggtagcctttgggcctagcacaaagtgaagcaaggtccacctcgcttctgccaaccagcccaggaggaaccaactcctgttggggaaaccaggcagatgcccactcgctccctggtttgtagcatttaagaccctctctcaccccagatccttccactctgaccttgcttattttccccacatgaatatttcaagcacctgctttccctacatgaacgtgttgatcacctttgtgtgtcagaaaattaccattatctgccgctcccagtttcagtctggtcagtctttgcaggagatacctcttaagccctctgcatgtgcctgagtaatttatcccctgtaaggccgagagtgtcctacaactgccccaaagcgccactcgagtgtggaagccgggcgactcctgcctgcccaccgcagatggggaacactgagcaatcgcctggcgtggtggttgtgatgggaaagttttacttgtccaggaccagcgactgggcctgtcccctggtgtttgctccgagctgactcttgcttggtacacacttctccccacctccaccgccagcgccaacgaatgtgggga

SEQ ID NO: 16286 - DNA, 53562 bp, Human
ataaaatgtgaaggatgtaaacagtgactacacgtacagccgctacctttggcaacatggctggatattaacaacagtgatgggggtggcgggagggaatgtacaaaagtgaataagtaacattaaacatacattcagaacattatctgtttttataaaaagcacatacagactaggtgcaatgactcacacctataatcccagtactttgggaggccaaggcaggaggttcagttgagccccggagttcaagactagcctgggcaatacagcaagaccccatctctatttttttttaagttgtctatgccataccacaccgaacacatctgatcttgtctgatcttggaagctaagcaggatcaagcctggttagtacttggatgggagaccccctcaaaatagttagcactgtaggctaaagagaaggaaaaaaggcccatacaggtacatataccaaaaacataagagtagggtcattgtctttctcattcatggttcttccccccttccccaccaggggacattttacaaatgtctggagacattttgttgtcacaactagggaggaggatgctatagacaactagtgggtagagcccaggaatgctgttaaacatcctatcattcacaggacagtcccccgcaacaaagaattacctggcccaaatgtcaatagtgccaaatttaagaacccctgcattccccagcccccaggacagctttgctgaatgaattatgaatgaatgaatgaagaaatgactgtggtcctgatcagctggtagcaacgggaatagagagacgcggtagaattcttgtagttttggagattttggaggtgtgttacacagcatttagggtgatagcccctgtcttttccaggagagggtgtgttctgcccttgcctggagctgggcacaatcccatccacttggggcctcagtcaccctccagcccgactcctcccctcccccgaccacctcccccagcttgggagtcctctgagctgccaggaagccagggtggttccttcgggcagggaactttgcatggccatggtggttccttcgagagaggaactttgcatggtgtctgaatggagcaggcctgcggaagagaaaccgctgaccacagacctgcctggaagtctcgggccgcggagttggggagggccgggccagaagggaggggtcggagtggtggggaaaagagatcacgatgcttccggggtagggtaaggcctttccagggtgggttggaatctttgaagactgtggcaggaatcccttgataggtggggttaggatctctgaagggcagggttggaatctttggaccggcggtatagacccctgggtattaaaactcttaggcggcgggaggttagatcgcgcaggagcaggagcggtattggaaccctggggtttgtgttctaaatcttagggcagggttagaatccactgaagtgagagttcggatccttccactgggcagattagaatctttgggggcaagttgagtttaaaaatccttcagaggtgggattaaaaatcctttggcggggcggggttagtatcttgggagccttggagcgggtgctggggttcttagacgggcgggttcgaatccctaggagtgggatttgggatcctttggagactggggtaggacgctgggcggtgggatggggaggtgttagggaaagtggagcggaagggatgggggttcgcatccttggtggacgcgttagaagcctcctatggatggtgctaatattttttttctcttcgtggagggtttgggatccttcttgcaggagacggaggttatgaccctcggggagccggttaggatcctggggtggcgtctgaatcttcggggaggtgttaggacacttggggcggagttagcctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggtgagtgccgcgcacaggggaccgggaatacccggcccgcgaggggtcccaggaggcggagggagcccaggagcctggggagggctggctacgggtgcggctgggggcagcgaggggagacggaacgtcgggggagccgcgggtagcccgggggatgaggggtcgacagcgagtggagggtgccctagggaggggcggcactgttgcggactgctggattcccggggaaggggacgctcgggcccgtgcagtgactttatccaccacttctctgggccgtccaggttccccttcttgggggggggcggggattttttttttaatttaaaaaagaaaaagaaggaagggatggggcttcacagaacccgggaaggggaaggcccttacggttcccggtgggggccgggtcacgccgggttggcagccagcttggggaagggggtagttgggcggaggcgtgacgtgcgagccacacccaggccggctgcagctggtcggctctctgcccctcctcccacaacaggtctaggtcaaacccccaaacctcctggccccagaccacactgcatgcatgccctgtctctttcctccttggacgaattctccgcctccgaattcgtttcctcatctgtaaaacggggctatgaagtctttcttgcaaggatgcaggaaattggagtatgcgagaggtggtgcgtgtgagagacaggctagtgggtagcggagggggcttctaggggcaaactgcctgttggggctggggtagaggatttggcctttctttgcctctgttttcacaactgcaggatggggagagtaatagtacctccttcacagggttgtttagaggattaattgggtactgaaggggccgggcagggtggcacacgcctgtaatctcagctttttgggaggccgaggcaggtggatctcttgaggtctagagtttgagaccagcctggccaacatggtgaaaccccgtctctactaaaagtacaaaaattagccgggcgtagtagcacacacctttaatcccagctactcgggaggctgaggcacgagaatcacttgaacctgggaggtggaggttgcggtgagccgagatcgcgccactgcactccagcctgggcgacagagagagactctgtctcaaaaaaaaaaaaaaaaaaaaaaaagttactgaaggaaagctttgagaatgctgtctgacagtacacaggcttaatgtatgttaacattgccctagctagacatatggccccgtgttctcagactttagcctacatcagcatcacctggactgcttgtgaaaacagattgctgggccgaatcctagagtttctgattcagtagctctgtgcaggacaatgagaacttccatccccggtgatgctgctgctgctgatccaaggaggacactttgagaaccactggggtagcctatgcctggcacagagaaaggcctcaatgcctatcagttgccttatcccatggttttctctttatggtccttttttttttaggggagggggtgacaggttaaaatacagaaaagtgaagataataatatattagatgtcccgagaatccaccatccagaattaacaaataatagcattttgttgtgtttgttttgagattttaaaaaattaatttactaaaagtaacagaaaaaattgaagtctccccaccttgtatcactctcagtcctgtttctctccctccccaggggcaaccgctgtcatgagttacagtccttccaggatgtgcctctgaaaatggattgcatataaatgtacgcataaacaacacgtaggattgttttgtgtgctttaaaaatgctatctatgcagtggttcatgcctgtaatcccagctactcgggaggctgaggcaggagaatcgcttgaacccggggaagcagaagtcgcagtgagccgagatcgcgccattgcactccagcctggacaacaaaagcgaaactccacctaaaaaaaaaaaaaaaaaaaaaaaaaaaaaaaaaaaaaaaaaaaaaaaaagcccggacgcggtggctcacgcctgtaatcccagcactttgggaggctgagccgggcggatcacgaggtcaggagatcgagaccatcctggctaacacggtgaaaccccgtctctactaaaaatacaaaaaattagccgggcatggtggcgggcgcctgtagtcccagctactggggaggctgaggcaggagaatggcgtgaaccctggaggtggagcttgcagtgagccgagatcgtgccactgcactctagcctgggccacagagcgagactccgtctcaaaacaaaacaaaacaaaaaactatctaattgtgagacttttctgcaattctgacaatggggatagcagaggagcatatttgccccatcttatcattaagttgtcaaaatctacccaggatgagaaatagaaaatagaggcctcattcattccttccagctgctgtggagtatcccagcaggtaacgactctacagtatttctctttcccctgtggataaatactcaagttgttcctaggcgttcactacaacgaacaatattgacaggagcatcctggatgtgtagctttcggcccatgtacaggtggttcttgaggaaaacaccaaaaggctggatggctccccagagagggcacctgtcacactcccctttgtgtgagaggagtactgtagcccagaagggtcaccagggactctggggcagagaagagagaagaatgttgctctgctgatctcccagccgtctctggatcaatggcctttctttcaggcctcatgttctctgctgtaaggcacttcacttgccttactcactatgcctggcacttaataagtgttcaagaaaatggaagcatgaaccttttgagggaacaataaccaatattttcatgtatctttatgtagtcttttctatgcacttttaaattaacataattagtataatgctacacatagattatttttatcctatttatttgcttagtattacattgtagcattttccaggtcattaaaatgttcttaaatttttagtggctgcataatattccactgtttgcctgtattataatttgcttaacctttctagcagagcaatcttttatatagttcaaaatttttagaaatattttaatcgaggtgaaattcacataactttataaaattaactatatgatttttaaagcgaacaattcagtggtatttggtatattcacaatgttgtacaaacactacctgtcagtagctcctaaacatttccatcacccctgaaaaaggaaactttgtacccattaagcaattaccccccattcccccggcccctggcaaccaccaatctgctttttgcctctacggactaatttattcaggatatttaacataaatagaagcatactatgtgactttctgtgtctagcttcttccacttaacataatgttttccaaggttcatccacatggtggcaactattagtactttattccctttgtggccaaataatattccattgtatggatattccacagtttatttacccatttatccacagatggaaattcaggttgtttccacattttgaccattgaaaataatactgctatgagcatgcatgtgcatacatgtatttgtttgagcacctgttttcaattcctttgggtatatacctgaagtagagttactgggtcatataaaagttctatctctgtggccgggtgcggtggctcacgcctgtaatcccagcactctgggaggctgaggcgggcggatcacgaggtcaggagatggagatcatcccggttaacacggtgaaacctcgtctctactaaaaaaatacaaaaaaattagccgggcattgtggtgggcgcctgtagtcccagctactcgggaggctgaggcaggagaatggcatgaacccgggaggcggagcttgcagtgagccgagatcgagccactgcactctagcctgggcgacagagcgagactccttctcagaaaaaaaaaaaacagtagttctatctttaactttttgaggaactgctatgctgttttccaccattttacattcccaccgtaatatacaagggtttcaattggcttcacatccttgccaatgcctactatgtttatattttattagtattattattaccattctaatgggtacagaaagcacgaatcttaatctcattcaaaccaggctgccctctgagggctcttacctcagaaagtaaggagaaagttgtctacattctaaggactagccagggcttggactttaaactcttctagaaagtaaattctacaagagcacaaacatgtttgtcctataaaccactgtatcttctaacacctggcacctggcacatagtagggcctcaaaaaaacactgatgggacaaacgcaatgaatgttggacaacctcctccctcccttgcctgagatatttcagctgccctccccgaacacccctccacccgcagcgattatttttaattagttgctaacatttaaactcaggagagctcacataatctggatttctgtctcctaaaacattagaagagttagcagccctgagactagaacccacgactccagtgctcttcagacaacctcagtggagctgggggctgccctgggggctacacctgggctgtccagcttgcacagcccttgccaggcccactttcctcatccgcagaaccctccacatccctatagtcatttgagttttcaaaccccacccttcgggtcatgacaaggcttccttttttatagaaaaggaacatgaagggctgggtgcggtggctcaccctgtaatcccagcactttgggaggccgagacaggcagatcatctgagctcaggagttcgagaccagcctgggtaacatggcaaaaccctgtctctacaaaaagtacaaaaattagctgggtgtggtggcacatggctgtagtaccagctactcaggaggctgaggtgggaggatcgtctgagcacagaaggtgaaggttgcagtgatctgagactgcaccactgtactccagcctgggtgacagagcaagaccctgtctcataaaaagaaaagaaaaggaatgtgaagcctagagagggtaattgactttcccaaagtcacacagcaagttagtagcacaatctctctcagcctctttctttcttacatctttttgttgttgtttatttttctttttttataccacaagtcatcaagcaatcacttctgcctttctaaacaaaccccaccacatgcaccaaccacatgttggtccccaccccatttctccagtttcctcccccacaggactgggagtttgaaggtactttcagaggcgtgggtaatgatgcagaagcagcctgtgcttaagtgtaaatgtgccctggtcttggccccggctgtggtcccacatgctgcatcctctggatggcactgcgctaggacgtgcgctcctgactctcccttcgagtcacctccctgagttccaggcatcaccctgaaatcctttggcccaggagatgtaagtgcagccaagagaacaggaatcccagcctcatctctaccatagaaatgaagaacagtgggtacagtacagtagacgaccccgagtctgagtgccagctctgccaaagacaggttgtgatgcactaggcaaatctcttccctttctgagcctcagttcccaaatccaaaaaaaaatggaactgaggctgggcacggtggctcacacctgtaatcccagcactttgggaggacaaagcaggtggatcacctgaggtcaggagttcaagaccagcctggccaacatggtgaaaccccgtctctactaaaaatgcaaaaattagccgggcgtggtggcgggcgcctgtaatttcagctacttgggaagccgaggcaggagaattgctggaacccgggaggcacggttgcagtgagccaaggtcttgccactgcactccagcctgggctgacaacagcaagactctgtcaaaaaaaaaaaaaaaagggggagaactgaggaggatactactcatgattcctgcagcacaattccttttatgtcaaaacacacacacacacacacacacacacacacacacacacacatacacacactagtccatcatggcgtatatgtcttagtttgagtttctccagaagcagaccctaggcaaggtttcaaatgcaaatagtttgagagctgattccagagaccctcctaggggagtaaggaagtgaggcagggaacaggaggtagtcattaaaggtgtcttctaagcccagttaccactgcgggcacctggagctcaatcccactgaggagctctgggagccagggtagaacaggcttgagaggtgagggaaccggggtatttgtccaccctgttctcgctcctgtcttttgttgaaaactactcctggggatgtgataattctctagcactttcggcttgccaagcccatgggcagagcaggcaccaatagccacagagaaatctctcagacaaagagatgaaggtgccggcagctggaagtccagccagaatgtgcagaaatggtaaagggcagagtgatagaggcagggcactgacagcctctgcttcaacatacatgtgtgtaaatgcagaggcagaggctgaggccaaatgctggcagaggatatctgggtggggaaagaggtggccatggagggcttatagaatgagtaatccaagagtgtcttaaatgtatctgtaatgttttaatcttccttccttccttccttccttccttccttccctccctccctcctttcttttcttttctttcttctttcccttctttccttccccccttctcctcctcctcttcctcctcctccactttcttcttctcttccttcctttcttctttctctctctctctttctttctttcttttttctttctttctttctttcttctttcccttcctcctcctcctccttcttcttctttcttgcttctctctctctctctctttctttctttttctttttgagacagggtctcgctctgtctcccaggctggagtgcagtgatgctatcatggctcatgcagccccaacctcctgcgctcaagcgatcctcccacctcagcctcctgagtagctgggatcacaggcacatgccaccacacccagctaataaaaaaaaattctggtagaaatggggtcttgccatgttgcccaggctggtcttaaattcctcggctcaaacgatcctcctgtcttgacctctcaaagtgctggtattacagatgtgagccaccatacctggcctctaatggtttaatttttaacaagaaggatgcactaatgttttactaggtggtaaaaggtcattttaaaaataaaatacatacccttcaaaaaataaaagaaactgagacctggagctttgtcaattataaaaaaaatgtaaaaggatcagcgcctgtgttactgaggctttgaggattccatttgtggaggacaggtttgggggcagctgatctctcagtaccacggcaggttaaagtgaaaagtggccctggtggtgaactggccaccatgtcctgtctggagggggaaacttccactcagcggcagccaaggaaagactgctcctctcccagcagaagcgagcaaatgtgcatcacccttctcagtttaaacatatatttatagctattggttttctttttgtttgtttgtttttgttttgagacaggatctcactctgttgcccaggctggagtgcagtggggcaatcttggctcactgcaacctctgcctcttgagttcaagcaattctcctgccttagcctcccaagtagctgggattacaggcacccactaccacgcccagctaatttttgtatttttggttgagacagggtttcaccatgttggccaggcttgtctcaaactcctgacatcaggtgatccgcctgctgacctcaggtgatccgcctgcctcagcttcccaaagtgctgggattgcaggcatgagccattgcacctggcctatttatagctattgtttagacgggaaatctgggggcatccagcagactaaatggggaccttactgtcatatctcatatcctattggtcagatggataataaacaaatcaacaggtaatacattaggtgcattagtccaggtccttttttattttttcttttctttttcatacttaacttcagcataccctgagatagttcaagtcctttgagaagcagactcccatagcatcaaatgtgcaagaaatttattggaggaaatggctatgagagaaaatgggaagaaaccaggagaggacaggagagccatcagatagtggggtacctctgtccactaatgaaaaagaaaaggaaggaagaaaggaataaaaggaggacgtgtcttggactgccatgccgtattttttttttgtagttgttgttctgttttattttgttttttttgagacagagtcttgctctgtcgcccaggctggagtgcagtggcgcagtcttggctcactgcaacctccgcctcccgggttcaagcaattctccttcctcagcctcctgagtagctaggattacaagcatgcgccaccacgcccagctaatttttgtatttttagtagagacggggtttcaccatgttggccaggctggtcttgaactcctgaccttgtgattcgcccgccttggcctcccaaagtgctgggattacaggcgtgagccactgcgcccagctgccgtgccattctaaggaaagtttgtcaaggctgttaaggagcccttggccaaagtctcttgacagaggtcccccagacatgggtgggcttcggtctccctgccacactcagtcattggctgggagcagcccatgagagcagtgatggacttcagagcacagcagctgagccgctgatcaatttctccagtcgtactcctgcagttggagatctgagaggtgcatcctcatggccaccacgtttaagaggtggttaggggcatgaagactagctgggaacaggctagacagtgatgggagttggggggcagaggatcctgtctttgccagggtgatgagggaaggttgctctgagaaggtacaatcattagagagactgaaggaagtgatggagcctttctgggtgaagaatattccagaaacagaacatgcaatgccccagaggtataagcacagttggtgagttgaagaagagcaaggagggctccagtggaatgatcaagggagagttagaaggagacagatctgagaggctgaggaggggatcagattgtggaggtcttacccaccttggagaggacttgggcttttactccaagtgagacggaaaccctgggtgggggttgagcagagaaggaatgcgatctgacttacctttttttttttttttttttttgagacggactctcactctgttgcccaggctggactgcagtggtgcgacctcggctccctgcaacctctgactccggggttcaagcgattctcctgcctcagcctcctaagtagctgggattacaggcatgcgccaccatgcccgcctaatttttgtatttttagtagagatggggtttcaccatgttggtcaggctggtctccaactcctgacctcaggtgatctgcccgcttcagcctcccaaagtgctgggattacaggtgtgagccaccatgcccaggatgacttacatttttaaaggctcacttatttgtaagaggcagaatgcagattcaaacccagctctatctgacttcaaatctcatgctctattttcaaactgccctgcctcctgcctgccttagagataaaatcattccaagaaggttcacagttgctctggaattctgaaattgaccaagtgtcccaagagtaacattgaacatgctatgagttttatatgtggttgaataagtgtttggaacacaggcatctcagagccaaccctatggctcagccaggcaaatgatcaaagccctgagttctcctttagtgtgttgctctgtcgctcgccatcgtgtgagccagggcccacgcagcctcttggggttgttactccacctgtccaatgaagattttgatctcccaagtttcctcctgtttgcaaaatcaaagttttgagctctatgagaaagaagctgaggctcagtaaagggaagacgtgagaagtcaggagtgacccctaactgtctattagggacagtagtcactcggggataaagacagttcattcagaagacagtcagggaacccgaggagagggagctgctgggctctgcacccccaaggcactgctcagggaattggctcctgttgaggaaatactttttccccacccccattgctgagctgttctgagaagggaaagttcctgtaactgaacagccttaagccctgggcccccagcggtctgccttcttgagagttctgtttgggttcctcattctccccttccccttcatcgcccacagcctctggggctgacctcagtggatgatgacaggcaggagagctgagtgccagtttgacctaccactgactagccgggggacccactctcccatgggcttccatttccctatctgaaaaataacttcataattctggtctgttgacttcagccaagtatgatgaggtccatagagagtagaacataatatatccattacacgaatgtgtatggggggcctattagataccaggtgcttctttttttgaaacattcttgctctgtaacccaggctggagtgcagtggcatgactacaactcattgtagcctcaacctcccaggctcaagtgatcctcccacctcagcctcccaagtagctgggaatacaggcacatgccgccatgcctggctaatttttttgggtagagacagggtctcgatatgttgtcaggaccagccttgtactcctgggctcaaagcaatcctcccacctcagcctccaaaagtgctgggattacaggcatgagcccctgcacccagtctctataaccaggtccttttaaggcatggcttcagtgccatcagcttaatgaggtccatattcctcccatcctcacctactctaataggtctagtaccatcttaccttctcttctaccaaaacctggtatcagggaggtctttgccatcagccatttgcacttgagtgcaaatcacaatcccttataagaattccctctgcactgggcaagactctttgatgtttaaagggaaataaatccaactcaaaactggctcaagcagaagaaggaggttactggaaaatccctgagatatcagcttcaggcgaggcttaatccaaggctgagagtctgcatttctctatttcttgggtttgccttgctgctgcaggcctttttttccagctagaaaccaagggctggctctcgttggccagaattgaatcacatgcccatctctacttcttttttttttttttttttttttttttgagatagagtctctctctgtcacccaggctggagtgcaatggcgcaatctcggctcactgcaacctccacctcccaggttcaagcaattctccagcctcagcctcccaagtagctgggattacagatgcctgccaccaagcccggctaattttttgtatttttaatagagatggggtttcaccatgttggacaaactcctgacctctggtgatccacctgcctctgcctcccaaagtgctgggattacaggcatgagccaccgcgcccatccacccatctctgcttctattactgcaactctcattggcttgatttggtcacagatccacctctacagccaggggttggagtcaactctatcccaatccataaactgagactaggggcggagtaattcccaaaggaaaattggagaactgttgttagaagaaggggggaatggattctatgcaggaaagagctgcagcttcttctttcagagaacttctaatccaacatctcatttcacatttggagaaactgaggctcagagacaagttgagacttgcctaacatcacacaatgagcttatagcagagatgggaccacaatccagggcttcacaccctcagcccttgcaggtttctgcttaagcatagaagctcccagaaaaccatctccagcccactggatggatgctcaggcaggccccggcctctcccccttgagcttgactctgagagcacaggccgagtctctgagttttccacagccagcatggtaaccctgggaagcagccaggcacaagcaagctgacctctctcatttcactcagcagaggctgaggcggtgaggagcaggtttcaggttcccagggacggcagtggcccgaggaagtatctttaccagggatcagcagttttgagtgggtgtgcaaccaggcagactgcttctgctctcagagcgtgcttttgaagcacattagatgagaaatgcgtatgcagaagttttatacagtccttcacatccctagtcacataggacctcaggccaagcctgagaagcaaggcctcctatttagcaggaaagaaaaataaggctcagagagggcaaatgacttgctcaaggtcacatacccagtcagtggcagaactgctatccaaactcaagtattctgactcccaagttcagccttcattctgctacattggtggatctcaaattttagtgtatatactaatttcctgtagaattgttagaactacagattccaggacctcactcccagatactggttcattcaatccagagtgtgacccaagaatatgcaagaatcagtggagactttttgagttcaaatggcagaaacccaactcaaattggcttaagcaaaattgataatttatttgctcgtggactggaaaaatcctgaggtgtataggcctcaggcatagctggatccaggtgctcaatttatcttcaggaattactttatctccatacctcagctctgttgtcctctctggtggcttcactctaaagcagcttttaccttgatgatgttgaggtggcctccaagaactccaggttcctacatctcaacaatccttatagaaagagggtgctttttccctaatttttgcagcaaaatcccagggcagactgcctcagtgaggaggacgtatatgcctacaactgaaccaatctctgtagccagggggccagaggatatgggattctctgattggccaggcctgtgtcaagttgccaattcctgaaggcaagggtgggatcggccccaccaaacttcatgcactaagtgggagaaagctggttctccaaaggaaaatccaggtactgttatctgaagagggacagatgctgaggaggcaggagcaaaagaggttctctagccttcttggctagaatgttcacatgaatcgcctgggaaccttgttaaaatgcacattctgatttgggaagtggggactgagattctgcatttcttacagctcccctgtgaggttgaggctgctggttctcacgctagccacactctgagcaccatattgcatttctaaactcactcaaaccactttgtcacaaggcactctgcagagaggccctgggctacataaacctctttcttccaccattctctccccaccttcaccccatcccctgttcccaaactcacccgaataatatcagcaccatctgtttgggaaccactcaccaacatactatagattctgctgacaaatcacagttgaagaaattgtccattgtgccctccagtgacttttttttttttttttttttttttttttttttgagacagagtcttgctctgtttcccaggctggagtgcagtggcacgatcttggctcactgcaacctctgcttcccgggttcaagcgattctcctacctcagcctcccaagtagctgggattacaggtgtgcgccgccacacctggctaattttttctgttttcggtagagtcagggtttcatcatattggccaggcttgtctcgaactcctgacctcaagtgatccacccacatcagcctcctaaagtgctaggattacaggcatgagccactgcacccagccccagtgacctttttatgaggagccacagaacaaattctcttttgaatttatactcaaaaaatatttgtttctgtcaacagacaatttgttgtgcttcctgggatcttatggtgatgttgtacaagtttccatttttatcttggctactaggaagctcagagataaatctagtactcaatggtagtagcagtcccaccctgggcttctggttcaataatctttcccttctatatggtgtagagtaaccctttttgagtcttgcagtgctctgtgtatggtttaatattataagctccttcaaatcctttttggaagtcggttcttctttggagtattcttgactttcccccaatctttatctattcagatcctccctgttcttcaaaacccaactcattatcttgctgctcaattattattgtaaacaggttgctttttatacgaacttactaacatacacgtaggcacataaattcattttagaagagtggtttgatgtacatgtttgcagtttgcatttttcacccaataagtattttagcaatctttgcatggcccctcctatgtttaccactccctagtagcttatttttctttcattcttaaaactgtggtaaaatatgcataacaaattttccatcctaatcatttgcaagtgtacacttcagtggtattcaatccattcagcatgttgtgcaaccctcaccaccatccatctccataactcatttcatctgaaactctacacccattgaacaccactaactcctcacttccccttcccccagcccctggcaaccaccattctactttttgtatctcctaatagcttcttagtatgtggcttcggaatgtaattgtgtgtccagtctccccttctcaactcggtcatagagcaggaatgtcctgatgcttttacttttttttttttttttttttttgccccgtcttatggtgctcagacacttttacttcctactacataaagtatggcacgccaggcatgcagccattcactcactgtgcatgacactcctactgtgtgccaggagacactgggctaagcactgaggaacgcaggtgtgagcaccagcctttcctgtgctgcagtgatgggagcattctgtctctgcatgtttgcatatggtggctctgagccacagacggctgttgagcacagatggagtcatagctgagatgtgctctaacagtaaaatccacactgagatgtgaaggcttagtacaaaaaaaaatgtaaagtatctcattcataatttttatatttattatatgttaataattttgatatattgggtaaaataaatacatcttaaaattaattcacttgtttctttttactttaagaaacctggatgtaaaaatttttttaaaaatgaaaaataggccaggcgcagtggctcacacctgaaatcccagtactttgggaggccaaggaggacggatcacctgaggttgggagttcaagaccagcctgaccaacgtggtgaaaccctgtctctactaaaaaatacaaaaattagccaggcgtagtggcacatgcctgtaatcccagctactcaggaggctgagacaggagaatcacttgaaccctggaggcagaggttgcggtgagtggagatggcaccaccgtactccagcctgggcaacaagagcaaaactccatctcaaaaaaataaataagtaaatgaaaattaaaaaaaaataaaaactaaaaataaatttaaaaggaaaataaaaataaagtaaaatgaaaataatttttttttaaaaaaggaaaaaataaaataaaataaaatttcaattttaatttttaaaaacctggctgtagaaaactttaacttatatttgtggctcacatgacatttctgggcctagtgaccatgaacatggacatttctgatgcccagtccacaccaggcagcagacatggttctctcatttagggagacaatcacattttacacaaatttgactcctgccagtgtatcactttcagaaaaatcacactttcagctgggcatggtggctcatatcccagcactttgggaggccaaggtagcaggatcacttgaggtcaggagttcaagaccagcctgagcaacattgtgagacctgccccccctctctgccccctgtctctacagaatataaattttaaaagattagccaggcatggtagtttgtaactgtagtcccagctactaaggaggctgaggtgggaggatcacttgatcctgggaggtcgaggttgcagtaagctatgattacaccactgcactccagcctgggtgacagagcgagactgtctctgagaaaacaaatcacactttattgtgcaaaaatggaactcatgggaattccctattttaaaaaaagcgaacttctccagtgttgcagtatctctaggcttgtgggccagaggaattgcaaactgtgcttgcttcatgatccggggcagtgtcacgtctgccagtaaacagaaatagttgtggttaatgtttctgcagcgcttactgcatgctgggcacttttacactcatcaacttgctcagtgctcaccaccaccctatgaggtagaacccttgccaccctttctcagagatggccttggattgtgaatgaacacaggtcttctgagacccctccctcgggaccctgtggccatcttgaatatgtacattgatcacgtaagtgaagcatacaaggtgctcaacgcgcatggattggaaatcacaagactcacagctgcagatcagtgggtgcccagagaggtagagtgagctgccctacctcacacagtgctgctcttcccagaacatctttatgctgaccaaaacacacgaaatgtgatataattttatgtcatatatgtcacacaagatgcccgtttaatttcccagaactgtaatacacatttatctcaaagagagatgctggtttcagttttaaatgcatgcaagtacattataaatctgtgcttaattatgataatttttcaaattaatgatccagcactccaagagtctgaatgtgttccttattttatttccaaaagacaaacaaagcaaaaccgctcaagtcttgaggtggcaaatctttcccagttcccaccagaagaggtaaatccttgtaaataaaaggaatcttttttcatttttaaaagtaactcatctaagcctaggagtttggggtttttttccttaaaccacaaatacatgtttattttaacaagataagtataactgagttctaactgctttagaagaaaatggcaattgtgcagagatgagaaaagcaagcacttccttatgtggttgtcacagcctgccttctcagcaaatgtgtgtgcacattttgagaaaagaaatgaaacatttcttccacttttacaattatgttttgactctacttggagtaaatgtgttttgtttaagcatccttaaattaattcaatacagcagcaaagtctgcaagctctacctccaaaatgtcccccaaacctgtccaatgcttacctcctctctgcccccacactaccctgggccaccatcatctcatacctgaacaattttggcagatttctcacagggttccctcccctgctccccactgtccacgcctcactcagccaccggtgggattatttaaagtgcaaattgaatcccatcattctcctgccagaaactttccatcatccttagaataaaatccaaagtccttactggccctacaggatatggtggccttgtcacaaccaccctcttccctgcccatgagcttcagctacactctcctgctttcagtgcctccaacttctctctaagcacatgccagcctcagggcctttgcatttgctgttccctctgcctggaacactcttccctcagagtgtcccctcactggctcctttgtgtcatttagaccgcaggttctgtatccctttctctgacaggccttccccaaatgccctgcctaaaagagccagacctgttgttccccacagcatcctctcttattgtcctcacacttttcattaactcaatttgccctgttatttatttgttggcctgtttattgtctctgtctcccattcggctgcagttgaggtcctgagggcgtgaacttgcttctcttcttcacagtttagaaaagtgcccagtaaatcttggctgtgtaaatggatgaatgaattaccaaacaactcagagagagacagagagaaagagaggaggaagaggaagaggaagaagacgaagaaagaggaggaggagggaggacagaggagggggaaggaggaggaggggaaggaggaggagggggaaggaagaggagggggagcaggaaggaagggagggagggagggagggaaggagttataagcaatttataaattgataccagtaatacggtgccttgacaaactagattgtttgagccatgttatgtgacctcatcttgttatttaatataaaaatggcaatttatcatctgataatactgcagtttttctgtagtgtttgctctgagcctgacactgcactgagtatttccccactgtaggtcatattattgtccccattttgccgatgaagacctgagaggtgggtaggggcaggaaagtggtcagtgaggtgctggtggggtggaggggccaaggatcagctgaggctttctgacctgagagctggcagtgcccacccaacagctctacctgttacatttctgttatcctcatgccatcctctgaataaacatccatcacgctggtccttggtacccacgacaatgacagcttgtcagccctgggccagtgctgtggcacgtggacatggggaagcccagaggtggcaaggatggagtgggttccatgtggggaggataagggtgcatggagctggcaggggagttaagaccgggaaggccagtgggagccagcccgggggcaggggacctggaatgccagcatcagaagacttccccgcatgaggctcttggtaactggggctcacctcccttctgtctgctgcaggatggggtgcatgaagtccaagttcctccaggtcggaggcaatacattctcaaaaactgaaaccagcgccagcccacactgtcctgtgtacgtgccggatcccacatccaccatcaagccggtgagtaggggaggtcccagtttccctgggggctgacggatgctgccccaacattgccctaacagcctcctgtcttcccaaggttgggcagggtgagcttggggtgaaagggagctgactggccaccaacagtgtcctgactcgactctccgggacgcagcgccagccagcatgcataggggcaaagaagtcatctctctttcctgcagcccaggcttggcccctcagcctgagctccaccaaacaggtgtgagtgagcatctcaggcctccggcctgggcagaagcaaaagcagtgctgagaaacgagtgaacagtaatgatagcagctgaagtgacaatgtaatggtagtatcagcagcattgcaaaaatacagtaacaattgtcatactaatagtaccaaccataattgcgtgagtataagaccaagagtagcagcaggaacaacagcaagagttgtaaaaagagaagcagtcatgctaggagaggtatttaccaacttcttttatgtttatacaaagctgactatgaacccagcactgttgtaagcctttacggttattaacaccctaatcctcacaataatcctattgtgtgacacacaaatacattcttcttgaaaataaaaacacaggccaggtgcagtggctcacacttgtactcccagcattttgggaggctgaggcaggaggattacttgagcccaggagttcgaactgcatgagctatgatcacgccactgcactccagcctgggcaatacagggagaccctgtctctttaaaaaaaaaaaaaaaaaaaaaaaaaaagagctgcttagaatgccatagtttaggtgtcacttcccccttgcatggacacttagattgtttcacatacataacagagcctttatttatggaatataaatcactggtgggcctgtgatttctccaaacttagtcggaaaacactgatctggaccgaccccttcactgtgtgttgaggggaggggtcaagcagcatcccccggtacatccaagaccgaaggccgaggccacagctcaagaaacctggatcctggctgggcacagtggctcactcctgtaatcccagcactttgggaggtcaggagttctagaccagccgggccaacatggtgaaaccccatctctactaaaaatacaaaattagccaggcatggtggcatgcgcctgtaatcccagctacttgggaggctgaggcaggagaatcacttgaacccgagaggtggaggtttcggtgagctgagatcacgccactgcactccagcctgggtgacagagtgagattccatctcaaacaacagcaacaacaaaaaatctggaccattttgtttgctggctctgcccctaatgtgccgtgtggtgccaggcatgtcccctgccgtatgtgggcctcctcccacgacatgcagggctagggtaagatgctcttgggtgtccttctcaacacagaccttccacgggtccccacacattggtcagattcattctcttctctcatttcttccccacaggggcctaatagccacaacagcaacacaccaggaatcagggagggtaagtatctacgagcagatgcagtggagtcatgtgtcctgcagaggactccgctaggttctcccttagcttgaggcataaatcccaaacagtcaaacccctgtcgagaatccccaaaatttcctctgaagtactttgcgcaggctattgtgtttctagaacgctgtttagtaacatgaacaaaacatatttagctttaaacttgagaatcacacccagcatggtgagacgcctacttatacttggaaccacatatcgatgggtgcggagctgttccaggtgccgggtgagggtcaccaagggctgtggatgcacttagacgaaacctcaccctctgtgtgtctcccttcccagcaggctctgaggacatcatcgtggttgccctgtatgattacgaggccattcaccacgaagacctcagcttccagaagggggaccagatggtggtcctagaggagtgagtccccatcccactccccctaagacagacctgcctcctctactcaactatgtgctcttttgtgcttccataaagaacctgatagatgggctatcttatcctgggtataaatgtctaatgagaagctaatcacaatagtggaggaagggtttgctgtcaacctggatgaaggggattgtgcacttactgagagtgcacgtccagcctgagatgaacaggtgacgctttctcagggaagcctttctagggctcctgcgattaagccaccggctttacctgtggaccaggccccatcgagtcgaccttgcatttggaaatccttggatctctgagtttgccacctcggatctcctacagccttcaccatcatgggtatagtgtccaggatgtgctgaagcccgagaacgggagtggtcatgcctggtcggactcccaagcccactctcccctattctcagccccagctgaaccattctgagtctctataggcacaggaccctgccatgggtatagctaataagaccaaagctgcaagtccagggaaaaggagtggagccagagacccagggctctgggctgtggacagggagattccagaccctcagatgcacagcaggaactggtgtaaggatccctaccctaatcatgggcacatgctggggctgacatagtcacagccctgtccttcaccctactggctttctggaggcagggagttttctaggtcaaggctggggagcttgaggagactggagaatgatccttctgtccctaacacctttactccctcatgtccctcagatccggggagtggtggaaggctcgatccctggccacccggaaggagggctacatcccaagcaactatgtcgcccgcgttgactctctggagacagaggagtaagtatcctatttcctaccttccagaaagaggcatgagcaaagccagccttgtttgcaactcaggacgtctgcacacactgtaccactgcctggcacatactcttcccagggctctgggcttggctggctccttctcttccttcaggtttcatccttccagtcagggaagagaggctaaagtgggtcccagctgtgactctgtcttgtggaaacctgttttaatcccttctgaacatgttttactagcaaaacgacctggtttctttggttggttacaagtgcattctctgcctgccctgcaaggaagagggctggtgagagcggggactttgtctgcttctgcatcctcggcacaggctggcatgcagtcagtgctcaataaatattgttgaatgaagcacacggtcttgccaaggagggtttctggagaggtgagacagctcacacctggccagtcgtccctcatttgttgttttgttttgttttgagacagggtctcactctgttgcccaggctggaatgcagtagcaccatcacagctcacttcagcctcagcctccctgggctcagttgatcctcccacctcagcctcccaagtagctgggactacaagtgcgcatcaccatgcccagctaatttttttcttttttgtatttttggtagagagggggtctctctgtgttgcccaggctggtctcaaactcctgggctcaagtgatcttctcgcctcagcctcccaaaatgctgggattataggcctgaaccactgcacctggcccatccctcatttgattcattcgacaagcacatgctcatgactcttcaagccctgtgccagcctaaggggctgtggaaacaaataagatatatccctaccctcaaggagctctccataacccatcgttcttggctgtgggttcttcttgtgtctagcttgactctaaaaatatacttcagtcatccatccatccatccatccattcatccatccatccatccatccatccatccatccatcatccaacagatacctgttgattccctattccagggttagaagatgacttagatggggctccctgctggagatgttctctgtatggtggatgaggttgatgagtaaaaagatgactacattgtggggtggcaatacatcccattaaaaaccagccaatcaaaagttgacaaatgacagtccccattgttttgtctcttctgcctcctctttctagctagatggtattatgggtttgggatgcttgcctgttaaaaatgaaaacgcttaggcttttcccattataaagccacctccttctggctgggcatggtggctcacacctgtaatcccagcacttcgggaggccaaggcacgcagatcacctgaggtcaggagttcgagaccagcctgaccaacaaggtgtaaccccatctctactaaaaatacaaaaaaaattagctgggtgtggtggtgcgtgcctgtagtcccagctactcgggaggctgaggcaggagaatcacttgactccagggggcagaggttgcagtgagctgaaatatcatgccactgcactccagcctgggggacaagagcgatactctgtcaaaaaaaaacaattatgtcaccccttcttagtgatcatggaactgggggctcttagctgtttctctctccttcttccaggctttgccctgggtcatcccatgctctgtttctccactccagggtctgaacacttacagaatccctgggtcacctcatgtagtccttgcagcaaccatggaggaggcgtggctggcattatttctcaaaggcaacataattgctaagtggaaaacgcagggtgtagacaacatgaatggggggttatcatttgcagacaaaggcaaaataacctagatggggggttctcagacatgagcagcaacagcatcacctggattgccggctaacaagtgctttctgggctccactgtcagattccgaatgtgcatttctaacaggttcttgggtgaggcagctgctgctgctgctgctccagggacccagcttgggaaccactgatctaaatacgcatatctggccaggtgtggtggctcacacctgtaatcccagcactttgggaagccgagggaggtggaacacttgaggtcaggagttcaagaccagcctggcctacatggtgataccctgcctctactaaaaatacaaaaattagccaggtgtgatggcgggctcctgtaatcccagctactcagaggctgaggcacgagatttgcttgatctgggaggcagaggttgcagtgagccgagatcacgccactgcactccagcctggacaacagagcgagactctatctcaaaaaataataataaaaataacaaatgaatacacatatgtgtcctttcagggcactcaggggtccttgtgtctgaatcaagaaactgctaacagaggttgcctctggggagcacaactgggaccttgggaatcagggcgggatggaatcttggtttctctcattctcccttgaaataggcaatactttcaaatgtttcaaaatgcaaatgtggggaagcatgcagaagagtgaaaagtcttcttcccaccctgtccccaaccagccacttcccctccccagaagcaaccagtttctcgtgagtcctcccagatgcttcctccttatataagaaaagacatctcttcccgcttatctcacacaagtggtagataccacacacactgttccatgcctctcgttcagaccttccatgcagcaccttgttcctgttttgttttgttttgttttgttttgttttttaggtggagtttctctcttgttgcccaggctggagtgcaatggtgtgatctcggctcactgcaacctccgcctcccgggttcaagcgattctcctgcctcagcctcccaagtagctgggattacaggcatgcgccaccatacctagctaattttgtatttttaatagagacagggtttctccatgttggtcaggctggtctcgaactcctgaactcgtgatcctcctgccttggcctcccaaagtgctgggattacaggcgtgagccactgctcccggacacctccttcctttttataccacagggcgtctgtcctgtagatgtcctaccgtccatttaacctctgccctatacagtggtcacttaagttgtttccagtcatgtactgaagcgaatctcctggtgtatatgtcatttctcccttgtgcaaggtctatgggataacttcctaggaccagaattgtcagggagacagttggttttttttgtttgtttgtttgtttgtttttgagacagagtctcgctctgttgcccaggctggagtgcagtggcgtgatctcggctcactgcaagctccacctcccaggttcacaccattctcctgcctcagcctcccgagtagctgggactacaggctcctgccaccatgctcggctaatttttttttttttttttgtatttttagtcgagacggggtttcaccatgttagccaggatggtctcgaactcctgacctcgtgatccacccgcctcggcctcccaaagtgctgggattacaggtgtgagccaccgcgcccagccgggggagacagttcttagtcttacatagttgaatattttaccatggcacaagtcactttacaacatgaaagcaaagaaggtagatgagcaacatagcatggtgattcagagcttgggttctggagttagactgcctagcttcaaatcctgcctctacaacttcccagctgtgtgactctaggcaagtcacttgccctctctgttcctcaatttcatcatccataaaatggggccaggagcagtggctcatacctgtaatcccatcactttgggaggccaaggtggatggatcacctgagttcaggagttcgagaccagcctggccaacatggtaaaaccccgtctctactaaaaatacaaaaattagctaggtgtagtggtgggtgcctgtaatcccagctgcttgggaggctgaggcaaaataattgcttgaacccgagaagcagaggtttcagtgagcccagatcacaccactgcactccagcctgggtgacagagcaagactcagtctcaaaaaaaaaaaaaaaaaaaaaaagggggggaatgataaaggtgacaactccatagagctgttgggtggatagcaagatagatgttaacttcctccccagttgataacagaggaaccaaaggcccaaagaggaaggcaacttgctcaaagtcacactgcaggtttgtggcagagccaaggcaggctgaggtcaggtctggggcttttttccaactgctcctcaccccagtgaaggtgggaatggattccactgctgctgcttgaacttttccacccaaatatctcaatattcaggaagaatgaagaaaatgtcccaggatataatcctaagtataaaattctttccaatctcacattgtagcttagaagttcaggccaactttatattcaactccatatatgcggaggaggattggttgtaaagctaacaaaactcaggcccttcacaggcttccaaggtcccaagaaggatcttccccgtggtcttgtatgcttgtgaaacctgcaaaagtaagactttgaccacagctggttaagactgctgtctgtttccactctgtcttcctgtccatctccctgtccctcacagcgagcagcactgaaatgacctatcagctttttgcacttgttaatgctgtattatttttcttaaaggaagttcccccactccaaattgcataggcttcagtctcagcaaacaggattcacttcgggtaaaatgtctattttgatatcaaaagaatggctcctttaccttctctcccccaaaaaatctttgagtaaaactgatgctgcaggaagccagaccctctgtatcctgacattcccctgggacctgcatggccacaggcatcctgtgtaggccggacaggactgcatgaccccaggttcacatttgtcccctcccttttccatcaggtggtttttcaagggcatcagccggaaggacgcagagcgccaactgctggctcccggcaacatgctgggctccttcatgatccgggatagcgagaccactaaaggtgacaccagccctccccaccttgtcctccctgccgaggtgccccagctggggctggccaccaccctttccttggaaaatgccctgggaaaggctgaaaaacccaaccaggtgctgtggctgccaggtttctcctgctcttggccacctgagctggggagggttgaggctctgtgcctggctctgcccttcttatccaccatagctgccagcttaggtcagtggaactagtgccaggtggcttaggccctgaaaacaaagaaacatccagctgaagcttgatcttcactgacttgttttttcatttgttttggttcttgttttgttttgttctgttttttgagatggagtctcactctgtcgccaggctggagtgcagtggtgcgatctcggctcactgcaacctccacctcccaggtttgagcgattctcctgcctcagccttccaagtagctgggattacaagtgctcgccaccatgcccagctaatttttgtatttttagtagagacagggtttcaccatgttggccagtatggtctcgatctcctgaccttgcgatccacccctcttgccctcccaaagtgctgagattacaggcgtgagccactgcgcctggcctgttttgttttgtttgagacagggtctcactctgttgcccaggctggtatgcagtggcacaatctcagctcactgcaacttctgcctcctgggctcaaatgattctcccatctcagtctcccgagtagctgggactacaggtacgtgccaccatgctgactaatcttttctttctgtttttctttctttctttttagtagagatggggttttgccatgttgcctaggctggcctcgaacttctggactcaagcaatctgcctacctcagccttccaaagtgtcaggactacaaagtgtcaggattgtttttgttttggtttttttaaatacccgtaacagaccaagtaggggaggccaacacaggaggatcacttaagcccaaaagttcgagaccagcctgggcaacatagtgagaccccatctgtatgaaaaattttaaaaattagccaagcatggtggtgcacatctgtactccctgatactcagaagggtgaggccagatgatctcttgagtccaggagttcaaggctgcagcgagccataatggagccactagactccagcctgggcaacagagcaagaccccatctctaaaaaaataaaacaaaatacccattacaatagatcttatccacaagcctcattcctcctttcctccctccataaggaaatgaggtaggatgaggtcgccagaagagactcaagccagccttctctgggactctgctgaaaatgctccttggaagcttttggaagttttaatgtcaggtgaccagcttcctggaatttctgtgctgcaagggtggattcatgctgattgggtgcatggatggcaagaacaggcctggaaaacatcgcgtagctcaaactggcatcgattgaggctcattgcctcaaaggaatgaacatcagtaggattcttatgatttcagatttcatgtgctaagtgcacctttactaatacatttaggttcacaactgcttgactcaaataagccaagtatattgtataatatgtgacctcacggtaccctgaagcaaacagatttggggacattgattaaaggcatgttcctcatgtggccttctacttgaccctcagctatctgaattggcgaagctttcatgtggctaggataatgctacccacaatcagtgtggcagctcagtgaatgcctgggctttgtctcttcccacccaacgagccccattcaagcccccagggggaagaaaaggagataaaaagacaaagctgtgcacagcccagcgcttctcctctctagctgtgcccaggacagcttttggcttgggctggtccatcctgcagacaagggcagagaaatcaaagaaaccatcacagatctgtggggcaggaaaatgagcctggtccagctttcacagctctctgagatggggcatgttgggaattttagccgatttaataaaagttgcagcatgagacctgtgaatcccaccctgctgcttcctggatcctgccacaccccatccagcagcaaccaagccagtctcgcccctgactgggacagagtggctgagaggggctctggagccagctgcctggatttgaatcccagctgtgccacttaccagctgtgtgactgtaggtgagttatttcacctctctgggcttcagtttcctcatccgtaaatgaggatgatgatattataaaacccttaccccatgaggttattcattcattaaataaataatattataatttatatagttataattcattataatgaatattattcttattcattcattgttcatctacgcagagtgctttgaacttgcctggcatgtacggtaagctattattcattcaacagtataaactggccaggtgaggtgactcaagcctgtaatcccagcagtttgggaggctgaggcatgtggatcacctgagctcaggagttggagaccagcctggccagcatggtgaaactccatctctactaaaaatacaaaaattagccgggcgtagtggcgggcgtctgtaatcccagctactcaggaggctgaggtaggagaattgcttgaacctgggaggcagagattgcagtgagccaagattgcgccactgcactccagcctggatgacacagcgagactctgacacacacacacaaaaaataaagtttaaacttcccaaatcctatgacattgtactattatcatggtaaagaacactgagacagagggactaataacttgcccaagggcacacagctcacaaatagcaaaacggtggtcatgagctgaaagacttatgtgtttctgctctatgtgataatatagggtggtgcaaaagtaatttcagttttttccactacttttgaaggcaaaaactgcaattacttttgcaccagcctaatatgtatgttaggttcccattgctgctgtaacaaattaatacaaacttagtggcttaaaacaacacccgtctattctctaacagttctggggatcagtagtctgacctcactgggctcaagatgtcagcagggctggttccttctggaggcttcaggggagaattcattttcttgccttttttagtttccagaggctacagcattccttggctcatagtcccttcctgacatctgtccaagctcttgtttccatcttcacctcttccactttgaccttcctacctccttctaacaagaactcaagggattacactggggctacctggatcatctggaataatctccccgtctccagatccttaacttaatcacatctctaaagtaccttttaccatgtaaggtaacatattcccaggttccagggtttagggcatgactatcttgagggaccactattcagcctaccacagcatgttcacatttcaataactggactggatttctgggtttttttccagaaaagtcatagcctgagtttttatgaaaaagtaaaaagtatactatggtctcttggctttttgtagggtagatgatagaaagatggaacaatagatcagaaataatgaagatgatgatgatgatagccaacatttgcagagtgttcagcttccaagtagtttacaggcattacttcttttagccgtcaggcaataggatcaggtagggaggcgtgagaactattcccattttacagatgagaaaactgaggcatagagaggtgacatagtcacatggccaaggtctcacgggtggatgtggtagagcctggatgagagcccaggatgcctggctcccacagcccactcagaccctcgggcacttctgcccaggtgtcaggacggtgccagcggtagccttacagggtgtcagagtgctaatgcaaggtggcaggcctccaagatgccattctgaggggtttctctttggtcaattcaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagagtgagtcccaccccaggggtgacatccccaccacgatgggcccacagactcctagtcacggatgcactgtggcccctgagacctgctgtgtccttcttggccatcccctagacagatagttgctttggatgcttctgaaggcttaggactgttgagcaggagggtgaggtggccaagatgtagaggtggcaccccgtcacactctgcttgcttgggaatgtctctgatggtggcaaccaggtggaacactggagagatccagtggaccaggtagggcggcctccaaggagcaacctctggctggctcggtgcttgttgctctcaattgaccagggactctgttccagaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatgggtaaggacccagggccacagcccacagggccagagggtggaggggagagggaggccacttgcttccaggaacaccttatggcaaagcgggaatgctacccaaggcagagggggagatttaaataatagccataaagaagcagttccctgatagcaaaccaaattgtcttgctgtgcaaacactgatttgcctttgagaccagtcctgtagtggtcaaaaacttccttctgggaagcaggtgtcatggatgaggaatccctccctcatacggagtggggactgcctaacagtttgggattgagataaccagagaccttttcagatgatgaaaattaagaatggggaaatgcagcttggagatttccaggcaactgatgaacaggttattctgagcacctgctgtgtgcccagcactgttagggtcttgtgggaaaatcagaaaggcacatctcacacctgctgattttccccaagaacttaagaacaacactgcctgctttgcagggctgtggggtagatgcagtgccagcccagtgtggggcagcctgctgtgttaatacgttccaaatgggagcgttccaaatgggagcgaagacaacttacagggatgcaaacaactcagccagataaaataagtttaaaatccatgtatttcgactgtatttattgcgattctgctgcatgcaaggccgggcacagtggctcacgcctgtaatcccagcactttgggaggccgaggcaagtggatcaatcaaggtcagcagttcgagaaaaacctggatagtatagtgaaatcccgtctctacgaaaaaatacaacaattagccaggcgtggtggtgggagcctgtaatcccacctactcgggaggctaaggcaggagaatcgtttgaacccaggaggtggaagttgcagggaaccgagatcgcaccactgcactccagcctgggagacagagtgagactctgtctaaaaaataataataaaattaaaaagaatttgacaaaaaagaaaatatggagaggaaggtaagacagatctgagtggtgagatttgaaagccaaaaatatcatataagacgctagactcctactacaggaagcccacggttctggattggagcttcctggaagccaaggcaaaatggaaacccaagcaattataaaattgacaagacccaccaaatgaagcagggtggggtgaggggagggaacagcatgtgccaaatccctgtggtgggaggtgagttgggtgcttgagggactgagtgacctgcagggtgactggcacataaaaggcaaggggagtttagtggctgatgaggctagaggggtggacgaggctgggtcatgtagggcctgggggtcatagtaagtctggcatttatttaagagcagtgttaagattaaagtgggcggtgtatgtgtgtgacataacctgagtagtgttttaaagctatttttatttgtttgggttttttgtttgtttgtttgtttgagacagagtctcgctctgtcacccaggctggagtgcagtggctcaatcttggctcactgcaagctccgtctcctgggttcacaccattctcctgcctcagcctccccagtagctgggactacaggcgcccacaactgcgcctggctaattttttgtatttttagtagagacggggtttcaccgtgttagccaggatggtctcgatctcctgaccttgtgatccgcccacctcggccccccaaagtgctgagattacaggcgtgagccacttagagctatttttaaatccttgcaacagcacttcaaaggcaaagcttaccatttccactttacagatgaggaagctgaggaagccacggctcagagacgttaagccacttgccctagtgtgcacagctgggaagtggtgaacccgcctttcaacccacagttgtctgaggcctaagcccatgatttcgcttccctctctgagagttgagatgagcaggaaagactttctggaggaggcgggtctgcagctgggccttctagggtggtacgggagaccagtgggctctgaccaccttccctgctctctatccccctccagccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggtgctgcgtgctggggctgggggtgcaggctgtggcctatactggtcaattgcgggcccaagggtggcttggacatggttcttgcccttgagatggccccaatctggccaggagctcttccaacaagtactcattgagaatctaatgtggaacaatccagccctcctggttagtggggtgaaatcatgttaaggggtcaccaaggggaagggagaacaaggggctaccaggagaagggaatggggccagaatactcctgggcaatgggagaaggggcttatggttcacagtgagccttagaggccagggtgtggcatgggtggtgggggtgccactctcccgcatcagccaccttccctgtacttgccaaagccctgggagagggagctggcaaagcagcagttctgcccccacccccgccctgccacaactcaggatttcttggggaatttttttaggccactgtttcacaaccattttcaacccctgccattttttgtttgtttgttttttagggacaggaacttgctctgttactcaggctggagtgcagaggtgcaatcataactcctgggctcaagtgatcctcccaccccagccccccgagtggctgggaccacaggcccatgccaccacactcagctaattttatttatttatttacatatttatttttagagacagggttgccctctgcctacccaggctggagtgcagtggcgtgatcatagttcactgtagcctcaaactctcaggctccaggatcctcccgacttagtctccccagtagctggcactacaggcatgcactaccacacccagctaatttctaaaaaaattttttttttttttgagacagagtctcactctgtttcccaggctggagtgcagtggcacaatctcggctcaatgcaagctccacctaccaggttcacgccattctcctgcctcagcctcccaagtagctgggactacaggtgcctgccaccatgcctggccaatttttttgtatttttagtagagacggtgtttcaccgtgttagccaggatggtctcaatctcctgaccttgtgatccgcccgcctcagcctcccaccatgctggaattacaggcgtgagcaactgcgcccagcttctaaaatttttttctagagacaaggtctcgccatcttgccccagctggtctcaaactcctgggttcaactgatcctcccaaagctttgggattataggcatgaaccactgagcctggcctaacatatatatttgtaaatttcttctatagatggggtcttgcgatgttgcccaggctggtctcaaactcttggcctcaggtgatcctctcacctcggtctcctaaagtgttggaattacaggagtgagcctcgtgcctagccactctgcccattttttgataaacagaatcatctcatgcaatcccatttagtgcgatttgaaacctcaagcctttttcattttaactatgcaattatgccagtcctgtgaaggcatgatcccagccatccaggctcaggggctgtctcagtcacagaatccatctagcaatcaaaaagtcacttcactaaaactcaattctctttctcaaacactaggaattgcaaacaaatattcgtatttaaatctactactatgaaaaatcttcaccacacactaaagtactagattggtgcaaaagtaattgtggtttttgccattaaatagtaaaagtagtaaatgttcctcccctctcccccatataggaagcttgctggactttctgaaaagtgatgagggcagcaagcagccattgccaaaactcattgacttctcagcccaggtgagagcctaacgaggaaacggggaagggaaacaggaattcgatttttttacttgccaaatatttactgaccacatactatgatgatagcagtaataataatgggtaaaatgtattgagagctcagtataaaactatgttttttgcatatattttattatacatgtactcattcatttaatcatcctataagctttataggctgggatttttgttatctattttggtataacaaaccatccaagtcctagtagcttgaaacaacagcaattgttatttctcatgatcctgtgggttgcctgggttcagctgggtggttcttctgctcgtcatggtaaagtgaggtgcagatgttggcacttgcccaggctagaatgtccaagacatggctcagcctccagggtctctccacatagcccctcaccacccaatcacccagcctgagcttcttcacggcgcagcagctgggttccaagacagagctggaccaggggccaagccttcatgagcaggctctcattaagcctctgcctgcatcaggcttgctaatggcccattggccaagtcacatagccatgcccagaatcagtgtgggaggggactgaccaaggacacaaatcccagggaccccctcaatgtaacagtctggccacagagtaggtaattatcatcccattttacagaataggaaattgaagcatagagcagaagtaaagtacagatgtggaaactgagccccagtgtggttaagtggcttgcacaagttactgtgctaattatgggggatatagcagtgaacaaaatgaaaatgttcctgtcctaatagagttcacaatccaggtgggaagatgagtattaaataaccaaatctcttagagaccatgacccaagtggtcctggctgagtcaaaagagcacagtatctaacaaagtaaataatgttcacaaatcgcaaaaacactgctgaaaacctaattttctttctcatgttccccacgccccttgcagctcctctcacccccagcctaagcagttttttcacttctgtcctctctcatgctctctctgatgtctgggaaaacagagtgtaaggacggggtggtattagagtgcatagctagagcatttagcctggtccaggagcaatcagagaatgcttcctggaggaagtggcctctaggccgagcctgaaggatgaatagaagttcagtagatgaagagaaaaggtaaaggtcttttagacaaaagaaacagcctgtgcaaaagtaggtgaaggagttcagcctactcagcaggagcccagggatagtgggagttgagtgagaccctgcctgggcctcagctgggcctgctggagatgccaagggcagggctcatttgagtatgcaaattcaggggcccagaggacaccacaaagtgtaacaaaagactctactttcagagcctggaatgccagaggcatatggaaatgtgttttcactcctatgggccaggtcctctgggagacaatagactggtctgttgctaaattatcatcttcaaactagcagaagccctgctgggcagcagtcaccgaccagggcaagagccactctgcccgtttcacagaggggaaaacaaaccaagggaggaaaagaggttctgggccttcatctgtccagaagcagaggtagattcagagcccagggacagaaaggagcccacctggggctttggtcttcacctccagactcagagaggcagcttggagcagcaggtggagaactggaccacacatgtggggtttctgtagtcacagctttgtgggtgacatgaaatgttattcagtagctgcatatatacaaacaggtcaaaacagagctgctctgactgaagcagggtggggggcttatctgtggcctttcttttgtctcccccacccccatataaccttgaggcatccataggattcagttggaagagctctacaggtccttccagctctgatgctgtgactccctgatactctttggaagcaaacccaagggtgcccaacctcatggcaccctatctgggggtcatgaaatctcaccgcctttatcaacccgcagtgcttacacctgggcccaataaacctactcgttattcattcagtcagcagaccctggagaagcaacactattagcatctgggcttaggagtcacacagagttttgttttgatctcagctctgcctgtgtagcctcaagcaagttgcttaacctctctgagtgccactttcccccactgggagcactgggagccactctttaaataaatacttaactatgtgccaaacactctactaagcccttgatgtaggcttaggggattcatcttcacatgaccccttggaaccaggtgctattacagagaagaaaagtgaggtacagagagatgacacaacttgcttgacatcacagagctgcagcgctcaagctgagttggtccagctccagagccatttagctattaccctctgctgtctcctaagtggggtgtcatccctgccccatcgagctcctgtgaaaatcagtagcatatgagcatctgccagtgagcatcaaacagtggtaactaccagcattagtccttgctccagaagaaaagcaaggcaaaaaagctgggccaagtaacaggtaagtgcgtggaccccaagcagcgcttttggagctccagccctggctccgcaacttgcaagctgtgtaagctggggccacttacctatttctctgggcttcagttttcttatctgtggaaatggggctgataacaaaagtgcctcctccaaagcacatggtaaatgtcacataagtgtttaagtatcatcttataaataagctatgatgccttccattagcatcataacttttgttaactgttcatctaaggactcataaatttcccacactcccagggccaagatgctgtctcactccaccctggcaacctcatccccatttcgtccccaccccccactattctaaacaaaatcagagtctcttccaagtttttactgaaaaatttgggtctctgggtctcccttgggcatgacagctcaggcctgtaatcccagcactttgggaagctgaagcaggaggatcctttaagcccagcctgggccacatagtgggacctcttctctattaaaaaaaaaaaaaattctttttaaatttaatctggcatagtggcatgcacctatagtaccagctgcttgggaagctgaggtgggaagactgcttgagcccaggaggcacaggttgcagtaagctgtgatcccaccactgtactccgtgacagagcaaggccctgtctcaaaagaaaaaaaaaaagaagaaagaaaagaaaaaagcaaagcatgggtctccattctaactgcctcgggtgccccctgctgtccaccccttgcaagtgcgccacccacttgcctcagaccttgagaagccggccggtggtgctttgattgttctgtctagtcagacgccctcacttccagaataatttcatcagactgcacccagctgcagtctgccggagcactggagtgctgggttatttagaggcagcaggatgcactggattgggagtcctcagactggtttgagcctgacattcagaattttcctggtggtgtgatctggaacaagtggttccatgtctgtaaaacagagattatgatcattcctgcctcaaagagctcaagcccagtttgtaaaccaaaagtgctgctttctgggcatctgagggttcatcttcaaccgcttttgtccaaacccttgtaagtaaaaatgtctgcaagatataatccctgtgttttcatcagaggcttctagggctcctggtgtgaataagaatcctccacgcagtctgttagtcactcagcagccatggtgatctttaaatgtacatcagaacatgtcacgctcctgctcgaaggcctctaatatctccccaacacgctcagaataaaatccaccctcctctcctgacctacaaggcagttcatgattggcggcctccctctcaacttcaactctccccactctctctgtggcatcttctgctggccacactgacctctgtgctgttccatgaacacccaagctcttacctacctccacgcctttgcatctcatgttctctctgcctagaatattcttatgcgacacacttattattatcatcattcagatctttgctaaaatctcaccccctcaaagcaggtttccctgaacgcccaatccaaaaaagctctctacaggtcatattttgttactttgttttatcttttttttctttttgagacagagtcttgctctgtcgcccaggctggaggacagtggcacgatctcggctcactgcagcctctgcctcctgggtccaagcaattctcgtgcctcaacctcctgagcagatgggattacaggcgtgcaccaccatgctcatcttctttttgtatttttagtagagacggggtttcgccatgttggccaggctggtctcgaactcctggcctcaagtgatccgcccacctcggcctcccaaagtgctgggattacaagtgtaagccaccatgcccggcctgttttatcttttctttatggtacttaccacctgcaggggctttgccgggctcatcacctgttcaagcaacatgtctggcacccacaagacactcagtggatttctgttgagtaaataagtgaattttccctacccaggctggggcatgaggaagatatgagaggtatagcagaatatgacatgaacctgggttgtccccagaaagagagttgaaggtgaaagctcttcatagtatcctagggttcgtgtgtgtgtgtgtgtgtgtgtgtgtgtgtgtgcatgtgcacgtgtgtgtgtatgtgtgttcctggaagaataggtcctggagaaatagtcccattgctttttccctgagaacatttcaaagtgctctctggaagtcttggaattctagagaatcccccaaactggcccaggcctccttagggatccccctaacctgaatgggttgatggaggaatgccaccctgagccctggggccctcccgacacaaaagggagggctggtgcagacatttcgcattttcttcacttgaacacctctctgctgcttttgggtggggccatcttggcgtaggccaggtctgaggacaaaggtgtctctgtttggggtgcagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggtagggaacgctgccaagcagccccacgttgcccatttggatgcttgtgagtgttgagagttgatacttgtgagagcgattggtaaaatgcaagggactgccccagtactagctgtgcattcttgagcttggtggatccttctggataatgtcctgaacttcagagtctcactcagagattttgaggagattttagatcagattgagaagtactgatagattttagagggagtgggcaaatatatgtcgaaattaagggtaagagcagctttgtgcataacagacaaaaatggggagggtatccaaatgtccatagcaggaggatggattgtggtatattcacacaatataataccacgcagtgatgaaaaagcacaaactggccaggctcagtggctcacgcctgtaatcccagcactttaggaggccaagactggaggactgcttgagcccagaagctcaagaccagcctgggcaacacaggaagacctagtctctacaaaaatttaagaaattagccaggcatggtggcacatgcctgtatgcctgtagttgtggctactcaggaggttagggtgagaggatcacttgagtctaggaagctgaagctgcagtaagccatgatcatgccactgcacccagcctggtggacagagcaagatcttgtcaaaagaaaagaaaagaaaagaaaagaaagaaagaaagaaagaaagaaagaaagaaagaaagaaagaaagaaggaaagaaagaaagagagagaaagagaaagaaagaaagaaagaaagaaagaaagaaagaaagaaagaaagaaagaaagaaaagaaagaaagaggcacaagccaatgctaaatgcaccaaaatgggtaactctcacaggtataatatcaaaatgaaagaaattagaccaaaaaaaaagagtagatgccacttggtttcgtttttgtgaaattctaaaagagacaaaacatgtaattggacattcatggcagcattcttcctaatagccaaaaaatggaaacaacactctttaatgtccatcaattgatgaacagacgaacaaaatgtgatatatccatacaatggaatattatttggccataaaatggaatgaagtactacgccaggctagaacacagatgacccttaaaaacattttgttaaaggaaagccaacatgaagaccacatgttgtataattccccttctatgaaatgtccagaagaggcaatcttttttttttctttgagatggagtcttgctgtcacccaggctagagtgcagtggctcaatctcagctcactgcaacctctgcctcccaggttcaagcgattcttgtgcctcagccttctgagtagctgggattacaggcgcacaccaccatacccagctaatttttgtatttttagtagataacagggtttcaccatgttggccaggctgaactcaaactcctgacctcaagtgatccgcccgccttggcctcccaaactgctgggattacaggtgtgagccaccatgcccggcccagaacagacaaatctaaagagacagaaagtagattattggtgcctacagctggtggtggggagttgggagaaatgaggagtgacttctgtgggttttttgcagggaaatgtgatgaaagtattctaaaatccacaactttgtaaatattctgaaagccacggaattatacactttaaatgggtgaaatgtatggtctgtgaattctatctcgataaagctgttaaagaaagaaacaggcaaaatttatttatagcactagaggtcagaattgcagtcacctttagtttctgttagcctaatatttatttatttatttatttatttatttatttatttatttatttattttgagacggagtctcgctctgctgcccaggctggagtgcattggcgccatctcagctcactgcaaactccacctcctgggtttaagtgattgtcctgcctcagcctcccaagcagctgggattacaagcatgtgccatcatgcccagctagtttttgtatttttagtagagacagggtttcaccatgttggccaggctggtctcgaactgatgacctcaagtgattcacccacctgggcctcccgaagtgctgggattacagatgcgagccactgtgccagtcctatttatttttttaaagagacgggtgcggccgggcacagtggctcacacctgtaataccagcactttgggaggccaaggcaggcggatcacaaggtcaggagtttgagaccagcctggccaatatggtgaaaccctgtctctactaaagatacaaaaattagctgggcgtggtggcaggtgcctgtagtcccagctactcgggaggctgaggcaggagaatcatttgaacccgggaggcagaggttgcagcaatgagccgagattgtgccattgcactccagcctgggtgatagagcgagactccgtctcaaaaaaaaaaaaaaaaaaaaaagataggtgcttgctctgttgcccaggctgtagtggaggggtgagatcatagctcactgtagcctccaactcttgggctcaagcaatcttccagcctcagcctcctgagtacctgaaactacagatacgtgctaccatgcccagctaattttttaattatttgtagagatagtgtctcactgtgttgcccaggctggtctcaaactcctggacttacgtgatcctcctgcctcaggctctgaaagtgctaggattacaggcatgagccactatgcacaggctgcagtcaccttaagtaagggggtattaactggaaggacgcagaaaggagcgttctgaaatgctgaaaatgttctacagcccaatctgatggtgattacaagggtatatatatatatataaagctgcagcaaaatggatattaaagatttgtgcatattatttcatgtacgttataactcgattaaaaaaaatttagaccgggcacagtggctcatgactataatcctagcactttgggaggccaaaatgggcagattgcttgagcccaggagttcaagaccagcctgggcaatatagcaagaccccatctctacaaaaaatttaaaaataagtcaggcgtggtggtgtgagcctgtggtccctgctactcaggaggctgaggcgggagaatcgcttgagcccaggaggttgaggctgcagtgagccaagatcatgtcactgcactccagcctgtgtaacagagcaagactttgtctcaaaaaagtaaataaatagggccgggcacgttggctcatgcctgtaattccagcactttgggaggctgaggtgggaggatcacgaggtcaggagatcgagaccatcctggctaacacggtgaaaccccatctctactaaaaatacaaaaaattagccaggcgtggtggcgggcacctgtagtcccagctacttgggagactgaggcaggagaatggcgtgaaagccgggaggcggaacttgcagtgagctgagatgacaccactgcactccagcctgggcaaacagagcgagaccctgtctcaaaacataaataaataaataaataaataaatgtaatgactaaaggaataaaagtagaatgtataatttctaaaccagaagaagataagcaggaaatcaagaaaagtctgtagatccaaaggaggaagggagaaaacatatacacacacacacactctcacacacacaaacacacacatagaacattttcaaaacttgaccatgtactcagtcataaagcaggtctcaacaaattccaaagaacatatattctatagaccatgttcaccaaccatgatataattaaactaaacactttttaaaaaaggataactatgccaggtgcggtggctcacacctataatcccagtgctttaggaggccaagatgggaggatcacttgagcccaggagttttgagaacaggctgggtaacataataaaacactgtctctacaaatttttctatttttttatattttattttattttattttattttatttttgagacggagtctgactctatcatccaggctggagtgcagtggtgtgatctcggttcactgcaacctccatcccctgggttcaagtgattctcctgtctcagcctgtagctggaactacaggcacctgccaccatgcccagctaattttgtatttttagtagagatggagttggccaggctggtctcgaattcctgacctcaggtgatcctcctccttggtctcccaaagtgctgggattacaggcacaagccaccatacctggccaaaaaaatttttttaattagcttggcataatggggcacacctgtaaccccaggggcttgagaggctgaggcaggaggatagcttgaggtcaggagttcgaggcttcagtgaactatgattgtgccactgcgctccagcctgggcactctgtctctaaaagaaaaaaaaaatgaaaaggctaactaaacccatgtcagactaggtgggaggaagggcgggtaaagggagagacacatagtgactggtgggaacctcatgggctgagagccagaatcctcccttttcccatcgcccaggatgagaggactgaggcatcagctgcaacctggactcaaggccccctgaagtccttctgtccccaaagacctgtgacctctgggattccactcttcggagttgcagttaactggggtatcagctgaatcaacgaggaggattctagagtgaacttccacaccataccccaggcccctaagcccactcctccttgtttagccatctgtcctcaggatggatgtcccttgcttccacagggaggccacgtatcagggaaattgcaggtctgcaggggcagatgttggcagctcttgcccttgcctgttcccccaccttagcagagccaaccctcactactccccagccttccccgactctgctctgttcaaccctgcaggggccaagttccccatcaagtggacagctcctgaagccatcaactttggctccttcaccatcaagtcagacgtctggtcctttggtatcctgctgatggagatcgtcacctacggccggatcccttacccaggtagggaaggggcatcagctcagggctgctaccagggcccagtctggcaatgggctcatctcaacaacatgtccattcaaactgagttcttgatcctcacccccaaccttccctcacctttcctgtcttagttaaaggcacctccatccatctaatgtcttaagcctgaaatctgggggcttccttggcccttccttctctctcactcctatgactttttttttttttttttttttttttgagacggagtctccctctgtcacccaggctggagtgcagtgacgtgatctcggctcactgcaacctccgcctcccaggttcaagcgattctcctgcctcagcctcctgagtaactgggattacaagcatccaccaccatgcctggctaatttttgtatttttagtagagacggggtttcaccatgttggccaggctggtctcgaactgctgaccttaggtgatgcgcctgcctcggcctcccaaagtgctgggattacaggcgtgagccactgtgcctggcctcacccctatgacatctgagcagtcacagggttttggccactcgactccaaaacatatcccaagtctcaccactttgaaccccacagtctccactgcatccaggccagcgtcatctcccatagatggtgcagcggcatcctcatcagtcttactgctttctccctcctcgtcctacagcctattctccacttgcagccagaaggataattctaaactttaaatcagatcttgtcctttctccaccttttttttttttttaagacaaggtctcactctgtcactgaggctgtagtgcagtggtgtaatcatagctcatggcagcctcgacttcctaggctcaaatgatcctcccgcttcagcctcccgagtatctgggaccataggcacatgccaccatgtctggctattttttatttttttaatttttttgtagagacttggtctcactacgttgtgcagcctggtctctaacttccaggctcaaacgatcctccagccttggcctcccaaaatgctgggattacagacacacaccaccatgcccagctaattctttaaattttttgagagacaaggtattgctatgttgccgggctggtgatttccatttttaagcgatgctttcagcatggagagtgaatgggagggaaagggaacagggtggcagccagtgaggaggccacagcagtggcccaggcagaggtgatgatggtctggacagggtggtggcattcgtgactggcatacgttgatgaactggtgctacgtttcaaaaggagaaaagatctgacttgctgacttaggaggtgagagagagagaataaaggatgattaccctggctttgcaccacagggtgggtaatggtctagggatagaaattggagagctctgttttagctctgctaaatttgagttgacttaaatatagagacatccaagtaaaggaagcacttgagttcatgagtttggagtttgagactaataatataaaattggggatcacagacattgaatggctattcttatgaatagctaatagaaacttgaactgaacaaaaaaatggtcccacccataggttaacattgaatctggccacctgaatgttttgtcttgagggtgcactagtcaaaaccaggcaacacacaatagacgctgaatccattaggatgtgttccacagcaagcaacaaaataacagacaaagagtaactgaaatagaagcaatctattactcccaatcttccattggtgactggttagttcagcaactcagcagctgtcaggactctgggttcctgtctctatgatggtcttctccatgttgtcagctccaagtatcataagtatctcacagtgttcaaaggaagagatgaagggtgcgttctccaaagactctcctctaagcgggaggaaaaacctttccatcactttcccagcagacctccccatcagctcccattggcccaaactgggtcccaggcccatgtcctagctgcaagtgaagctgagggtggaagtctgtctttcacagtggaaggggctcagcttgcaaggtgaggtggggagtgatgcctgctggggaggccacagggcctgccacccctgggctctcatttcccaactgcttccgtttctaattccacggctccttttcagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttaccaaaacgttggttttcctgtccttccaattcctgaatatctatttgccttcttgctgtatgacaagtcagaaatggtgaaggactctcccggggaccagaaatacaaagacaagtggggttcagactgggtgctgtggctcccacctataataccagtgctttgggagaccgaggagcgggggattgcttgagcccaggaggtcgaggccacagtgagctatgatcgtgccactgcactctagcctgagcgacacagtgagaccctgtttaaaaaaaaaaaaaaaagatgaagaagaagaaagaaaggaaaggaaagaaaattggggttcaatgcttgaggttttctaactgccctaaaatagttactggctatattagtttcctcttgctcctgtaacaaattaccacatatctggtagcttaagacaacaaaactgcataacattacttggccgggcataatggctcatgcctatagttccagcattttgggagactgaggtgggtgatcacttgagatcaggagttcgagaccagcctggccaacatggtgaaaccccgtctctactaaaaatacaaaaattagccaggcatggtggtgggcgcctgtaatcctagctactggagaggatgaggcaggagaattgcttgaacccgggaggtggaggttgcagtgagccgagattgtaccactgcactccagcctgggcaagacagcgagaccctgtctcaatacatacatacatacatacatacatgtataaccttactgttccagaaaagcaagaccctgtctcaatcaatcaatcaatcaatcagtcaatacatgtataaccttactgttccagaagtcagagggactgaaatgggttggcagggctgcattctttttggaggctctaggggataatttgtttccttgcctttcccagtttctagaggctgctcctattccttcactcatcagcccctttcgttcattactccaaactttgctttcatcttcatatctcctctgagtcttcttcccctcttttatttgtaagaactccttggacccacctggataattcagaataatcttctcatctcaggattcttaatcacctttgcaaagtcccttttgccatgtgaggtaacattttcacacgctctgagggttaggacatgaacatctttcgacggggggcacttttctgccttctccactggtatccagatgctggatgggttttgcctccaaggagatgggtcttccaggatgacaggaatggtttctcatgatctgggaccctgactttcctgttaggccacattgctataagagctggtcagtttacagctccccagagctgggggctgcctgcagacctgacgtttcccatgggtcaagcagccatcatacttgtcgaagtggtatttgccattgcaggaatcctggtctggagatatggctgctgagaggtgtctagtaccctacaggggaagctctcagtggaggggtgggagacctgcgtaggaagcagagaagacgaagcagtgcgggcttcctgaatgttgcctcagctgaaagaccctggcagctagtttttatcatagagagaaagacaaaagaggtggacaatgggtgaaaacgaaacaccacctttctatattattgcatcccctgaaggttgtacatcacatcaccccccagggtcccatggaatcctatactaacttgattctgtacttctgagtagggtggggttctaaccttaggaactgaatataagaacagtggaaaataaagctagcagtgtttcaatttacctagttggtaatttctttcttgctttctagtttggggtatggcttgggtacatgaaagcagagcccagggtcttctgatggaaatgttcccttatgatttgtgataataatccaatgggaggagtacatttccctgctccatcagtgttgagcttgaccgtgagacttgctttagccaatgggatgt

SEQ ID NO: 16287 - DNA, 60489 bp, Human
cctatggagtttacaattaataactctcttaatcatcacaatagctcaacgagagaggttggtactattacccattttacaattgaggacattgaagcacagagcagttgagaaacttgcctaactagcagagttagaatccagacaaagtgcttaaccacaaggcgatgcttcttctatatataaactgacggacggatgaaataggctgattgactgatgagtgactgactgactgactgaatgaataaatggaaatgtgattataaatgttgattttttgcgcctcccgattccccagatctaccgcgagggggcgatctctccccggtcctgatgccagtcactcaaggcgcgcactccctttgcgtctcgggctcgcgcgcgttgccgcggcaccggaagtgactgagcttgcaagttcccctgtctcttcaggggaaactgaggccggcttgttcgggagagacggcgcgagcagtcagccaggtaggccggcagccaggtaggccggcccgggtccgcggcgcggaactcggccgcgaagagctcttgcgtctggaagctaccgggccgatgaagggggatgtggccccccacggctcgcggggctcgcaggtgagagcgccgcctcccctgtgcgtgacagccgttgcgcccaataggagccttcgccgtcccgcttccgtgccggctgggctcgctgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatgtaggtggtgcgggggagcgggagtggggcgggggggactgcccagggagtgactttccgaggaaggcatttcggagaagacgggggtagaaaaggctggtgggagattcagagtccactggtgctttcgatttgacttaagtgaagtatcttggaacctagacccagaccttcgtaagacccacaaagaaaccagttctggtacctggagggggaatggaatttttagggtaaatggcatgcatattaattatttttttttcctgaagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggtaagaaccaagccccttgtgtgtcccttttctttggcctctggtcagagatccccaacagcccttcttctgtatctctttctgttgtgttgggtgattgttggagacgttgatagttgaggaaacctgactggcctcatttcaccacaagaggttaactccttggaaatacaaatgaccctgtgcttcagagatcaggcatctttcaccctggtcacccccatgactccactattccatacttgtgttccagtttctcagcaaagaaaactgtagcctatgtgttcattaagtcccaaacctgtgagggtaggaagttagttcggtgtttcccttaccttatacaatggttcacacacaaaggggtgatgagtataatgcctggagaagatgatgagcatcaatgacccacagacctctccatctgttccccccaaggggtctcagtcctatcctgggcttctctcccccaaatcaagttccctttatttcaaagtttgcgtgtatggcactctcctctcagactagggcatggccataggcaggagttcccactgggttgaatggctgagaattgtcagattttggggcagtgtaggctgtgcagattgtgtttgcactgcgccccctaagttcatttcccccaaagtgtgcgactttctgcatggttgccttgtttgtggagcacttgctgtgtcacacattaagccaggggactttgcacctcattgcctggggtcggttggggagctccagctgctctgcctgttactttccggccagagcccaggggcctcttcaagcactgtttgctggcaaagcaagaacctagtctttggggctctgtgggacattgagatttagtaacagacttcacatgcaggtataagttccagttctgtcatgtaactagctgtgtgaccttggacaggctgggttactttcttgaggcttagtttctttcactaaaaaatgtggcaagctctccttgccttacagtgtattgtaaatcttggcgataatgtgagcacagtgactgacaccagcaaattccctttccagggagggagagttctcctgcccatcactgagccaggatgagatggtggtgaaagcttctttaccagtggtcactgtaggcaagttttgctcttcagtgaattcagtcctgttttcttgcttatctccctacctagcggaggtgcaggttttatgagagatgttctatcccctcagagtatgcagaaaagcatcaagctgtggaaaataagtcatccattgaaggagctgaggtggaaggggacatgcaccatggactcaggaatgtcaagaatgcaactgtctataggctgggcctagggtgtggcaggcacttcactttaccactgagcaagagacctcctgagtttgccctggaaccccaccccctctctcattttgcatttctttgcaatttcaactcgtctgtgccagctcttgtaaaaggcaagggggtcaagtcaatagaggtcagataactggggtggggtcaggggaggtaaaggtggtgggttctcttgagctagctgactagacttgaaagccattctgtaaatgaactctctagggggataaatgattaaatagttcctgttggtttgtgcagtgacctctcctgttccctcctgctttgattctcttttggggcaaatatttgttcagctgattacaggagggacaggattccagtactgcagacacaccctctgaggcatctccaagtagggattgaggctgcttgcccactttgcctgactattgtctttggccagtggtcctaataccaggtgggttgttgccagctataaacaaaaggcagtctgggagaggtgcctggtctgctagccagcctctgcagaaggctacccctaccagagaattgccagctgcccagtggtgcatatgaaagaggtcttagacacagcaactctgggtaagtttattagatctccatggggttgaaattccatcttccatctctttgcttaagaatcatcagagcctgttggacaacataccacatgtcacttcctcttggtgaacagaggggatgtgtgtggaagagccagttatatcagaaccatttctgagcacacattctctccctaaggccagggagtaaagaacatttgactcaggatcctttgagcctgggtagaaggtacccgcccccttcctctcaggtattatcctgttccaagctgcaccgactggctactgtggtggcatcgggtaattatcctggagactgcggctgggagatccttaagggtaggagttatgggctattctactcagggctatgttctaaatttagcatccctacaggaaaggggaaggaaattagtctttattgagtacctgttaagtactaggcactgtgttaggtcctctacttatgcaaccagtgtttcttgagcatctactgtgaagctagcagtgtactaggtgctggccataagccacgcatggtaccttccttcatggaaacggcatgctgtttcatatattctacagtaaccttccaaggaaggtgagtttattcccagtttacacatgaaggtctttgtgcctaagtgactgaccccaggtgtccctcagccagttaagtgtctgaatgagaatttacaccaaggttggcataattctaaagccaacacttttcatcctatcaagttgtccagggagtaataaagtgacctagacatgctggcccagaaagccagagatgctgttgggccaagcaaaccatgcctgtgaaggtgctcactctggactgataactggctttgttcaggtagctatgggaaggatagttggcagtagcaggttcccagaggcgtgttggtagcctcagattctggcactggtaaaactcagacatggcaggtttcaagtgggcatcagggttttgcccagagtgagctgcttattaattttttctttttttttttttttttgagacggagtctcgctcttgttgcctaggctggagtgcagtggcgcgatctcagctcactgcagcctctgcctcccgggttcaagtgattctcctgcctcagcctcccaagtagctgggattacaggcatgcgccaccacacctggctaattttgtatttttagtagagatggggtttctccatgttggtcaagctggtttcaaactcccaacctcaggtgatccgcctgcctcagcctcccaaaatgctgggattacaggcatgaaccaccgtgcctggccccggccaattttttcattgttaaaaccctctcaggccctgccaatagatgacagtggtgtgcgtgtggggagaaggtggcctgccccaggtatctctacttagtggtggagtgatgcttcaaggactgaaagtgtagacccttagccagattactgcctgcctggagtcacctgatgaaatgctgaacctgttcggctgtcttgtccatctgtctctcccgcctgtaaaatggaataatgatagccagctgccatagcttgactcgagtaaaggatctagcacaaaagcccttctcctgccataattgtagggtggaaaccctttaatgaatgggcagcttccctcagagaactgactcttccccctagagtttctccttgagaaacaaagtccctgtgatactttcctggaatgttgtatacatgaccttccccgaagggacacaagtgtttctggtgctttccaatgggaatgtgggaagggacccaggtgggccttgccactttgggattgctgtccctgaagaaatcccttagcctgatagaaacgtaattgttgggagcaatgaactgtgttgggggagaaaacataacttggcctttcttaagctgtatggctcagtggtctgagtttctgtagatctcttattgcctaatgtggcttcttcagatggatgtatgcttagttgaagcacctcagctccctttgcagatagtggcagttctgtggttttcttagggaaaccccattagaaaccccaaatgtggaaatttttagtaatctcattcgggtcccaaaattaagtagaagtgtctcaggggctcccccttgaaacacctacttcttctgagtgtacatttgaggttgctcttaaaattctgttaccatcacagggttttccagacttcctaggaataatttccccagtagccccacagagccctttagcttctgtcgaaaattacccgggtattttttcagggggctccaatggaacctggagggttttcttgacttttgtatgggtgtccccagatttgtttgggctgcatgaaacagcagttgttatctctgtcccttcccccagcagatatctgtcctgaggccagtgggcttgagcgtcctcctctgtgtccagtctccctggttttgccagtgccctcagccttccatcatggggctttcttgaagcaactgtggttttgcctgagtttaatgtggatagacataggggtaattcccagtgtactgcttttctacggaagtataatctcctactgccttaattaagcagaggccctgtccccacccaacctccaacctaattccacagagtcctccctaaggactccctcttttttctttgaaggagtcactctactcctggatcctcttctcttctgcccctctatccgacagtctgtcttccttgttcccagttggcagacctgagtcaggcaatcccactgggtctttttgtttagcctggggaagagaagacccaggagaatatcaccagcttcagatatctgaaggaagagggactgagtctttttttattggtgtggtacctggcaaaacttggataaatgaaaagaagttaacagttggtagagcttaaattatgtgcagagaagacatttctaacagatttactctgtcctagatttaggagctcctcagggtggaggccacatcttgtccatgcttgtttcctcagcactgagcagaggccttgggcatagcagatacctaattgaagagaaacccactaaatttctgaagaaacagacccttgtcaagccagaataacaataatgggagtggctatttacctaataattcattcgttgagtcaaacaatgtttattgagctcctactgtgtaccatactgggagtatggcagtaaacaaaagtaagcaaaactaagtttctgtcctcatggagctcacattccaatgaggagtgacaggcaataaatatataattacatgtttatatcagatgattgtacatgctatgaagaaaataaagcaggttggggcatagggcatgtctagcaagggagggtggggctgcagttttaaaagagtgatcaaagaaggtgtaagggagaaaaaaatggctttcctctacccttctaggtcctttggctgggctgagaattaaattgacatagacagattaactggaggaaaaataattaattacatagttgtacacaggaatcctacaaaatatgaggctcaaagaagggtcagataattgaagcttatatagcatcctgagctacagaaaagaatatggggcttgggacttctgttaggggcttgagtggcagcaacccaagttatggcagggtgagggaaagaattggtggtggcgtgtgtctgtggtcccagatactgttgagggggtgtactgaggtgggaggatcacttgagcctgggaggtggaggttgcagtgagccgagatcaagccactgcactccaacctgggtgacagagcaagaccctgtctcaaaaaataaaaataaaaagtctctctggtaataaaatttgtctggagcagccctcttcctaatacagatacctttactagtgtagatttcctttttagatgtgaatttcttttacaaaaggacagcttttcagagctactcttatgtctgcagtttctcagaataaccagttcaaaatatgccaaagaagtatatttttggggtggcatattgttttcctacagtcatattttgggatggtatgtcctgagtcccaacaaaagtattacctaaatttatttgagccaagcgctaaatgaggtaaggaggtggatgatgtaggtaccctacagcaaagggtgtttaaagcagagggaatggactcaggagggagcatgcttgacattttcaaggatgagcaagaaggtcaatgtggctggagaagaaacagcaaaggggaaaagggtagaaggtggggagggaatggttgaggaggaggatggagaagtaggtgggggccagatcgcatacagcattacagaccatgatgaggatttggctttggtggaatggtctgtattccttttttttttttttttgagacagagtctttctctgtctcccagactggagtgcagtggcacgatctctgctcactgcaagctgcacctcctgggttcacgccattctcctgcctcagcctcccaagtagctgggactgcaggtgcccgccaccacacccggctaatttttggtatttttagtagacggggtttcaccatgttagtcaggatggtctcgatctcctgacctcgtgatccgcccgcctcagcctcctaaagtgctggaattacaggcgtgagccaccgtgccaggcctggtctgtattcttaagggtggcaacagggagcccagtgaagaggctggtgcaattgccaggtgaaaaagaatagtggcttggacctagaggtggaggtgtagtgagacggggactggagaataagaccaggcttgcacatggtatattgatgggtccagccatcctggaaaccatatttttcaactacttggaggtcctagaatcaaagttaagtaagatagatgttctttgggaatagttctctccaaatgtgatattctgatgaatggtcctcttccactccaacagtatttctgtctgagtaaatgaaatttgtctgagttcagttcccaactcatccgtgtctacctatgcaagctccttttacctctctgaatcttgggacaaataataatacctgcctcacagggggcgatggtaaagacacagtgaggtatacctgagatgcataaagactggagccatgttggtatcattattcttattatctttccacagaacgcatgtcagagacccattcacggaatcttgagcatccactctcctttttctaaataccatagtgacccatcagcacatctcagagcaggcccttgcagcatttctgttgtagtaggagctccacagtgtttgtgtgcaatggtggtgtaagcactggtcttggagttggaatcccagttctactctcagtctcaccttggccaagtcacttcacccccagtccccagtttccctttatgcaagatggagggtttgaagtaggcaataaaggaatgctggttctctctatccttaggccttgtggcggattccaccattacagcatatttcacattagttatattttaaaatggctctctcctgttgacagatatgtcagcaccttaactaaacccagtgtcaaggcaggctagtttatcactgagcccacaatagtgctaccctatatttatgtaacaccttacagcttccaaagcactttcagatccaccttgcctttttgatccttataaccacccagagaggtgagcaggaaggatgacatctccgtttcaaaggagagaaatcaggtgagaaagatgaattgacttgcccaaggttacatcaggaggaagaggcagtttttggactttcaaattggaacttgactactagcttgctgtgtgaccttgggcaagtcttttaacttgtaaatggctatagtaatgccacctttttctgaagattgggtgaattaattcattcttttaaggctttcatatcatcctagggctcttcactcacatcatctggcttctctttttttacatattgatttttgaaattgtggttttgtataaagaaactgcctttgggaccgtctgctatttggtttcatccctgatgagactctcgggccaagcttgagccttacagtgaactctgagccacacagctttttgggcagcctccagtgctcccctcggaactggaggtttttctccagctcttcaggaaatgccattgcgatgacttccatggactgcttcctgtcccagccctgccggcaagagtgtggaaactggaaagcaatgtccctagaggtccgccccccaaaaactactttttttggacgtgtccctgcctttcctcttgtccattactttctttgctccctaccctttcctccttcacctggcttctgcctccagctgtgatcatcccttcaagatttagaaaatgcctttctacttggttctgccaggccattaccccctaccctaggctaggctgtgagggaggtcagttagaattcctgggttctctccttggctccatcacgcattagcagtttcagtcctggacttcccctggagatgcattaaacctgttgcttgcggtgccctgtgtcatccattaaccctgagttcccctaggagattccaccccacccctgcataggatgggattcttaagagataacttgaggtttggcacatataaatcctgcctcttggaaattgatgataaagggtggagtgaaacagagcctgccttcccctcccccagtcacctttgaggaggaagctagaaggttgaaaaccttgttggacaatcatctgaggaatgggagctggcctgggaggggattggaacgcactcaactatgcctcagatcctttgttcctctcttgaaagggaaacattcccctccctcctccctggccacacacacatacacacgtgcctttgttcccccgagtcaggcagggataggaacatagtgtcccttccaaggagcctgactcgcttccctagagactggcctcctggtcagtgggactgggatatttgctcaggagcccccagcctcgtgtcctttccatagagtcttcgaggctaaaaacttgcctacaaacagctgctgagacttctctgtaattatttcatgggacacccatgtcccaggataaacagtccctccctcttactccagttggtgattaatattattgttaacattactattaatagtatctaacacttattgagtgcttactctatgccagccattgttcaaagtgctttacatgtattaatagatttcattctcacagcagcactctgaagtaggttcttttatccctgtttcacacatgaggaaactgaggtacagagaggttaagcaatttatgcaaagtagcacagttagtaagaggcaaagcctgggagggtagcttccaacctcccccttttaaacgctccactgtgttccctcgtccagtgcgctattgtctaggtgactgctggcattaatccagtgctcactatgtgacagcctttagtgacgctgtttttgttactatcccaacaaccttatcgttataggcactgagatttgggagggcttatagttagccagaggcagagtcagcatttgaaaccaggtctctcttactctgaagcctgtcctttttatctccagtccttaaaaatcttgcaaagtaggtgttgttaccttcattttatggttgagaaaattgaggctcagagaaaagtgatatacccagagcttcacaggctagtaccaagaagagctgggattcacactctactgtcttagtagtctgtattgtcatgattattctttttatgtgcatgataatactttcaatttaccaaactccttttataagttatttcccagtgaagtaggagaggtgggtatgttcagccctgtttccagaggggaaactaagataaggggtcttgtcccacagtaaatggcagcatcagacttagaattcatgttctggcttttaacacagtattatcaatactgtctgcctctcctaaagctggatgtgtggcttggagctgtccttggagtttcatttcttttgttaaatcagcaaatattgacaaatgctttgtaatgtgctaaatgctagtgatactgtggatattgtggtaactgagactgagtcccatccctcaatggtctgtttccatactccacaccttgggtcttgctggtgtccctctgccatctgaatcagtctacatgtgccatccatccttctcctcagctgccagacacaccaggcaagattcattatagttgatatgtattaatcaccttcaacacatacacagacaaaactctggcctcacatttgagacagcttgactccttgctggtggcataacacaaagcaaatcagcttcaaattctcatccataagcctgagagaataatgccaagccaccagagtaagtgaggcatgaatgagaaagtgaaatgtaagtgtgttttttggtaataataacagatactatgggttgagtagttacttgctctgtgccaggtgctgtgtttatcccctcaatataatcatcttacttggttctcacaaatgctctcctgtgaagatggagaatctagggttcagagaggctccctaatgtgtccacagtaacagatcttctaagaggcagagctgggtcttatactcagatgtgtctgatgcaaaagcctataagcgtcattgcttcttacaagcccagactggcttattttaccctgactacctggctcagggcccgcggttgggtgaggactcagccagggcctgctcaatgaacatgaagggttattattagatacaggttaggctacaaaaaaagtttctgcccctaaggaagcaaactcatttgaagcagtaggaatagacctcaaacacttggtgaatggcttgaggcaaactgtgccaaacctgtagagtaaacaccaaaagtggaagaagttgagcccacctgactgcattgctgggccctgggcctctgccaaatgggccagcttccaccatcagctacccagttgattactgggcccagaggcctccaccctcagcctgtatcatcaacctgcaccctttccctagccaactgcattgccaatccagactgtcttctgcatcaacagtggaaagggttaggaaggagagaggtcactgacagcttaaataatcatagctttctcagcaccgtagctttgtacaatttccactgaggcctcagtttcccggtctgtaaatggagataatactaatctcttaatgaagatgatagtaatctcttccttataggcttgctgtttttcctctgcctgtatcactcatcctatggatctgatcagggctctctctcttcttatcattcaggtatcaactcagatatcacctccctagaggtcgccatgtttacatgtttaccatctgtctcctgtagtaaaacataagctctcggagtacacgggctttatcctgtctttcatccccagcatctagcagagtgcttggtacataggaggcacttagcaaatatttgttgaataagtgactgtgtagaccacctcacacggtgtctgatatactcagtcaatgttaggcattgttatgtcttaggaagatgtggaccatgatgggtttaaataggtgaaaagaatgtaacaagagcaggctgtggctgggcgtggtggctcacacctgtaacctcagcactttgggagactgaggcaggtggatcacttgagatcaggagttcgaggctggcctggccaatatgacaaaaccttgtctcttcttttttttttttttttttttttttttgagatggagtcttgctcttgctcagttgcccaggctggagtgcagtggcacgatctcggctcactgcaagctccgcctcccaggttgacgccattctcctgcctcagcctcccgggtagctgggactacaggtgcccgccaccaggcccggctaattttttttgtatttttagtagagacggggtttcaccgtgttagccaggatggtctcgatctcctgacctcgtgatccacccgcctcagcctcccaaagcactgggattacaggcatgagccaccgcacccggctcgtctcttctaaaaatacaaaaattagcagggtgtggtggcgggcgcctgtaatcccagctacttgggaggctgagtcaggagaatcacttgaggccgggaaatggaggttgcagtgagctgaaatcatgccattgcactccagcttgggcgacagagggagactctgccacacacacacacaccaaaaagatcaggctagttacacacgcgtgcacgcgcgcacacacacacacgagcaggccagacgggtaagaaccacccagacagaactggagggtggagtatgtatgaagcatttgagagatcatgaggaggcagactggctagagccaaagatggtctgtgtcagcaataaagttggtcagggaagaaaccaggtggctgatgacagaggcctctggacagagggatggttgatggtagaggtgggcctaatggggagaggcccagagcacctgtgggatgcagttaggtctcagtaacccctaagaaaaagaatctcttgccagccagggctcagcaggcagagctgcagggagagaaaagccagaggcacctgcaacctgcagatcaggtaagctgccctggttgttattttgggactcagggccaggtgcagattcaaaggattgattgaagccttttggcaactctggcctcagcagggtaaacatcacctgtctcctgccacctgcagtgacaatgccaggaagggtaccctaggtaggcccaaaggggcctaactttcttgctgccctggtggagcaagaaatatcttctaggagaggccaatccttccctgccccacagctccttctctgcaaagctcaggtggcaatcaggtacctcctgcccaagaggcccccatggttctggcctaaggaaggcagggcggggcattgggagccgttgacagctgggctcagctggggggaggggtcagtttgggagcaggtgcagatttcagggagggtggggcctaaagggaagtagggatcttggtaggctgcaaaattttcctccccatcccccagccacagctggcttctccaggaacctgatgacctagttacaatgcttagaaattgtcagcttagcttgcagttcagggctttgccagtctctcctctctgaggcttcttgggtccaaaaggtaccttggcatttccccaagggggttccatgtgaatgacatacactgtatcacatgtacaggcttcttgcccaggggaggaaagagccagtaaggctgctgcttcttcccttgtgtgtgccccccaaccccagggagaaaatactcccatgcccttgcccccttctgtttctctctagagggttggtgagtgacaaatgggaagtcacaaacttcttcccttgagggtcaacaaagagggccagacccttgttgccctaaggatagattgagcacacctaaccattctttccttacctccccatctcagtgtgatgttaaaacctgatggaaagaggttaggaagactcttctgggggctctggaggccccccactctctcaggcagcagctgctcctggtattcctggtgtctgccttgcctccttgggagaaattccatcgttgttaagagtcaggtacgaaatttgacaaaccgttgttgagttggtgagtctcacttgcttaatagttatccttggcaaatacttaatctttcccagccttagtttcctcatgtatggaaaagaggtaacaatatacagtgcttttcttttttccttttttttttttttttttgagacagagtttcgctcttgttgcccaggctggagtgcaatggtgccacctcggctcaccacaaccttcgcctcccaggttcaagtgattctcctgcctcagcctcccgagtagctgggattacaggcatgcgccaccacgcccagctaattttgtttttttagtagagacggggtttctccatgttgatcaggctggtctcgaactcctgacctcaggtgatctgtccgcctcagcctcccaaactgctaggattacaggtgtgagccaccatgcccggcctacagcgcttttcttgaaacactcttgagagcatgaaaatagttgaaaagatacatggagcacttaccaaggagcccagcatatagtaattacttagtataacaagctactattattactgttattgtcacattgcaatcactggtaaacaaattgttgtcattgctattggatctactctccaggagtgaactttcaggctgacagaatatgtggatatctttggaccaagagtttagagattttaaggtacctgaagcttggggccttggctcacaaccttgtcccctacctcctctacaaggcccaagtcataccttgtacacagtagaggtttggccagtgttgttgactaggcgtttggcaatggggcatattttgttttatcttcccagggtcctccttgtttgttgactgagtggaagacttaatgagttaagtatttaaagtgggtaggagcatgcctggcacacagtaggtgcttgacatgggtttgaatgattaaacatggcattgtgggaactctggagtttttccaggatggccccactcactccttgtttgctctgtggcctcaagcctcttgcccaagctctgcctgttgcctcatatgttgaagaaagataacacccgccttgcctccctcatgggctagcagggaggcccaaagagatgatagatgaaaaagcactttgagaactataaatatttggtcttgttgctactccttgactaaagtcacagccatagctgtgtcattcattcattcattcagtcaacaagcattttttgagtagaagcaatatcttatcacttaactggcttcatgaatttggacaagttacttccctctgtaaacctgaagatctataaagtggaagtaatactcatttcagagggttgttgggagaaagactaaacgaggtgctctgagcttactgaggataaaaactatgtcttattcactcttaacagctactgctgggcctagtacttggtggctgagtgtttagtgactggattaacaaacattcctaataattaatggtacatgtaaagtgcacttacacattgcctagtgcagagtaaaagctcagcaaatgctgagtctttcccttttctctatgaggcttgaggtgccttgatttagccatgggttgccttctgcagtcaaagtaccaggcaaggccagactctgaatatgactcagatgggaagtagaagtgagtattaatgcctggctccaggttgtccttacctgcctacgctggacttcagtgcgggagttctgaactatcgaggatcagtgctgcttaaacataaaatccagtgtactatggttctcaccccatgcttatctctgatccagaacaactgcctcttgttctacccactctccatctgctactcagaagaatttccccttgctcacagcacccatgttcagttggagccctaggggttaccatgtcagggaagtcccagggagtcactcagaaatagcctttggggcaaggtccagagaaggagcccaattctaaggctcagtgtctcctgggactgggtcaagcagcaggtgcatacatgagacccagggctggtggctgagtgatgaaactgagagatgtgtagggccagacaagaagtcaacctagaggaaactgcctgcttgttcatgcaggtgtttggacacctgggggaactttctgggtctgatttagtggtgctagtgtaggttccatattagtatcccaagccccagtgagggaaacctttgggactcccaagcaaagcctgtagttggcacccagcacctttaaacccttctcagatccctttagggtgaaagagaggccccctcctctgggttctacagcatctacagctggaaactccagggacaatgacataataaccatagctccctttataaagtctctgctgtgtgttaggcactgtgctggggctctttatgaaaaggggatcattttgttaattggaagtatgggctctggaatcagacagagttgagtttgaatctggtctctattacatatcagctgttagattttgggtgcattcctttccatttctgagcctcagtccccctatctgaaaaatggggataataataatacttcatagggtttttgtaaggatttaagagccttttgtaagaatgtatgtaagatcatatggtgcaggtattaaggtaattttagtaatatttaacaatgagcacttgcacttaagtgttttatatgagatagttcattgaattctcaaaatagtaccactcaggtaggttctcttattattcctatagagaagttaagaaagttgttcaaagatgcacagcgagtaagtggtaaaaccatgatttgaacccaggtagtctggctccaaagccaacttgtcctacctggataaggaaggccctagtaaatgttgctgttataactattgtatccagcattgtagttgtctgtagtttttggtctatccactgaattctgagctcagtgaagactagaaacccatttaatcaccttgcacccccagagaccaacataatactcataaaactcattaatatttgcttaatggctgagaatattctctttctttagtaatcaatcagtaactctttatcgaccagttcctgtaggctagctttgaactaaatcctaggaggaatgcaaagtacagctatgcctgtgtaaacggaagattgggtgtgtgcgttgggggggtgcattccagagagcactgtgtcattggcagaaacttccacacaggaggcagaaacaatacaggtggtttgaggatgttttccaagatgggattcccacccctccctgagggagtcacttcctccatctcctgcagaacaaggtgacacagattccctactccggccaagggcaaggaaccactctaagctcttcagtcactctaatccagaaactgtgtctttatggctcaggcaaccagttcatggcagcctagaatgacagggaaaaagctgggaagggaccttagaaaatcactcttgcccaatactccagccaaagtggtcttttaaaaaccaagttcaggctgggcgcggtggctcatgcctgtaatctcagcactttgggaggccgaggtgggtggatcatcaggtcgggagttcaagaccagcctggctaaggtggtggaaaccccgtctctgctaaaaatacaaaaattagccgggtgtggtgcacgcctgtaatcccagctactcaggaggctgaggcagaagaatcgcttgaacctgggaggcataggttgcagtgagctgagatcgcgccactgcactccagcctaggtgacagggagagactccgtctcaaaaaaaaaaaaaaaaaggtttagggccgggtgcagtggctcatgcctgtaatcccagcactttgggaggccaagccgagtggatcaactaaggtcaggagttcgataccagcctgaccaatatggcgaaaccccgtctctactaaaattacaaaaattagccaggtgtggtggcgtgggcctatagtcccggctacttgggaggctgaggcaggagaatcgcttgaacctgggaggcagaggttgcaatgagccaagatcgcaccactgcactccagcctgggtgacagagcaatactcgtctcaaaaaaaaaaaaaaaacaagttcagggctgggctcagtggctcatgcctataatcccagcactttgggaggccaagacaggcgaatcacctgagatcaggagttccagaccagcctggccaacacagtgaaaccccatctctactgaaaataaaaaaattagccgggtgtggtggtgcatgactgtattctcagctactcgggaggctgaggcaggagaatcacttgaacccaggaggcggaggttgcagtgagccgagattgcaccactgcacgccagcctgggcaacagagtgagactcttgtctcaaaaaaaaaaaaaaacaaccaccaagtttaggccaggcatggtggctcacacctgtaatcccagcattttgggaggccaaagcaggtggatcacctgaggtcaggagttcgagaccagcctggccaacatgatgcaaccccgtctctactaaaaatacaaaaaattagccaggagcagtggctcacatctgtaatcccagcacattgggacaccaaggcgggtgatcacctgaggtaatgagttcgagaccagcctgaccaacgtggtaaaaccccatctctactaaaaatacaaaattagccgggcatggtggctcatgcctgtgatgccagctacctgggaggctgaggcaggagaatcacttgaacccaggaggtggaggttgcagtgagccaagattgcaccattgcactccagcctgggcaacaagagcaaaactctgtctcaaaaaatttaataaaataaaaaccaagttcagatcttattgcatttttgtttacaaccctccaagtggtcttccactgtagttagaataaaacccagacttttttttttttttttgagatggagtcttgccctgtcgcccaggctggagtgcagtaagtgtcatttcggctcactgcaacctccgcctcccgggttcaagcggttctcctgcctcaaactcctgagtagctgggattaaaggtgcccactggccgggcacgatggctcacccctgtaatcccagcactttgggaggctgaggcgggtggatcacctgaggttgggggttcgagaccagcctgaccaacatggagaaacccgtctctactaaaaatacaaaattagccaggcttggtggcacatgcctgtaatctcagctactcaggaggctgaggcaggagaatcacttgaacctgggaggcggaggttgtgttgagccaagatcgcaccattgcactccaccctgggcaacaagagcaaaactccatctcaaaaaataaaaataaaaaaataaaggcacctgccatcacgcccagctaatttttgtatttttagtagagatggggtttcaccatgatgtccaggctggtctcgaactcctgacctcgtgatctgcccacctcagcctcccaaagtgctgggattacaggtgtgatccactgcacccagcaaaacccagacttcttaccaacctctgaggcctgtgtgatctggtcctggctgcccctccatcattctgtctctcccttactccactcaagccgcatgggttccttgctgcttctggatcctggcataacttcttcctgcccaagggcctttgtagttgctcttttctctgcctgaaatgttctgcccctagtatttcctttctgaggcctacatttggttcagcttgctggtcacctcctctgagagactttccttgaccttcagtttaaagtagccatgctatttctaaatccctctccagtcttcttgtagttttgtcatagcaacagcctctacctggaattttctttttgtttgtgtacttgtttttgtctgtctcttctattagaatataagccccatgattatagggcgtttggtttgttcatcattgtatctccagtgtctgcagctgttctttgcaggtagtaaacattcagtgaatactttttgaataaattattaaacaaatgaacaaaacctaagacatgaaaaaactgaggcccagagaagagaagctaatgagaattaatagtgttctttcatcctacttttgaatgctcattaagtgccaagcactgtattcagtgatttacatgcattatttttgccacttattcttaattgttataatgagttgtttggaacatcattttttatatataccactgtaccacttaaaagaaaactggaccaatcttattttttattggaaccttgctctgttttacaaagagttggaagcaacttaggaaaattcatacaaccaaaaggataatgtagctaagggagtcgggtgaaaggaaaatatgggtaagaagacgagccaaaagtaaaattagttcacacaaatgtatgttacaaaagtcctttgaactgagcagtttttatgccattctttataactaaatattgcccagattcatttaaaatgatggttttttaaaaatctaactacaggccgggcgtggtggctcacgcctgtaatcccagcactttgggagggcaaggtgggcagatcatgaggtcaggagatcaagaccgtcttggccaacatggtgaaaccctgtctctgctaaaatacaaaaaattagccaggtgtggtggcgcgtgcctgtaatcccagctactcaggaggctgaggcaggagaatcgcttgaacccaggaggcggaggttgcagtgagctgagatcacaccactgcactccggcctggcgacagagcaagactccgtctccaaaaaaaaaaaatctaattacatagatgaccttgggattgtcccagactgcacctaatagtctaggatttgctggctcccttcctgcctcatcagctgggctcctggattgaggcaacacgatctcctctttttgccaaaggggctggtccagcagggaggagcctagacccctctccagtcctctctggacctagctaactttgtttcaaggagtcttttctgtagaaggtttattaattgagatattgccattggaaacccagttctgctctcaagatacttccagttgaattagagagaaaagacataatatacatgaaaggagatcttgtaaaagccaacaataaatgctaaatgccaaatgagggaaggacttcacagaagaggtgaggtttacaccgagccttaccacaaagcggagaaaagaggggctgtagctcccagtaggagagtcaatgtgggttaagatttgcaggctgagaccaactctcaagaagagacccgtgggcagtggcagtcaaattttaggcatatgtggaggggtctctttcattaggtaataaagccaaaaaggtcagctagaaccaggtttgtaggatcttcaagtgccagggggaggattccaaggccctccttggcagccctggtatcccaatagataggtcgtgcccagggactaatgcccatgctggccactggttgggctgctgattcccaggtggcaatggcagcttctgaaatgggagccagagccttcaactaatagtgaggggaggagttaagtgtggggccattgtcagtttagcttttggccatcccaggtgctattcatttggcgattcggcaaatgtttattgagcaccaactatgtgccaggccctgtgctacatgctgaagatgctaagataaacaagataaggtcaaggacattgctcttgtagaactcttactttaatgggagagacagctagcccgagaaacaaacaagattatttcagggattgggttaaatgctgtacagaaaatgaaactgagtaatggaatatctaggaagcaactatatgcatgggccaactcagttactcagctttgacactgttgggtctagttggtacctttgtttccttttgtgttatagatggaggtgatctttcaaatctcctctgcagagatccaatgggataatggttgactaccatttattgagcacctagcccatgtcaggtactctacatgcattttctcatttaattccctcacctagactgtgtgctaaatggtccattagccctactttcttttccagtaaagaaactaaggtttggataagtgaagttgcatgccagggtcctgcagctttacgtggtgaatcctggatttggacctagattgggctggctctaaagccaggcttctttcccctgctccactcttggaataaatgaaggattgttggttcaggatatgcagaaagctgcttagcaaaaggagagttggagaagcatcttggtttgagggtcttgaaggacacctactgtactcccagctgagaggactctttctcctcatcttcaggaggatgcctccagagcctggggttactgtaggcctttgccagaggcatgttcggacttagccagctgagtatcccctgtttcctgcttttaccatctcagctgctggtcaggaggtttgggaaggtgacatcatctagctgaatcagctgctgcttctagatacattactggaactgaaagtcattaccccttccttcctgctctgcaagtctcttcagaatgaggctggagtatgggtgttccacctgtctgcagggtcatgactggaatggtacttgctgcttttaaagagctaaaaggtttttaaaagcttgttcatggaaaaagctttcctcaaggcttctcaagctaagggaacagagcgtccttgagaggcaggaggattcacaggaaggccctccccgactccctcttgtccacctacatttagccatatgacccttctgatctcctttgcctaagtccgaggcttaggcctagcactgtaggatgggtaaacaaaacgttatttgtggactttttgaccttaagacttttagagtctggtcaaggggacaaaaaaaaactgcttacatttcagagcagaccagccaccacactattggagatatattggagatctccccttgactcactaattgaaaagcaaaaaagggcaggtgtggtggctcatgcctgtaatctgagcactttaggaggctgaggcaggcagattgcttgagcttaggagtttgagaccagcctgggcaacatggcgaaactctgtctctacaaaaaaatacaaaaattagccgggtgtggtgtttcgcacctgtattcccagctactcgggaggctgagatgggagaaacacttgagtccaggaggtcaaggttgcagtgagccatgttcacaccactataccccagcctaggtgacaaagcgagaccgtctccaaaaaaaaaaagaaggaaaatcgactgggtccagtagctcatgcctgtaatcccaaaactttgggagtctgaggtgggaggatcacttgagcccaggaattcaacatcagcctgagcagtacagtgagacctccatctctacaaaaaatttgtcaggcatggtggcacatgccaataatcttggctactcaggaggctaaggtgggaggatcacttgagcctgggagttcatggctgcagtgagctatgaacacatctcacagaactccaacctgggcgacagagcaaaatcctgtctcagaaaaaagagtcattggagggttttgaaccaagaaatgacagtccgacatacatttttaaaggatcaccaggctgggcacgatggttcacgcctgtcatcccagcactttgggaggccgaggcaggcagatcacttgaggtcagaagtttaagactagcctggccaacatggtgaaaccccatctctactaaaaatacaaaaattagccaggcatgatggcgtgtgcctatcatcccagttactcaggaggctgaggcaggaaaactgcttgagcccgggaggtggagattgcagtgagctgagattgtgccactgcactccagcctgggcaacaaagcgagactccgtctcaaaaaaaaaaaaacagcaacagcacatgctgaggattctgttcagtggtttccacttatcagtatagcacctcattaatcctcccaacagttttatgaggtatgctctagtggtatccacattctacagagaagaaaactgagactttgagaggtaaagtcacctgttaggccgggcacagtggctcacgcctgtaatcccagcactttgggaggatgaggtgggcagatcatgaggtcaggagtttgagaccatcctggctaacacggtgaaaccccgtctctactaaaaatacaaaaaattagccgggcgtggtggcgggcacctgcagtcccagctacttgggaggctaaggcaggagaatggcatgaacccgggaggtggaggttgcagtgagtcaagatcgtgccactgcactccagcctgggtgacagagcgagactccgtctaaaaaaaaaaaaaagaaagtcacctgttaaagattacacagcaaactgccagcatccaaagcctgtcctcttccctcttccatttgaataggctccttccagccaacattcatgtatattctatccaggctccaaagtccagtaccaagccagtcttttccaggaagccttccccaagcttatctaatggcctgtccctctattgagagctgatctacagagctaccatccattgagcactccatgggtgctaagtatactgctgaatgatttaaatatgttatctcatgtaatattccaaggagccatatgccctgtgacatccattttacatgtgaaaatagtgaagctaaaatataggcacatgccatcatgcctagctaattttttttttttttttttttttgagatagagtcttgctctgttgcccaggctggagtggcttgatctcggctcactgcagcctccgcctcctggattcaagtgattctcctgcctcagcctcccgagtagctgggattacagtcacccaccaccatgcccagctaatttttgtatttttggtagagacagagtttgaccacgttggccaggctcgtctcgaactcctgacctcagatgatccacccgcctcggcttcccaaagtgctaggattacaggtgtgagccaccacacccggccgactagcttatttttaaatttttagtagagacaaggtctcactgtgttgtccagactggtctctaactcctgggctcaagcagtcctcccaccttgacgtcccaaagtgctgcgattacaggcgttagccagcagtgtctggcctctaatgacactttattcatgagaataaatgccaaaatgtatacagtgcatgggcatatgactgggagaccttggtacgccagcagtggcaaggacagtcacctagaagtaagtgccctagagtacaccgaacctgggtttcaactgcccaggcttactccttctcaaaaccagcccttttccagctttgtgtccctgtgtgtttgcatgggtgcaggcacaagtagatgacacagtggtgatgctatgcacccaggacatttcataatagggaaggacgttgaccgctgccatggggtaccaaaggtcatcagggctgtgaaagccaaggacactcaggcagccttactcccctttgagtctgagtcatttcctgagggatattggtcattcattcatttgttcattaacaagtatttattgcattcctgtcatatatcagggactgagctaaaggttggacatacagtctgaacgaaccaaagtccctattctcacccagtggacattccaaggtgggtgacagattttaagtaaattaacatgtcagggctaggcatggtggctctcgcctttaattctagcactttgggaagctgaagtgggagtattgcttgagcccaggagttcgagaccaacctgggcaacatagtgacaacccacctctaaaaaataaataacatgtgaggtagtatttagtgatatagggaaaaataaagcagagaaaagggattagggatgggaaaaggaagggtagggtagttaggaaggcctctctgataaagtgacattggatctgaatgcagtgagggcatgagctgtgcggatatatgggggaatagtgttgtaggcatagagaacagcaagccgtaaaacaaaaaaaagccagatgcagtggctcacgcctataatcccaacactttgggaggccaaggcaggaggatcacttgatgctgagagtttgagatcagccagagcgacaaagccagagtttagttgggcatagtggtgcatgtctgtagtcctagctagctactcgggacactgaggcaggaagatggcttaaatccaggagtttgaggctgcagtgagctatgatcctgtccctccactctagtctggctgacagagcaagaccttgtttcaaaaaaattaaaaaataaagcaagtacaaaaaaagactctccaacatatttaaagtacagcaagttggccagtatggccagagtagagtaagccagtggtaggaatcaggtctgagacgtcaccaggggccaggtcttgtagggccacatgggaccttgctttaagggcagtggaaaggcatggaggatttttaagcaaagaagtgacaggttttagaaggatctctctgatgtggagaacaaactctatgggtaagagcgggagcaggagaccagtgagaagccaggtgggtgataacagcagtttataccagggtggatgggtggtggaagtggcgagcagtggtcagagcttcaatacaatttgaaggttggaccaactggatttgctgatgtttgctggataagaggtgagagagaaaggagtccaggtttttggcttaagaaactggaaagtccttactgccatttaataaggggaagatgccttggctgatagtgatttcctgctagggctgtggagttgaactgcctgcattcaagtcctagtttgcttactgttttgtttttgttgttgttttgagatgaggtctcactatgttgcctgtgcttgtctcgaactcctgggctcaagtgatcctcccgcctctatcttcctgggattataggtacgccaccaggccctgcttactgtttgactttgagcaagtgtttgactttgccaagccttagtttccttcaatgtaagcctactgtctagatgataggcagttgggtgctgtgaaaactaaatgagggtaatttgtatgaagggcttaggacaatgcctggcatatggtaaaccttcagtaagagttagctctaatccttattactattgttggaagacaagaagtcccagggcctcaaggtcctctggaaagcaggcagcaggtcacactccacctccaccaccccctcaaggagcccgccctccaagaggcagctcagacaccatctgtccagcagagaaaagccacagggagacagctttcggggagcattagatagatgagcccttcccaagaaacctaatctcattctcagcaggtgctaatcccaccaccctcccttggtatctgagcccagcccacccacttccttccccacccccatcctgtgtcctagaccctcttccccttctcaccagctccaagctgccaccagcaaacttccttaccagatggaggggctctgacagaagcccaccacccatctgactgggcccagcctctcacatgtatcaggtcaccaagggctacaggtgccacctgtccagaagccccccctacaggtgccagttcctgggcgtggtgcttgatccaggctggagccagctggagccaggaactcccactgtgccccagctgctgcctgccctcccacccacaggcagagaaacaggcttaacccttcggacactgcatatgttgagttagttgttacagttctggctcagagtattgcactgtttcagtacactttttttttttaaagaaatttatcataaatacaacagagaatatctaatgcatatgtacaattttaaaaataggaaaatcatcacttgtaaactcatcacccagattaattaataatcaaacatatgtttgccttgcatgatggcttatgcctgtaatcccagcacttgggaggctgaggtaggaggaatgcttgaggccagaagtttgagactagcctgggcaacatagtgagaccaccatctctacaaaaactaaaattaaaaaatagctgggcgtggtggtgcacgcctataactccagctactcagaaggttgagtcggggatcacctgagcccaggagtttaaggctgcagtaagctatgatcgcgccactgttctccagtgtgggcaacagagggagaccttgtctctaaaaacaaacaaaaataaacgtgagtaccttagagccccctgtgtaccccctccccaatcacagctaccccaccatccatactcctgagttctgtgttttcttttgtgatatcttaccatgtcaaccaggctagagtgcagtggcatgatcatacctcacttcagcctcaaacctctgggctcaagtgatcctcctgcctcagcctgccaagtagctaattttttaattattattattattttttttagagatgggatctcactatgttgcctgggctggtctagaactcctggcttcaagcgatcctcctacctcagcttctcaaagcactgggattacaggtgtgagccaccacacctggctacctttttttttttttttttttaagttttactatatatatataggtatatattcctaaacaatataggatattcttctacatgcttttttttgtttttgtttttgttttttttttttgagacggtcccactttctcgcccaggctggagtgctatggtgcgacctcagctcactgcaacctccgcctcctgggttcaagcggttcttctgcctcagtctcccgagtagctggactacaggcgcacgccaccacacctgactaattttttttttttaagaccgagtctcactctgtcgcccaggctgtagtgcagtgtggtgcgatcttggcttactgcaacctctgccacccgggttaaagtgattctcttgcctcagactccctagtagatgggattacaggcacctgccactgcgcctggctaatttttgtagttttagtagagatggggtttcaccatcttggccaggctggtcttgaactcctgacctcgtgatccaccagcctcggcctcccaaagtgctgagattacagctgtgagccacggcgcccagccctaagttttgtattattagtagagatggggtttcaccacattggccaggctggtctcaaactcctgacctcgtgatctgcctgcctcagcctcccaaagtgctgggattacaggcgtgagccactgcgcccagcctgtgcattcttttaaacttcatttaggtattatgctgtgtttatcatctgcagtttccttttttcattcaaggttgagatccatccatgttacttgcatagcataatttgttcattttcgtatccatttatatgatcatgtctcaagctgtgtatccattctgctgtcagtggttatttgggttgtccccttgtttttgctgtttcagacaatgctgttatgaaaactgtttgtgtctcctgcacatgcacatgttcaagagtttctcccaggcagtggttcccaaactttagctgcccatcagaatcacctggaaggtttgttaaacctcagattgctgggctccacccccaaagtgtttgattgtgtatgtcagggttggggccctcagaatttgcacttctaacaacttctcagctgatgctgccactcttggtcctgggacctcactgagaatcattgttgtagggtttacacagaagtggaattgcttgatcagaaggtaatggcagattgttttcctgtgtttgtgtgaatttacacagccaccaacagcatatgggttttccattactttacctctttgttaatacttgatatggtcagacttaaatttttatggagctggtgggtgtgagatggtatcttgcggttttaatttgcatttctcagattacaagtggggctgtgaatcttttcttacatctgttggccattcatgtttcctctttgtaaaatgttcaagtccttgctccatttccttttgatttgactttttcttatgggtttgtaggcttttaaaatgtattttgaatactaatactttgtctatgcatgttacaaatatagtctttcagttcttctgcctcagcctcttgagtagctgggattaatttgttcgccgggcgccaccacacccagcctgtttattttattttattttattttattttattttattttattttattttttattttgagatagagtctcgctctgtcgcccaggctggagtacagtggcacggtcttggctcattgcaacctccgcctcccaggttcaaatgattctcctgcctcagcctttcaagaagctggaattacaggcatgcactaccacacccagctaatttttgtatttttagtagagacggagtttcaacatgttggccaggctggtctccaactcctgacctcaagtgagcctccatgcctggcctccatagggtgttaaaggctgtaaatttgaattatttatgacttaagttatacctagagcttattgtatatactgtattaatatttcttttttttttttttttttttttttttttttttttttgagacagagtctcgccctgttgcccaggctggagtgcaatggcatgatctcggctcactgcaacctctgcctcccgggttcaagcgattctcctgcctcagcctcccaagttagctgggattacaggcatatgtcaccatgcctggctaattttttttatatttttagtagagacggggtttcaccatgttggccaggctggtctcaaatgcctgacctcaggtgagccacccacctcggcctcccaaagtgctgggattacaggcctgagccaccgtgcctggcctactgtattaatatctcataatgaacaaaggtaccctctttgggaaaaagttggggctttttttccttttttcttttttaacttttcaattgattctcaaagccagcatgtgggagagagtttatcaaaacagccaggcatcatggcgcacgcctgtaatcccagctccttgggaagctgagacatgagaattgcttgaacccaggagacggaggttgcagtgagctgagatcatgccattgcattccagcctgggcaacagagtgagactctgtctgcaaaaaaaaaaaaaatacatactgacctgtgtgtgggatttgcttcaaaatactactggagtgagagatagtggttggggaacagatgaaatcagattggcaccaagttggtacttgttgaagttgaatgatgggttcgttttattctgtctacttttgtacatgattaaatattatcataagaataagtttaaaattggccaggtgcagtgactcacacctgtaatcccagcagtttgggaggctgaggtggaaggatggcttgagcccaggagttggagaccagcctggacaacatagtgagaccctgtgtctctcaaaaaaaaaaaattagtcatttgcagtggtacacacctgtagtcctagcttcctagctacttgggaagctaaaataggagaatctcttcagtccgggaggttgaagctgcactgagtcatgattatgccactgcactccagcctggatgagagtgagaccctgtcacagggggaaaaaaaaagttaaaaatatccaaggactatttccagggctacttgtgaggtagcacatcttttctttttttcttttttgagacagagtttcgctcttgttgcccaggctggagtgcaatagcgcgatctccagctcaccgcaacctccgcctcctgggttcaagcaattctcctgcctcagcctcccgagcagctgggattacaggcatgtgccaccacacccagctaattttttgtatttttagcagagacaggatttctccatgttggtcagggtggtcttgaactcccaacctcaagtgatccgcccgcctcagcctcccaaagtgctgggattacaggcgtgcgccaccgcgcctggcagaacatcttttcttaacgttttgttagccatttgtattcttcagagccaatttagtctccatctactttcaggagttcctgataaagtggtcttagcaggcatggaagagactgattttaaagaaaacaggagagggagtggtaaggaaagactggggaggggattttcaggcggttgccagcccttctcctagagcctgactactactgcctctaggattaagtttcctaccttcccttgtttcttccaggaccaccatgggataatttttattttctttctttctttttttttttcttttttttgtagagacgggatctcactatgtctcccaggctggtttcgaactcctggtctcaagcaatccacccgcctcagcctcctgaagtgttagtaggattacaggcataagccactgcacccagctgtctttcttccttccctcccctcccctgccctccccctccccttccctccctttcccttcccctttcttcctttccttttcttctttaattatagagacagggtcttgccacgttgcccaggctagtcctgaactcctggcctcaagcagtcctcctgcctcggcttcccaaagtgctgagattacaggcatgagccactgtgtccagccaatttttattttaatggtattcttctttccctattattttacctggacagacttaacccagaggatagaggaacctcatcatggatcctggtccgcttttagcttaacagcatccaaagacaaagggtcagagatggtagcaaccctagtgtggttgattacacagtagtggtgttattttgttgtcataggatgcaaatatcaaagttgtatctcttaagatctttctgtgtcagtacataaaagctttctcagtctttttaatgctgcatagtattctacacagggcactattctatactttaaccagttcccattggtagacacatttttttccagtcttttgcagttataatagtgacactcaatgaatagccctgtatatttgtcatttggcccatatatgaatacagtatatctgggggggatgaatccctaaaagtggaattactggggccaagggtatgtgtacttgggattttaatagggttagttagcctgggcccacagcagtgggtaccagtttacaggagaatcttttttcttaacacccttccacccaagtggagagtttggttcagcacatttctttttctttttctttcttttcttttcttttctttttcttttctttcttttttttttttttttggagacagagtcttgctctgtcacccaggctggaatgcagtggcacgatcttggctcactgcaacctccacctcctgggtttaagcagttcttctgcctcagcctcccaagtagctgggactacaggtgcccaccaccttgctgggctaatttttgtatttttagtagagacagggttttgctatgttcgccaggctggtctcaaactccagacttcaggtgatccacccacctcagcctatcaaattgctgggatttacaggtgtgagccaccgcgccggccatcagcacatttcttgagtgccttcctgtacctggccctggatataagataaacactttcatgtatcaagtgaaattgttactatttgccaggcaccagcacattatctgataatcctcataactactcaaagaggaaggcttttagatgagataagtgaagctcagaagggttaaatagggtgccatggtcatggtccagctattaagtggcagagctaggattaagcccaggtttcaatcctctgatgcctgtgctcttacagtacacctttacctgcctctcaggaggaagaacatatggtcttattgtctaatacagataaggaatcaggctcagagagggtaactggccacaaaacagccagcctggaagctatgaggaacccacatatgtctgatcagaggtctctggtctacactgagctgcctgcctccctcccggggaaagagtttgagaattttcttttttttttttttttttttgagacagagtctctttctgtcgccaagctggaggagtggagtggcaatcttggctcactgcaacctccgactcccgggttcaagcgattctcctgcctcagcctcctgagtagctgggattacaggcgcgtgccaccacacccggctatttttttttgtatttttagtagagaaggggtttcaccgtgtttgccagaatggtctcgatctcctgacctcgttatcctcctgcgttatcctccttcctttgggaggccgacgcctcccaaagtgctgggattacaggcgtgagccaccgcgcccgaccgagaattttctccgttcagagcttcacttgctatagagagcctcaagtcactggttctcagtgtgcatctattggccatcagagggtcctttagggatgacccatctgtgcttaatttactaatgacagtatagttgctgctatttattgagtgcctgccatgtgcaagatgctgtaaggtacagtgtagtttgttttgttttgttttgtttttgtagagatggaggtcttgttgtcttgaccaggttggtctcaaactcctgacttcatatgatcctccctcctggacctcccaaagttctgggattacaggtgtgagccaccagactcggccagtgtagtatttttaatcttcacaataatccttcttgggaaacatgttattgtcctcattgtccagattagaaaactgagtgtaaagtaagttaaattatagtcctaaggttgaatgctaataaagacagaatacaagtccaatatattggactcaaaagccctcacttaactatggtctccatgggcttcccttggctctctctgcctttttttattttttcttattgcttgaggccctttctggaaggtaagtctggattatctacttcacactgttttagagaagacttgtggtttccatttaccccttactccctccgctccatggcctttcagggagaacactgtgggtatcatgctgggtggcctggagggtccaagtaacaggaatctagaaggatggaccagatgtgaacaaaagaaagcctgagtaggacacaaaacagagaagtggggctgtaacatctctaagatattacagcttgctacttccactctctttgcaaatgtggtgaaacccaggctggagtcataaaataatagcataggatcattaactaaagtttgtctagtgcttccttgtgttcacacattatctcattgaacctctgacgatgctaggaggaggtaaatagggttttcctcttaccttgggtgaactgaggtcttctgactaagtctcaggtcctttctaccatttgtgctgcatccacatctctactgggaagaacacaggctctgcagtcagacacacctgggtttgaaccacctccattttgtgtgtgttggatcttgagcaagtgaattcacctttgtgaccatccatgtcttcataaaataagaattttaaacacacatgagggcctggcatatacaaaacattgaataaatagcagtgatctttttattgacatcagaagggggttggggacccagaggctatttgggctcctatggcatagctcttggaacgtgttaattttcaaggacaggggtttgcaagtcagagcaatgtcaagtaaagaacaggttctttgggaggccaggatatgctaatgggtgaacaatgtaagggaggcataataataatgccaaaggcctcctagagtacctgttcactgcacttttgggtctttggtttatatatgaagaaaatgaggtgcccccagaggggaagtgggttgccattgttacacagtaagttaataaatggcattgctgagattagaactcagtcttttgtctgccaagaaagcttacttttcccttacactccactgctcccttgaggggaaaaaaaaagggcccggagataggatcttagtgctttggaactggagagaaagccttagagatcatctgatccatcctccacacttttcagatgagaaaagtgaggcccgtggtgcttaattgacaggaccatagccaaatagagccaccacaaagcaggagtaagctcacgtttcttgaacctgaccatgtggaactttcaaattgccttttttctgtgcggaactagagcctcactgaaaataccagtggtttacaataagaacagctgtttagtttggggaacatttttccaaatagaatcttctttttctctctttctcaattctttttttttttttgagatggagtcttgctctgtcactcaggctggagtgcagtggcacgatctcagctcactgcaagctccgcctcctgggttcacgccattctcctgcctaagcctcccgagtaggtgggactacagacacccgccaccacgcctggctaattttttgtatttttagtagacggggtttcaccgtgttagccaggatggtcttgatctcctgacttcgtgatccacccacctcggcttcccaaagtgctgggattacaggcgtgagccaccacgcctggctgtctttctcaattcttaataaaaatatactagaagaagaaaaagctttaatggaggaccttggtagaaagcaggtaaaaattatatagagtctctaaaatctagggaggtccccagagccagtaaatttagaggccagccttctcgcctatcccagcaagcttatcacttgtcttgccctattcacaacaggccttcagaaggcccagccttcccttggcagctgcatgtggtgaacaccaacggaaatccctggtatttttctttgtatgcaaccaaccgtggagatgtaggtcaggcattgctggcttggcagttacaacatctctagcttcacccctgcacctgtagccgtgttcactaagcccctcaaagatgggaaatggatggtcccttcttaatagggtttggatccccgagggctcatatgggtggagtgggtttgggaggagacagaccatccggaatgtggagatgagaagggtagatctggctcttccctccttaatgtctgatgtctggtgttactatagctggattggtggtgcttctgctcagctcaccttagagtaatcatcactgacggaggagactggggaggtcccatccttcccctgggctcagctgggtccccagacctacacctgaaccccacgcctgtctggtgtttacggattgaagctgccaccctttgggacctatcctgttttcatttctgctctcagctctctggtctctgtggacctcacttacaggtttgtacgtgcctgtcacccacggtgcagccccatgaggctctcccagcctggcacactcatgcctctttggcctttgttctcttcaggaaaactgctagctctatgccttgctagggagggcttttctggcccctcagataggttcttttggtccaacctagctatacctttcctgagattcagtctctttgtccacaccctgggggacagggctgtggttccaaggcatgttggggggtacctgtgggccattctggactggcttccggtcagctggctgactctgccctgggtctcaaatatctcctctgtaaaggtgttagaccaggatcttcaaggtaacttagaggtgatatgcagatggacattttctgttttaatagtcagtgtattttatgttgatttccatctggggcaaatgatactctttataggaagaataataagttgccttttcattgcatttatttatttagcaaatatttgctaagtgtctactatctgtcaaccactattctagctactggggatacctgccttcatgaagttcacattcttttttttttttttttttttttttttttttttttgaaaaggagtttcactcttgttgcccaggctggagtgcagtggcgcagcctcggctcactgcaacctctgactcccgggttcaagcgattcttttgcctcagcctcttgagtagctgggattacaggtgcccgccaccacacccagctaatttttgtatttttagtagagacggggtttcactgtgttggccaggctggtcttgaactcctgatctcaggtgatccacctgcctcgttctcccagagtgctgggattacaggcgtgagccactgcgccgggccatcatgaagtttacattctaagaggacagagagtgattaggtggccggtggtaggcagcttttggtatgtgtttgcctttttaataaaggataattaaggaaggcctctgaggagcaggcatatgagcagagatctgcatgatctgtctgagggaggaaaccatgtaacagtctatggaaaaaacattccagacataaggaacaagtgcagaggccaaagggtgggaatggtgtgcctggcatgtttgaggaagagcacgggagatcagtgtggctagaacagagtaagcagaggagaagtgattggaaaggaaagtttgtgtgagcagtggtgagacattttggttcttcctctgggtgagatgggaaggcagtggagggttttgagcagacaggaaactgactttgctgacccctctggctgccatgtggtgaaggaaccatggagtcgataagaagctgggagaccagtaaggaggctgttaggacaatacaggcaagaaatgatactggcttggaccaaataatagcagtggaggtggtgggaaatggtgggactctagataaatttggaatacagattcatcaggatatattgacagatgagtgttagaggggatttaaggatgagaaagatgcagaaagaacaggtttagggaataaattgagaattttcagtacatgtatttaaatttataaaaagtaagtaaattgatagaataatgttaagtaggccaggcacagtggctcacagctataatcccagcactttggggggccaaggcgagagaatagcttgagctcagtagttcaggaccagactgggcaacatagtgagaccttatctctacaaaaaaagaaaaagaaaaaaaaattagccaggcatggtgatgcacacctgtagtcccacctagtcgggaggctgaggcaggaggattgcttgagcctgggaggttgaggcctcagtgagccttgatcacacgattgcactctagcctgggcaacagagtgagaccctgtcttgaaaagaaaaatgttaagtaaataataacagaatcacatataaggtcaaagcagtgatggctgaaattgtggatagagtggaccaaatgtgtctgtgctgccttccagctctaaaatcctgcttcagtgattcagaccacatagtctcccattcacagagaacaagaacttgaagctcagcctagaataagcagataaagtgacaggagagcaatcctttggaccaggcctacctcctgttaatttggaaggacttgggaagttcttgcacatatactggccttctggcattaccttatttatttattcattcattcactcagtcagtcagtcagtcactgagcaccttctgcctagtaggccctggacaacggcagctctgatgcttcttctctcctaatataaagcaagctaccctgacccccgctcccactggagcctgtctactctgtggcctggcatatgcctggcggtaatgtgtgtgctgaaagtggaatagccacagcctaggcagagccctgccctccctttgctgcactgtctctgtccatctctgccttcctcatcttattgccatccacactttgaggcctggtgagcaaatgattttgcttccatgagagcagcagaaatagttgctttatctctttcttcatataggtcctcatagttatcaaactggaaagaaatccccaagggcctcttctctcgccttttatagatgggaaacagagggccaagagggcaggcaactcccacagtccacatctaattcatcagcaaatcctttcagctctacttttattgattgattgattgattaagaacagtatcttgctgtgtcttccaggctgaagtgcagtggcgcagtcatggctcactgcagcctcagcctcctgggctccagcagtcctcccacctcagcctccggaatagctggaacatgccatcacgcctggctactttgtgtcatttttttgtaaaaataggattttcccatgttgcccagactggtctgaaacttttggactcaagcagtcctctcacctcggcctcccaagtgctgggattgtagacatgagccgctacacctggcccagccttactttaaaaaataaattctgaaactgactgcttctcaccaacttccctggcaccattgtggctaagccactgtcatattttcctgattatctcaccagacccctggagatctccacccagcagccagacggacgctatttaacaccaaggtcaggtcatgtccttcccctgctcaaaaccctacagtgctttcccaggacaagcccaagtctttaaatggcctaccaggccccacacaatcgggcccttggctacctccagatctcatcaccaccagtctcctcacattcactggacttcagccacactggcatttttcctgttcctggagcacctcaagcgtgttcctgcctctgggcctttgcacttgttcccacagccttttctcagatctttgcagtgcctgtttcctcatttcattcaggtctctgatcaaattcacctccttaagaagttgtccctgaccatggattctaatcttaccttcttccatgtttctctgtaccccctttctcacatttattctttcttaatgcatcaccgtctgacatgtttattgcctgtctcttcccatttgattataaactcatacaggtacgaattttcattctatttagtcactgctttatccccagcgcttagtacagtgcctgactcttagtgggcacttaatgaagatttgttgaatgactgagtgtccaaagctagggaaggcagcctgtctgggccttcctacaactccataggtcagcctggcttacaaataggtcatgtcccatcttagaaaactcatctaatagcttcaccaaagctacgtggcatcacttttgtttccaagataaagatcagacagagggaggaactctctctgcaagtactgtccttgcagatctggcttaggggaaagtgggttcatcactgagtagcctcagcacactcttccctttctcacccctcaaggcacccagggaaccaggggggaatgctacttccatgtacttaaagtcatctctgacttcgaaggcctaagaatagcagattctcagtaaatattgggtaggtgaaagggtgaaggaaagaaggtcttagtaaaatctcttcatgtatcctgttgcactggtaaatttaacatgctgtgaagttgaatgccctcactagtaaccaggggcctcaggcaaagtctcatcacttcgctgaattttagtttcctcattggtaaaatgggaacagcacctacttgcaagattttgagaattcaaacagtaaatattagttcagcaaatactagctgttactttttgtttgtttatagctacaaataagagagacactatgagaagcacaaatggagccactgattttttagctataaaaaaacaggctgggtgcagtggctcatgcctataatcccagcactttgggaggctgaggcaggcagatcacttgaggccaggagtacgagaccagcctggccaacatagcgaaaccccatttccactaaaaatacaaaaattagcctgcaaaaatacaaaaattagtgtggtggcacatgcctataatcccagctactcaggaggctgaggcacaagaatcgcttgaacccaggaggcagaggttgcagtgagcagagatcacaccactgcactccagcctgggcgacagagacagagtgagacttcgtctcaattaataacgataataataacaacagcagcagcagcagctaacatttacagaacgcttaccatggaccattgaactctgctgctaggcctgtgaagtaagtacagctgttttcattttgcagccggaacaccaggcttggagggggaaagtgtcttgctccaggtcctgcaaccaggtagtcacagaactagggttggaagccacactgtctcactccagggtagggaggcctgagaccaggctgtgctctgtccctgtatgaagccttggaggtatcccttcacttcctctgggcctcagtttcttacctgctcaggatcgaaccacacatctctgtgacgctctgaaatttctggtggtccacaggccacatcaagtgggacagtgagttgcttccaggcctcctggtggtggtgctctgggtattgactgtgaacagcacacctctgggtgccccctccctcgacatcaggcaaagtaccctagccctcttctcaccatctcaggcatcttactgttctgcaccttaaaggggtaatggactggggcagaaatgaatagggtagaaaacaagaaggaacccactcccttgtctggtgcagatcaatgttggatgctgcagagaagagtatgaggctgacagtcagtggatgtgggttttgtttcccagttccatcacatcacagaatagaaggaaatgcaacaccgtgggtgccttcagccctgagtttttggttacatggggtgtgagcattcatctgtacagtggggagagaagggtgttgcagggatttgctcccttccccaaatcctccagagctgttgccttctgctgtggaattccaaacatttctgatcagataaaggtggctgaaaatacttgggacttgtctggactagttggaggcggtgctggggtgaagaggtcgaggccacaggagctagagcgtggaaagatctagccttgcccaggagtctgcctggtcatagatgtgcctattgctctcttcccctggaatcctgcaggttcagagcaatgcccagcgggctttgaggtggagaaggatcagactcctttgtggcaacaagttctcctacttcagaatgttgcttctcaatttacacactaattactggatcttttggatacccctgagagagagaaccctggtagtcactcatctgtctgcatgagttactttcattctccttatgctgtagccctagacggagccctttgagatgattcccacttcatttgacagttggggaaaggcccatactttcccagagtctcaggcaggggaaaggactcacctgcaaatcagcgatggaactgggaaacaaaatccacatccactgactgtcagcccagtactctcttccccacagcatccagcactgatctgcatcagacaagggagtcgccatagctttgggtggagaggaggaaggagaagctgctttggactatggagcacttggggtcaaagacctcagaaagaagtcctagtttttggagattgctaccccattcctgcctgttgcctcagcacagtgcaaaagatgccttttctagaactttcccataagcttcctgtcccctttccttatcctgagagaaagtgtctggagaatactggacaccttgcataatcacctgctatattggggcctctttctagttttgccaggcagtgaggaaagggatgaagagagtgggaactggcctttcttctcttccctcctctctgtccaacactcagccagactcttcagcaccttctctggacccagcactgggcaaggcctaggggacagagcccatggtcagatgggggaagaagtgagcagctaggctccttgagaaagtgacctgtggattaagacctcagagataagtgggacagagcttggtagaagcaccagtgtgggcaaaggtcctgagtctgaacagaacatggcatgtgaggaatgaagcagcctggccctaggtgaagctgagaaaaccctgcaggcccttgtaagccatagagaaggctccgagacacaagctgagccatggtctactagtaagaacaataaaccagacatttactcaaagttaactatgtgccatgcacaattctaagacctttacatgtattaatttgaatcctcatggtattcttttgaaataaggacattttgggccagatgcagtggctgacgcctgtaatctcagcactttggggggccgaggtgggtggatcatttgaggtcaggagtttgagaccagcctgaccaacatggtgaaatccagtctctactaaaaatacaaaaaaattagccaggcatggtggtgcatgcctgtagtcccaattacttgggaggctgaggcagaagaatcacttgaacgtgggaggcagaggttgcagtgagccaagattgtgccactgcactccagcctgggcgacagagtgagactctgtctcaaaaaaaaaaaaaaaaattaaataaggatttttttaatccgcattttacagatgaggtcaaaagcaaaatatcttaatctagtttgcaagacttattggttctctgcctgctctgtgctctggcagcccagcttggtagagaagtagaaattaattgcctttatccagatagcacttccatttcacaaatgagacaactgatacttggaggagagcaggagagcagcagcggagagagagcagaactaagaccagccagtcaagggagacagagggagacgagcatcagctccctgacagggaagagttttccaacggggctgtccgaagatgaaatgtcccacccaggaaggagggagctctccataagtgcataaggagagaatgccctcgagatgactaccaactcccatgggtgtggaccatcagaatgaaacagacccactgtgggacttcagcactccacccttctgaaccctgtctgtgaaatgggggtgttcgtggtgagcttgagtattacatggaaggttggatgggcatgctgtaaggtccctggagtctccgactctgttccaagggtgagtattggtttttctcaccctggacactgggagaagaatggagggctgtggccatctacttacgaaagaatagggagtcaccagggttgaaatgagagagttgagatgacgggaggcatcggaatcccaggggatgagcctatatgagcacatagcagccacccaggaacagttaaatgtttggactctggagacagactgcctgtattcaaatcccaactctaccacttgtggcctctgtgaccttgggagggtgatttatcctctctgcctctgtttcctcatctgtaagctggagagtaataacagcatgtactcggtgggattattgtgaggattaagcaaattctttacacacgaagcacttagcaccatgcctggtacttagtaaacatcagctgttttatctccatcggttccagggaaggaggttatgagcccccaaatgagcatctctgcccccagtaaatgcttttctgaattctctctctttgcccccaagcccatcaccctggttctgagccagagagatggagagcccacactcgcactgctaggcctgatagctttctcgattccccagcggaggtgttatctcctcccggcacaaccgcttccttttctgagaaatgcaagtgcatctgtcaggcacagcttcttagaactaatggtgggggaggaggtggaggaggagaggctggcagctgaattgaacaggtcagagttggaggaagataaacatgaagtttgttgtgaggataccaccaaatattccctatagcccagatggcttgagccctctatgacaccccctgatctcaccactactgctagggaggtcaaggcaggagaaactgaggctcagaagccaaaaggcttgctgtggcacccacccatacctgggccggctggactgaggtgttgaccccaacacagtcttgccacccctctctttgccctgcctccactgagctgcttctccaagttgcccacctccaggcctatgtttccgtgggggagaggagaaaggccatgttcttctcacatctcgggagccaacagctcccctgggaaaaccagaggaagtggattccaaccacaaacctcacttcttccgagtctccgcctgcaactccctgccaaaagagtgataaggcctctccgtttgccctacccccttcctaccatctcccagcgatcttctagcaaggccatgtttgtctattcagcacacatttatcagcctctccctcagggaaactgaggccaggagcataaggtgactctgcaggtgactcacagcctgccaatgcagggatgtgagaaggacagaacaaggtacagttctggtgtccctggcacttttcctggctgctagtagcctcttcctcttctccacctacctctttcctgaaataaccaagcaggaaggaagcaatgggcctgggccctccagagtcacccaagaggaaggaagggttcgtctggcacaggcatgcttgttcctcactgaagccaggacggaagggtttcactttccctcctggtcttcgtcacatccttttcctgtggcaccagttcccctcagctggcaggagccagtgcttattcattcagctgatggcctcaggctactttaccctccttgacagacccagggccatggccctggctcagaatatggggtttgctgccaaacatactggggcttaaaaatggcttccctttttttttttttttttttgagacggggtctcattctgtcgccctggctggagtgcagtggtgctgtcacagctcactgcagtttcaacctcccagcctcaagcaattctcccacttcagtctcctgagtagctgggactataggtgcatgccaacacactcagctaaatttctaagatttttcttatagagatgggggtcccaccatattgccctggctggtctcgaactcctgagctcaaacagtctgcccaccttgaactctcaaagatgctgggattacaggtgtgagccatcacagctagctgccacttatccactttagctaggtctcagtatctctgagcctcaggttacctggacttagaatgaaggccttcctcagccacagaagtacatggacctggcccatgattgtcctttagaaactgagcagagtactgcatcaacgttaggagtaaaggcactgaaccagattgctggtgtaggcatcccagttaggtcaccagctcactacatggccttgagcaattcacagatcatctgtgggccacatatccatcagctatatgggttaatggtagtacccactgacagagtgtagagacaactaatgaactaatctacaaaaaaaccaagaagagtaccttacagagtatgtgctcaggaagtgtgcgctgctgctgaagtcactaaggaagtcaggttttctgtgggtagagatagcagggtctaagatggcaagattggacatcagaatgagtgtgaatgaagtactatcttggatagattaaaagaaaaagaatggtgtgaggccagaactcagacagatcctactcttgccacttcctagatagggatcttgggtaaattctggagcctccattttcacatatgtaaaatggggctattgataaatgttatgaggatcaaatgaaagcattcatttgttcttctaaaatagatttatttagaatggcatctgctgtgttccaagtatagcacaccaggttctagagatacaggtgacagagccacacacagtcaagtgggggagacaggacaaaaaataatctctcaagtgaatatgatgattgtacatgtaattgggaaatatggcctagtgtgcatagactgctttatagctcagtgcccagcacaggtgaaacactgaaatgtttggtaatggtcagctgtcataataatagttttttgtttctttgcttttatcttttgtttttttgagacagggtctcactctgttgcccaggctggagtacagtggccccaaacatgattcaatgcagccctgacctcccaggctcaaagatcctcctcagcatcctgagttgctgagaccatagatgcataccaccacacccagctaattttttttttttttttaatttttttgtagagacagggtcctcctgtgttgcccaggctggtctcagactcctgggctcaagcaatcctcctgcctcagctcctaaagtattttattactgttaacaagtaagggctgggtgcggtggctcatgtctttaatcctagcactttgggaggccaaggaaggtggatcacctgaggtcaggagttccagaccagcctggccaacatagtggaaccccacctctactaaaattacaaaaaattagccaggtgtggtggcgggtgcctgtaatcccaggcaacttgggagactaaggcagaagaattgcttgaacctgggaggctgaggttgcagtgagccaagatcatgccactgcactccagcctgggcaacagagtgagaggctatctcaaaaaaaaaaaaaaaaaaaaagcaaggacaccatggaccagagaggtgaagtaacctgctcaaagtcacactacttggaagaagtgggaagggtgggcacagttgctcatgcctataatcccagtactttggaagaccaaggtaggaggatgaggccaggagtttgaaaccaccctgggcaatgtagtgagactccatctctccaaaaatttacaagaaaaaaaaaaagaaggaaatgtgggcagtgaagccaggatgggaactaaaagatcagattcaagtagggactatacttcagcctctggctggtcctctggcacttgggcccctttcctcagggcatcatgccaaccttttcacctgacttctacagggtcacaggcacctacaaggtgacctgcatcgttcagttggctgcctctgggcagagatctagctgaagtcagtctgtgcctgtctgagtaggtcctgggccagacttggtccctgcctgcactgagcccccagactgttgggggaaaccaggcacacagaggccatcaacccaggaacacccctcctctccctcccacctcagggcctttgcacttattacctctgctaaaacaggcttttttttttttttgagacagggttttgctcttgttgcccagactggagtacaataatgtgatcttggctcactgcaacctccatctcctgggttcaagcagtcctcctgcctcagcctcccaggtagctgggattacagatgcctgccaccacacccagctaattttgtatttttggtagagacagggtttcaccatgttggtcaggctggtcttgaactcctgacctcaggtgatctgcctgcctcggcctcccaaagtgctgggattacaggtatgagtcattgtgcccggctcccccagatattctctgtcacctccccaggacttaaaaccctatcatctctaaaattatcttttttttttcttgttatcctctctgcttcccagtaagacagggtttctcaaccttttttttttatcatccacccctgcaaggagtctttttcagatttttttgtcctaattgccctcccatgaaatttgaatacctcagctatactatactatatatagtatatatagatatagatatgtataatatataatatatagtatatgtaaagtatatatatagtatatacagtactatatatactacatattgtgtgtatatatatggtatatatagtatagtatagctgaggtattcaaatttcatgggagggcaatacctatatactatatatactatatactctatatctccttatgtgctgtggccctgtggagagccacaaatcactgtaatgtctaagaatgcttcacttcacgccattggaggtgatcttaccaccattgagaatggactagaacataagctccatggaagccttgctcacggctgagtctccaatgccagcctcagtgcatacccctggtataaacagaagtccaaggagtctgggaacagaaaggagacattcatcccagaggttggggagggatgagcagggaagaggggactccaaaatggagtcctataggcttagtaggggttggttaactgaggaagatatggagtgaccagttaaaggacagtgttggcaaaggcaccagggcctgaagcactcaggagtatgtagtgtggggccattccaagtgggtggccaggactgttgaagcctcttgaagtattggaagaaggaccttgaaagtgatactagcctgggcatctcctaggggccaagtcaggagacccagttttctagtgtaggctctactacaaaccagcagtggaaacgtagaatgggcaggtgggttggccttgctgacttcatgggcctacctggctaggaatccatgactctcctgtggaggtcattagccattgcctgtcgccagtggccctacaaacccccacatggaagtcagctaccccactttcctcttaactcaagcagaggatgcagacaggcccttgggcctgggtctcctagaaacctttgtgacatcagagacctccctacaacccactcttaaacctcatcccctgcctaccatgccagcctggttaaaaccagtgggagccacccaaggtgcagtaggggcttatctctgcttttccagaccagggctgctctgcaatcctgtttatttatccagagcagccgcctgctgagaaaatggctctgtttatttccaagtgtgtcgtgtgaaccatgggctaaatatacccacgccaccgcctctccagcacccgccctggaacagcacgccccattttgctcatgctgtctccgcaaaagcaatccttagaatccacaccccttggaaatactactccccttccccaggaaaagaagctgaaatggaaatgaaggttgtcatgaccaggaacacatgagtggaagctggggcaggtgaaatgagaatgtttctatggcactgaaatgagaatgttccctccacccaggaatgactgtttctggacagtgaatgctttgtgcccttgtggggacagcgcctgtttactccaacccagccccagagctgaaaatttcctgtggctgccagccgtctacttcaggaaagttcccatcaagggagccaggcctctcccattttggctgcaaccccagtgtccctggtttcttgagagacatttggcctcttgggataaccagggccttctcctatgctcttcatagtgtggaactctcccccatcacagataagcctattttgtgactccacctgggtgtacttgggagcaacaaaatcaaacctcctgtaagaatatttttgtctgccaagacccgcagaggctagctaggatggagagggagacagggaagcatagccacggccctagtgccctcctttccccagatcctccacctcaaccctgctcccacattccttctcctggaaatccatcctttcagcactactgacaggacaggtccctccagcctccaacttcagggaagtgtcctgacatagcagccctccctttgaagctaggcagtcttgcagtttgatcccgactctgctatctgtttgctgagtgttccctgctttaaatatcaggcatcttatttgtgaaatgtggctcaaatctacatctcaggattctgatgaagatgaaatgggataccaatgcctgacatgtagtagacatgcaatacatttgttaactcatgtattctcatgtatttacagagcaagacactgttctgagcactgggtgtataggaacgagacaggacctctgccctcatcaagacacatctagtataggccgagggcagtggctcacgcctataatcccagcactttggggctgaagagggcagatcacttgaggtcaggagtttgagaccagcctggttaacatggtgaaaccccatctctactaaaaatacaaaaattagctaggcgtggtggcaggcgctactcggggggctgaggcaggagaatggcttgaacccgggaggcggaggttgcagtgagccaagattgcaccactgcactccagcctaggtgacagagcaagtcttcgtctaaaaaaaaaaaaagacacatctagtatggaagacacatcacaacaaaaacaaagtacagaatctagttatgagaagtacagcttaatgggggaaaaatgtggtgaggtggtgaggccgggcatggtggctcacgcctgtaatctcagcacttgggaggctgaggcagaaggatcccttgagcccaggagtttgagaccagcctaggcaacaaagtgagaccctgtctctacaaaaaatttagaaatattagccaggcatggtggtgtgtgcctgtagtgtggcagctactcaggaggctggggcaggaggatcatctgagcccaggaggtcaaggctgcagtgagccatgattgcgccactacagtctaacctgagtaacagagtgagacactgtcacaaaaatttaaaaattaaaaaataaagcactgagaagaaaagctggcatggtggtcattctgtgtagtgtagttcctgtaatcaggaggctgaggcaggaagattgcttgagtccaggagttcaaagtcagtctgggcacatcttttaaaaacaagaaaaaaaaaatggtggctgggcatggtggctcatgcctgtaatcccagcactttgggaggccgaggtgagcagatcacctgaggtcaggagtttgaaaccagcctgacccaacgtggagaaaccccgtctctactaaaaatacaaaattagccaggtgtggtggcacgcgcctgtaatcccagctacttgggaggctgaggcaggagaatcgcttgaacctgggaggcggaggttgcagtgagctgagatcgcgccattgtactccagcctgggcaacaagggtaaaactctgtctccaaaaaaaaaaaaaaaaaggccagatatggtggctcgtgcctgtaatcccagcactttgggaggccgtgggcggatcacttgaggtcaggagtttgagaccagcctggccaatatggcaaaaccttatctctactaaaaatataaaaattagctgggcatggtggcacatgtctgtaatcccagctactcaggagaatcgcttgtacccaggaagcaaaggttgctgtgagcccagtttgtgccactgcactccagcctgggggacagaataaaactgtgtctcaaaaaaaaaaaaaactgagaagaaaaatcaaggaaggtaaggggacaggcagagagagacgggggtggtgtactgttttagacaaggcagtcagggaaggcctcccctaggaggtgacatttgaggggagtcatggttgtgaaatgagggagtgaggcaggcgacgacctggggtcaggtgctccaggcaagcaggaacagcagactcctgcggcaggagacgttggaggaacagcaaggaggccagtgggactggagtgaagttcaggggacaggggtggggaggaggccagaaagtgttggagccagatcccactagaccttgctggccagagtaaggagtggggactttatttcaggtgtgatggaagccctgggaaggttgagaacttggagtgactgaatggagtgtgcttctgcaagggctgagattcatgggtcactgctctctactgccttaatgttgaggattccttcagtcaaattagcagctcagtgcacatggcattttgctaggtaccagggatacaaaaataaatgatgctgcccttctaagtgcaggagaatgctgctggagggcttccagtgttcttagaaagctctgtgtggagcatggactgagggggttgtcaagactggaagtgggccacggcaggggtcacaagtgagcaaattgataggtgagacctgaggccaactggagatggcatgcctgtcttgagggagcagccactcggccatttgggactggttggaaatgtaggcccagtgtggcagaggtcttggtagagaggcaagaaccagccagtaactcattcattttacacacacacacacacacacacacacacacggtactatggtacttccttttttttttttgaacggagtctctgtcacccagactggagtgctgtggtgcgatttctgctcactgcaacctccgtctcccgggttcaaacaattctcgtgcctcagcctcctgagtaactgggattacaggtgcgtgccaccacacccggctaatttttgtatttttagtagagacagggtttcaccatgttggccaggctggtctcgaactcctgacctcaggcaatccacccacctcagcctcccaaagtgctgggattataggcatgagccaccgcacccagcctggaacttacttctttcttacatatttctaggtgccagatgccagttttagattctggctccaccactgacacagctgggtgaccttgatccagtccctggaccctcagaggcacagcttcttggcctgtaaatggggagagacagcctgcattgcagaattgttgggaggattaaaggacaaattgggtactacgcttactcataaaagttatgttctaagcgtccttctccctgccccacaggctgctgcaccctgggctgggtaatttagcccacagctcctccttccccctgtcatgtgcttcccttctgacttagattcagggcagagggctgttgatcacaacctcctgggcccagagtcacaccccctgcagtggaggatgtccgggacaaggcctcacagaccccgtgatggaggcctgtcagtcctgcatcattgttaccctctctcctctgccctgctcttcttgtcaccaacctgcccaccagaggctccctccagagggaggagcctctggctgaagtcccaggacccattctacccctgaattggcctcaaatgaccctggggatttagccctgggcttccttatccctccctctggtgcagcagtagaaaatctgaggcctagtggctccacactccacactaccctcagactcaactctaggctccttgcggcttccaggccacgtatggtctggctcttgctcacccctgcaccatcatctcccccatgccctcctctcctgcactctgctccagccacctggcttccatcagttccctgaccctgcccatctcgttcccaccttggattctggagtaagtgctacttcttgacttacctcagacagggcactttcctcctctctacctgtttctcagcagtaacatggtttgattatcaccaatggagggtcaagaaagaggaccacccttagccctttacctggcccagagtgggcacagatggctacagtttttcacatcaccaaggccatagcatgcagatggcccctttccccacccacctacatcactctctgaggactaaaactgcaccttccttctctctccctgcaggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaacaaagagcctgggctcttgtgtgctccgggatggggaaaggaggggccgctggagagctgggtactggtcctggctctgctgccctcaggggagggccttggacaagtccttccttccttctgggcctgaatttatccacctgtacggtgacagggttttactgggtacatgctgtgtgctgggcactggggctgcatgtgaacaggacagacacagtctctgccctcaggagctgacattctagtgggagacacagccacttggcaagtgtttactgagctctgctctacacagacatagtcctgggcactggggacttcttcaaacaaaacctttgcctttacaagcattcattctagtggaagagacagacataagcacggctctagctgctgtagggtgtgggggaaaggtgtgatgcctttcctcacccatcagaaggttctgtgactgacattcctataacaaaagaaaaacaaagtggcagttcacaccctgtaatctcaatactttgcgggtgggggatgggttgcttaaggtcaggagttcaagatcagcctgggcaacaaagtgagaccctgtctctacaaaaaaatt

SEQ ID NO: 16288 - DNA, 63187 bp, Human; identical to SEQ ID NO: 12682

SEQ ID NO: 16289 - DNA, 58162 bp, Human
tataccaacacacacacacacacacacacacacacaccccacacatgtcccccaactcagacttgcacccttcccttgtctcccacacataccacacatacactctactccacactctcccctacacatcataccctactcataacagccaaacacagcacatttatttcacttcagaaagattataatgtaatggtttctaataaatacattttaacatttttgtcaaccaaggaattaaaaataaaatttttaataaataaaaatttaaaacattaattttatgttcaataaagagattcacactgtggttaaaactattcaaaatatgcaaaagggtataagtgaaaagtaaaaagtgaaagtcccccttcctgtatgacttcttagtcccagtccagatataacttcaaaatcttcatgtgttgatttctagaaattgctacaaacacatatgtgtatataaaacaaatatgtttatttaatttttaaaagttgatcacttgacactagttgagccattagaattgggtgccagtcacagcactgtgtccttgcataagtcaacaagcctctctggggacccctttagttgccatacctctatagagtcaggcttgcccggccacatttgccttagtccctatctgggagaagccagtggcttctgtgctcctctctctgtttggggccctcagagctgaaaacagaatggacactggtaggtgcctctgattcctcttgccagggaagcttcccaatttagtcatccaccccaggcacccagggaggccagtgtcctctctagttaattttcaactcctgactccacgaatacagttttttcaatggtaggaggtatttctggaatatatattctagaaataaagcattttcttttctagccgttcacttttaactttgacttatttgcttcaaaagtcagtaatgtggaagctttatctggtactttttggtacaattcatcccaccaaaaatcacagatttttaaaaggaagttatcttgaacattggaagtgggtaaggtaagatacagatttatacaatatttgtgcaacattttaatagccaccaaaatattgtacagattattgaaagattatagatagtcacgatgttaaaagtgtttatttagcattgtttttcagagactctgaatttccgaaaaagctttttattcatgaggaaaatctgagaacttcataaaattcgattttctacctggcgtaaggatgcacaaggaaatgaaattatttacctaacatcacagaaattaagatgtgaactcaaatcactgtacacatcaattgacataactttgataatgcagctaaataaatctcaactaatgtggttgtgttaggatttcagtgcgcattgatctggatgtacaattagtgcccagttgctttactcacaaagtaattctagtgatttttaaaccataatcaaaccttgtcgtttcagttccaagaggcaaatatataatactagtaattaaataattcttattacaaaggcacggttgttttcaataaaatcaatctaggttgatgctcaaattttataattgctaaatcttgtctgcatctttgaaaagataaatcctataacttggggatgggtgaatccccttaagagaaacgcataaggtggagggtgtgggggcaagtggcatgtgcctgtagtcctagctacttgggaggctgaggtggaggattgcttgagcctaagggttcagggctgcacctgtgatcttgccactgcactctagcttgggccacagagaccctgtctctaaaaaagtatttaaataaacaaaaattttaaaataaagagaaaaagatgaaactaagatcctgcaacatgatacttggcctaaatcctgtgcttttgtagggggctgagggtcaatgattttatttagttaaaaggatgcaatgacttggcaggagtgttttggcctcattctttaaaaaattaacttctcttagtcttcaagcctagtacttgaatgtcaagtacctgcaagcctcaatgtccaagacttttaagagcggaaggtacgatgagttccatctttactagggtcacaaggaaggcatgggtatatggaaatttttattattattccatctgaatatcattttctagagaataggagcttttgttctgaagggctgccggcttccttctgggatctagcagccagggttagatcacaggtgtcactttcaggcgagtagttagcaacggtatcgctagcaactgagccgacccctgcagccagaggtttgcagtgggtagtgtgtattccagaaagggccctgacatgtgaaaggaaggaatgtgccctaatattctacagttgttttatcgttgctactgattaggtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaaggtaagctttgcgctctaccccggctgctctgtgtgctcacccaacttccccgctgctgcctggcctgctctgccaccgttcgctccacattcggttttgcccagtgaatgtgaaatcacgagggactgagaacgtcattcagacctcatctaatgttttctttctccctctcaatgatggtgctgtgacaaattcgctttggggatccagtattctggatcagagagctataattatggtgccgctctgtgttgggtaagcattaaataaaactcaagatttctcccctttttgctaaaaggagggtttgggtgtgactttttgtcttccaaatccttcctcctgttttgtagttagttgcatggtagcacataagtaatatgtttgctttatttcccctgagggagtataccgtgtctggatgtcctgcaatactaggtgtgtggtggactggacagagcaagctcctattccatctccacgatagtgttagttttggatgcactgttcattggcccaagcatttgtgtatccctttagaatcaaaagtcaaaagaccaataaaaaatactattaaagtcacttcactgatatgacaaaatgcctctccctgaattccacaaatgtatattcagagtggtgagccgtagatgtcagttcaatctagaaatatgaggacagcaaagtgatttgctttaagagattttttttaataagtgaactttttttctggatattattttcaatcaagcagtattatttatttgtataaaaattatatattaatgacagatcattttattttttaatcagttgctacctcctcctatgcgttttgattggttctagctactaaatctgggtatttcatagttccgatcaatattatttagactgtttttggcagcttcttgtctcccatttcccatctaaaaagacgattgtagacatcaattccttgaattattttctagatgctaagttaatctttttagtttagtgttatggtgtcagatcacagaaaaagtgattattctttcacatctgaatatggtttttatagttagtgagatttacacaaatgcaactagcaatataattcaggatacagaaaatatactttgccccggtgttgcaagaaaatggtgggaaagtggtcccatcccttttccatacacacaaaattccctggatatccatcaatgctcattttgtcccagtggagatctggacttactgtaattttgttaacccattaaaatatttttctgatgtaaaagctacacacatttattgtaagcattttccaaaaaagggaaaatacaaagaagaaagtaagtcttaccttatatctaacccctttgaagagattcattatgtggtatttgaaaagatttatttacttggacccaaaatgttttttttttttttttttttttttagatctcagagcaagttgaaaactccaaattccgtttagagacagtagaaaagcatttaggtaaagcacttgtaaatatcactttgttgttttgaaacagtaattaaaacataattctaaacatatttatttgccactatttcaaatgccacacaaatcttgtttttacacatttttcttgatatatactgaaagtctgcaagagattctataaaagggaatattttctaaggtcgtgttttaataatttactaaagatggtgatgtttgcaattccacccagagtcgtcagctcagtgcaaccatggtaagagaatttgttattcatagttttaccctgaagctgactaagtccatattggtaatgcttagaatctcccttattctgacttaaagggtcacctctgataacctttcaggggtggggaaatatcacaaataaagaggcaaaaagagagaaaacacagttgaattctagagaacatccataaagctgccaaatatctataaggttaagcaaaaatcatctaaatctcccagttcttttttctagattatatggaaagtgcttgtgtagcaagatagccctctctgagccaaaattaggacagttctttagaaattatagtctccaaggacttcatgtctctctcccctaactcaatgtgccttttctttctcatttttacctgtccttgttattcctttcttatctgcctttctttcacctttctcccctcttatcccatgttcatgtccgtctgtcagggctttagacagacagagaaaatagtgctttcatagcactgaccctgagactctgagctctgaaagggcagcaaaagtgaagctcatttctgagacaagcaggtaacctaatttgccctattccatggtgttcgctatattcttcccatggggactttgagctcaaagtattagccttgaaattaaaaaaaaaaattgtttcctagtgaaaaagaggtgattttttttccttttaagacacctatatttattttatcttatcaatggcctataatatctagtatctcacccccgaaattgccattatttagatgcttcagagaagattctcagccactctgcagttttcacatttctttgaggaatacagtaggtatggtgtttaaaacatgtgaaggtcaataccctaagaggtcaaatattctaggatacagatttagataaattaatggaggatagctcggtgacaggttattaaagaaatattttggatgtgcaaatgctgtttgaagctattctgagaaacagaatattggaaagatagactcttggtctaatcctccaaaatgtcagtggcaaggaagccagtcatttattaagctgtgaggacgcaaactgaaattttctagttctgactgagtcaatgacgcaccttttttgtaaaaataaagaagtagggagaggcgtttgcttccctgtgcctcagttttcctctccttaaagtaaaaaaacaatttcaccttatatcacactacagctgtaaggaagaaaaaaaatgaatataatccaaaagcaaggtgacattttatagcaggaaaatactctaggaatcatctttcactttgtaaaagagaaaacaaaggctgtaggcaacatttcatatgttaagcctagatttgagtgtcttgagtcccagtcgtaggtattatatctaatataatgtacctggtaatattgaagcacttcttagcacctaatttgtaccaaacacattctaagcatttaatcctcatagtaccaatattgggtaggattattcatgtcagagaggtaaagtgaattccacaatatcacacagctagtaggtggtaaagcagtatttgaacccaggaagtctggcttcagactctatgcttttaatcagtatgataacttgcctcttttgttattagggaaagagcctgacagaaccaagcctgttaagagttgaatttcagttttccacttcaggataaaaaaggattagaatggtaattaaacatatacattaaaaggagtgtgcagaacctgtagatagattgtgatgaagactgaacttcattgttcttcctctggcttgagcagatccttagggttttaagttctgctctataaggtgtgcagtaggtccaccagctaactgtggagggctgtggtaatagatgagcagtatattaaagaccattatgcaaaactaacttaagataaacttattagaaaatgtagaccagacaaatggtctgatctgtgaagtaacgtggtggaattaacagtcaatgcggcctcaaggtggaactaacagtcaatgtgaactttacatagatggttgcttttgcagctgaagagaggctgttcttagctggagttctccatctttcccacggaactctgcataggtttaaaaaatggtatccaatgactataacaaaagaaatcaccattatctccagctctgattattttctgcactctggcaacagacttcttcaagtgggaaatgtttaaattgttataaaaacaagtagtgctgtccttgcaacatgtttgattatcagtttttttatctttattgatctttcagtggatgtgaaaaaagctttccttaaaactaaacagtttatagactataattttataggtaatgagtcattatttaggtattactacagatgtgggtactaagtgttcttcaaagcacggaaggtagcctctttttatttctgatcagtggagaaataaccaccctatgttgtaccaaatcttacagaacagtctgaactgaagaataacatgaggaaatttcatctaaaaaaattatattaaaagggaagctttatatggaaacaggcatggatttaatacttcttctggatgctataataaaatgtttcattagtctttcaggaatggaaagcagatggatatttaactgacactctgcacagaaaccagagactgaacattttattaattttatcagttgcatggtaccaacttgaatggaaactaaagattgaagttttattcattttatctgttcccttacgaagggaaaaggattaactgtaactgttctttatctgaatttctcatatctgaaatggaaactattctaatctgtgtagcctttaaacagtctctcttcttcttgtttattttagctgatgacgtggttttgctcatcaaatcacgttaattatttaaaggaaaaaaattgaaatttttcacatgtcttttttaaagtatgatttttggaagcccagtaattctgctgagccaaatattacttagtaatatggacacatacaatgtctcaggacatgttacaatgggaaattctgttttcctcaagcatttcacattagattattatctggttacctttcctaataggctagaattttagtgaaagtcataaaagtagaactggagtctccaaaaatgagatactttctcaggagatggtcattgacaccttcattagaacaaatggactagaaataaagctccattcagaaggcaacaaggaatgctaccagctgacttccttatggcagtccatggcagtgtataaatatgcaaatgaaattaaagattcacggattatttttagcaatgtgttagttccagtggcctggaaatttttctctcaggtactgaattctgtaacccttgagaattcagttacatacagtgatatatttctcttcttctagttctgcagggcacagtaatatgcccttcagacaaacaaacaaacaaaaaaccctctgtatacaggtgggtatccatctacctctctacattcgctataaaccagttattctcaaacttaacatgtatcagaatcatctgaagggtgtgtgaaaacacacagagattgctgggcccttcctcagtttctaaatcaggacatgtgggctggggtctgagaatttgcatttctaacacatgcccaggtgctgctgatgctgctggtctgaggactacactttgagaagcaatgtctccagtaaggcaagggataatgaactggacaagttatttttcactgtcaacctaaataacagagagagaggttctctaaaagaaaatgaggccgggtgcggtgactcatgcctgtaatcccagcactttgggaggcccaggtgggtggatcatttgaggtcaggagttcaagaccagtctggccaatatggtgaaaccccatctctactgaaaatacaaaagatagccgggtgtggtggcacatgcctataatcccagctactcgggaggctgaggtaggagaattgcttgaacccaggaggcggaggttgcagtgagccaagatcgtgccactgtactccagcctggatgacagagcaagactccatctaaaaaaaaaaaaaagaaaacaaaaaaatagaaaatcatatttatttgggaatataacattgcagtggaaatacaagtgacatggtaaactatgtgtgtattcagggaggtaaagaaagacaaggtttttaaaggaaaagtgaggagggttacactcccggaacaataacaaaggcggagccagtccaaagttgtacaggcagttgctgggcagatgtcctcacggaggtattttttgtgtaaggttgccatggcctttatgcaaggttatggtttttgcagtcttttgtgatagttttatgtgtgagaaccctcccttcgtggccttctctgactctattagtcagggtttttttgttttgtggtgtttttaacacagttgacttagttttgacaactttcatatcacatatagttgatcttctacatcaaattgccattttagaaaaattgccattatagaaaaatttccaatgtagaaatggtcttgttttggctttacaagaactattgtttgtacaaaagagagaaaactctttgatcctttggtcttttggcatatacttttttgagtaaatgctttttaaagtttttaattgacaaataattattgtatatatttatggggtaccatgggtaccatgggatgcttcgatgtatgtatacaatgtgaaatgattaaatcaagctaattaacatatctgtcacctcacgttactttttgtggtagtgagacatttgaaatttactcatcaattttgaagtatatagtacagtattaaagctatagtcactgtgccgtgcagatagatctcaaaaacttatttcttctgtctaaatgaaactttgttcactttgaccaatatctcctcattccatctctacttcaccctacctcctactcccgccccctgcctctggtagccacttttctattctctgagtatgacttttttagattccacatataagtgagattataatcatgccattttcagaaatatctcggatggttgggctggttgcagcagaaggaaacctggctaaagggttgggtgggtgcaaatccagcctgtattcagctcaacaagccttgcatccaggtgggctgcagctttctacccccaaaagaagggatacctttttctaattcacccaaatactttccactgaataaaagcaaattatttgtgttaaaacactaaacctcttgttcttagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaaggtgagtgggcctactttcatctagtgccatattagaataaacatgtgatacaaactatgccataatcctaggaaaattattaaaataataagactagacgctagtaggctgggcaacataatgagactgtgtctgtacaaaaaagaaacaaaattagctgggcatgatggcatgtgcctgtaatcccagcactttggggcctgtaatcccagcgctttgggaggctgaagcaggaggatcacttgaggccaggcgttcaagaccagctgggcaacatagcgagaccctgtctctactaaaaatttaaaaattagccaggcatggtggcacgtgcctgtagttccagctactcaggaggctgaggcaggaagatcacttgagcccaggagatttgaagctgcagtgagcaatgatagcaccactgcattccagcctgggcaacagagcaagcaagaccttgtctcaaaaaataaaataaaaaaatagatgctattgataaaagagttttttgtggggggtaaagttgcaagttaaatgtgtagcttctgatcctttctactttttacccatggtgggaccttgaataagtcataaatttttaaatttcagttccctcatgtacaaggaggataatatctcttatctatctcagggttttggtggaatttaaatgagttaagatatgcaaaagcactctgtaaactgttaattacaatacaattaataatgctgttacttgtatacatttttgtaaggcatttttacattgttatgtgaatccttgcagcaagtctatgttattattcattttatctataaaatacatcagatagatgatggggtttctattctacaaggaaactgaggattgccaagcttcaatgacatgtctaaggtcacataactaaggagttggtcatgcaggtgccagaaataaaaattatgatttttttactctgattattgcagaaaaactgttatgtgtatctatttgctaacttgtatggggcttttaaataattcacaaaaattgtagttatgtttcacaataataaatatctcagttatccagaatccaatactttatacatgttatataacagactttcttgtactttaagagaaactgataaatcacaaagaaataaactgttatcagctctggttttatgaagttggtcaatttacaaagagccaagtgttctgtcttttctgcagtgtgacatggtgcttaagaggacaggcactagagccaacctgtaaggattcatgtcctgacatcaccatgtgctcctgtgtgaccatgagcaagtcacctaaccatccaagcctccatctgctcactagtaaagtgaagacaatagttgtacctacttattcatttgtttaaggattgcatgagataatgcatgtgattagcacacagtagtacatggtgatttctcaataagtatttctcaataagtattagctattaataataacatttctacattatgaaaattcatacccagagtgatgactcttaagctagttaatcctcactcgtcaaagacagatttcatgccccttgtactgaatcaagtccttagtaagaggagttgatttaggcaggaaggaatttagtaagtgatattgaggaagctcacagaatcctaagaggaggtagaggaacaagcttatctaagctgtgcttccaaaaacctcacccagaaccaggcacagtgctgacctgttaagggagtttctgtggcccaaacagaacaattctgcctctgctgctcccatatcagcatagaaaggatgctctgcatcctgcctgttttcatatggccccttccactgatcagtggaacctaagccaatgtttgcaccctagcagcaagtgaggatggggaaatctctctctctctctctgtgtctctttctcctctttctctctcccctcctctctgtctctctctcttctgacacacataattctactaccacaatgtagaaaacttctacacatagtatttgcaagattttggtcaaccattaatggcagatctcttctctacttcataagatagtcaaatgtgaagattctcagtaaagattgaaataaaacaacttttcaaggaaagtatgttacaagataattaaattggctagattgccctctcagagcattcttgctagttgaggttttgttattaatatattgagggaaaaggatagttttgagcaagattgatagtaaactgttttttagaaaattgtctagacatatattcacacatcctgcaatatgtatctcttttctttggcacctgagagaattgatttcaattgtcactggttttttatcattgctttggaagtgttatatgagcagagacacctcatctacacttgtgcttcagtcaactaaactgccttgcagagtttatgtcttcctgcatgtcaattttaaataaattggcatgtaggttacaaagtatgaggtgtcgttagtaataaattggtatcagtcaaccatcaggcaacaacaaaaaagttagaactgtaaggagatttaggacttttgcaaacttctggttttgtttgttttatgctataaaaggagtattaattagagtctttgatttggaatcttcactcaataactgtatgtaagaattctattctagaataataaatgtatgtaagaattctgttctagaataataaatgtgtgtaagaattctattctagaatacttgcaaagccccaatttctcctttctttcttcctttcaaaggcttccttcatggccgggcacggtggctcacacctgtaatcccagcactttggggggccgaggcaggtggatcacgaggtcaggagatcgagaccatcctggctaacatggtgaaaccctgtctctactaaaaaacatacaaaaaaattagacgggcgtggtggcaggcacctgtagttgcagctactagggaggctgaggcaggagaatgtcatgaacccggaaggcggagcttgtagtgagccaagatcacgccactgcactgcagcctgggcgacagagggagactccgacttggaaaaaaaaaaaaaaacaaaaaaaaacccaaaaaacaaaggcttccttcgttttcagtcaacactcacccatcttcattctcacaggaggaaaaatatcaccccacccactcctgctgcttccttttcccaccatctcatttctagtctccaagcaaaaccacgtcttgggttataatgatgcacaaaccctgcccactctggcacagaggtagtccacagccatatgcaagccattgggatttcaaagtaactttatatgttatggactcccccaccccctgataacataataaactcatatttattcaaatcaacccataattccaccaaggaaaccattcttatctaattgtaagccaatattggccgcatatgagactcacgaagtctttctttttttttttttttttttgaaacggagtctcgctctgtcgcccaggctggagtgcaatggcgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaggaagtcttttttctaccctctgcccaagacctactcccagctctggttctgagtctattgtcttctaactgggctcaggattcccagagatctggtctttcctagaaatcaaggcatgagttcaacgcaggccttacagaactcaaggacagttaatccagaaaatgaatatataaaacaccagaataggagatacatgaccgtgaatttaatgtttatgttggaaaggactttctcatataaaagcgaagaaatctccaagcaaaaatgcaaataatctggccacatataatttaaaacctctgtatgacatcagaaagattataaacaaaaaagtgaagggcatactaggaaaaatgttttttcgattgtatctcacaaaagattgatcttcttaatatcccaagaactcaaacaaatttgtaaggaaaacatccagggccctgtagaaaaatcagcaaaagatttgaataggcatgtcacagaagagaaaattcaaatggctaacatgcatatttaaaattttcagaccttttagtgataaacgtatactaatgtacaaataccattttccttctcttaaactaacaaagaataaaaatttacaattctcaatgctgatagtaaaagagcaaccatctgcctgcatctttactaacagggaatggattttgaagattattcatcctaaaatctggttttttttcttttttttgaaatggagtctcactctgtctcccaggcttgagtgcagtggcgagatcttggctcactgcaacctccacctcccaggttcaagcaattttcctgcctcagcctcccgagtagctgggattacaggcacccatcatccatgcctggctaattttttgtttttttagtagagacggggttttaccatgttggccaggctggtcttgaactcctgacctcaagtgatccgcccacctcagcctctcagagtgctaggattataggtgtgagccactgcgtccagcctaaaatcatttttaaggggtctgtaaggtaaattttaaaactggaaggatagtgaacactattactatttatagaaatacctatattattctttgaaaagagaatggaatacactggaagatgaaatttgattttctgaaaatgggtacaagaaaattaaattttaggcaaaaacactaattttgtttaattagaataatggactatttgccccccaccaaaagtcttgagttctaattctgactctacctctatcctgctctgtgatgtgcagctgaacattaatccactccccaccatagaaataaccaaagttctacctacttcaccgtgagctatgtctattttgagaaagtttttgacaaaagatactagagcttggtagaccactgaatctggaaaactgggctctcagaaagagaaggagaacatttcctgagttcttcgtttctgctctcctattaatatttcctccatagtaggattagatttaaatgtagaaaagccatcctaaaaagaaacatgcagcagtataaacaggataaaagcatccattgtgtatccactttctgtgcaaaaagtgtgcaggggaagcccagaattaaagaaatgcaatgagagagtggtaaatacaccactgagacgttggaacgggtgtgctggccggcacagtcctgtgtcctgcactgtgtggcctcttgtcctggtcttccccaggcaccaagagataacagagcattttgcactcagcaagtttgaaaatccagaaaacctgtgcaatataagttttaggtttatatttcacaagtcattgagtttttaaaagaagttgaattgcctagtttttatttacaagaatatgttcctttaaattgtatgaattgtggctctaacagtatcattaaaaacaaatccagagttcctaccatgattttacacaacagtattcccatgaagacagttcttgtgaaggctgatttgatgaaaaacagtgtaacatgaattaatttttaagtttaaaatttgattgttttccctagcctgccctgatcagtggttcagtttataatctattagttatttggcaagaaaaaacatttcagttgttctcaatgctgattgtccaattgaaagattgagattttcttgtgtcaagcattctctctttgaatcagaaaactcaaaataagggtattatttttgttatgacttcaatttgctggtccactgaagttaggaaacagcatacaaatgttatccagttgggcataactggtgtagtgacataaggagatttttcaggaggtaaaacacttttcaggtataaaggtcactgccctatttcgaagtcattgaaaagaccaaaactcatctcctaaagggattagcttttttgccttcacttgctattattgtactggctttactttcttttttgaaatgctccttgtgtacttgcattaggattttacatcattggaggaaaatctgtttgtgtggattaaatggaatcgacagaatccatgaagtcgtgtataattatctcaaaaaaaagagtagaattagaagcataggaaatagacctgttaagctgaattttaaagtgtaacaggcaaaatgcaaacacccacaattttggttactacttaatgtagagtaagtgtttgcactgtagtacaggttacatcaagtcaaagattgaccatcacatatatgccatatgggaaggattgagtccatcaagtctttgaagctgtgcaatctttataaatatgtaattaatgacataaagcacatcttcaaatttaaaaattagtccaaggaggaggagtaggaaagggagatatgctataacattaatatttctgtcctcaagagtttaaaacctaagaacgactagtgccttagtccgtttgtgttgttacaatagaatgcctgagatggagagacttataagaacaaaactttcttgtctcatagttctggaggctgggaagtccaagatcaaggcaccagcaggtttggtagtctggtgagggctgcatcctctagaggggaggaacactacgtcctcacatggcagaagagtagaagagcaagctagctgaatgctgcatgaagtcttttttataggcgtcttaataccattaacaagggagcagccctcatggcctaatcacctcttgaaggccccacctgttaactctaccacattgacagcacctgaatgttggaggagacacattcaaacgatagctaccagacactcacaaaagggaaatttgtccatcaattccatatagacacatgcccacctgtctcttaacttcatgggaattttgtttcctacagaaactgttggtctaaaaactacattgttgatttcctaagtggtaatctgatttaatgacattatatgctccacctgtagtttaccctgaatgcaccattatctgtcctaagcttagcctggctgcagccaccagggatgccttttatttatatctgtctaacttcccacaaatgcagatcctccaaatatcaagatacttgtaccaacattcaaattaagactcttttaaattctgattaggcatcttgacaagcctatgagttgaagtctcagttataatagcttattttgtgtctattcaaagcttactgtgtaccctagaacaatgacctcttatcacttaattcaactctgatgcttccatttttatcttcttgtaccaatacacttgcccaatatactgcctggatcataggaggggcttaagacattttgatgagtgaataaatgaatgaatgaatgaaggacatttagggaccatagagggagaggtgaagcaggaaggaaatgatctaaatatagtacaggagcagaagtggaagtttggagaagttctcaacaagaatcctagaaagttgtcacatatacccaggaagccttcaactttgatattcgtgagttcaaataatgattgcattggtctatgaaatgctgttttcaaaacttagaaccttggaaaagtgacaaaatcctgggtttggagagaagatctaatacatccttagcaactagcagctactgaaaatcaggacctgggattttgaaaactgaatggaaaggaactcgcatgataaaatatgcttcttagttcaggctgctgtaactaagtaccataggctgggtggtttataaacaacagaaatttatttctcggccaggcgtggtggctcatgcctgtaatcccagcactttcagaggctgaggcgggcggatcacctgaggttgagagtttgagaccagcctgaccgccatggagaaaccccgtctctactaaaaatacaaaaaattagccaggcatggtggcacatgcctgtaatcttagctacttgggaggctgaggtaggagaatcacttgaacccgggaggtggaggttgtggtgagacgagattgtgccattgcactccagcctgggcaacaaaagagaaactccatctcaaaaaaaaaaaattatttcttacagttctggaggctggaaatccaaaatgaggatgccagcatagtgaagatctgatgagggctctcctctgggttgcagactgctgacttctcattgtatcctcacatggtggaaagagcgagctctcctgcctcttcctatcagggctccagtctcattcatgaaggctcctccctcatgatctaattacctcccaaaagcctagctttctaatacccatcacattgaggcttagaatcttaacataataactcagttaattatttcaaatctagtattcataaatttattctcaccacctctgtctgtgggtcgttaagtacgcatgtatggtgatgcggaggcagctgccagtgcagccatcagtggactttacactgggtgcactctgggggcaaaggcagggatttgggggaaattgaacctacatcgcctgtcctgggagatgagactttcttttttaattaaaattgttgatgggaaactatgcaccagtcagtggaaacctgtgcatttccttgtaggtgggctttgataaagagccaaatattaataactctaggaattgcctggagttactaagaatcatcaggattattaactagaacttgatcaaagaggaaccttttgacaagtaggaactgcagctactctgtttctcagttcccaaaaacatttcatgggtgtttcttaacaggttcattgttattgcttattctgttttttagaagacagtgacaccttgatttttgtgttgctaagaactcctttaaaaaatatgttgtcactcatagttgatttttgaattcctgagcttggacaaagagcatatgaccattcaaaaaaaggtgtgtctagctacaaatgggcagattttggcatagggacctttacaagggcctgagtacaaatgcattctgcttcttgaataagaacagggctttaaagaaatcccagtccttctaaatgatgcaggcagataacttaacaaaatcaaacgggaaaaaaaaaatcaaatggctgggctgaaataagtataatttgctcatttttcctgattagaattgtatttattaaagaactgctgaagataaatagtcatgttcttttgaccttttgatacaggaagcaataaaaaagaggacaggagggaagtggcatttggtgccagttcctggaagaagtgcatgtgtagacccagcataatacttgcaagttcaattgattatttttcaggccttttacagatttgcagtaatagtacataattacacaaagggtgcattatgcatttttttgtatgtagcattttaggggttgctcgcgaaacttcacacatttctcttttagctatagcctacaataaaccaagtaacttttcttcttttccattttgaactgaatgcaagtaagctggccaacagcaagatgggacacatttttacaaaagaagccagatgtcacccagattccacagagaaatctgtgaatcatggagggtttctatcaaaaagaactgtgattaaggacaacaccaattttaccttctcatttccattctaattcttctattagttctgaaacaattttgaaaaatggagggaaagctaagaagaatattaccagaaccttccagtaccaatatgctagaaaaaatatgctttaatatctttaggatgcatgtgtatttaatagttgagctattgacaatggtatggtaacttacctttctctccccttctcaaactctctctctcccaatagtttgtggctcatcccaactgccagcagcagctcttgacgatctggtatgagaacctctcaggcctaagggagcagaccatagctatcaagtgtctcgttgtgctggtcgtggccctgggccttccattcctggccattggctactggatcgcaccttgcagcagggtacttgctttctacatctatttcctctgtggtggtgtactgtgtctctttgggataaaaaaataaaaagcttcatgcttaagaatcttatcagttttaccctgaatgttaattgattcaagaacacagattctcctttttaattactggatcaattcaaataagggatgaaaaaggatttggtaccagtgggatataccacatttgcaggcataaagtacttaggcttttaagataaaatcctcatggtagacagagaaggaaaagctgcttgagtgaagtagcccttgtactgattttattgacggcttaataagtagagtgtcgactgggctggcctgtgaacagaccggggaatggagagcactgctgcagtagtaccaagaaacagttacgctgggaactagaagggcaacccatttggacctgtcagaagaaatccaaggttaagtgtgcgaagcacagttgagaacagcagtggtatccaaagtcttcaagaaaatgcatgtcaggttcccctagccctttgttaattcagacagttcttaaaaatgtaggatttaggttcaggggttttagatttttttagattgtttatttggttttgcttggatcattttggttagtacctttattctcctctcaactttccaatgtaaaatcaatttagttgtgcccaagagatcccctagcaagatgtggaaaggaatactattcatgccagttattacaggcactgccagagagaaggagctgtgctgagatcctttaatcctgtttttatattctgaaatttggttttgtttaagtcagaggtagtttcaaggcaaaatgagtcaagggcacttacaagtgatcctggaaatctatcatctctctggctcagcagtctcccccggcagagttctgctctgcaaacaccatatatgtgtgagaatattcatccatctcatttcatcattgagttgcccatgcaaattaaggcagaaagtttgtcattttgatcatgtttgatgactcagccaagttcttttgttacgtatcatggaaaattactttaagattcttcaaatacgtaaacactaaagatgaaaaactataatatgagagagcatgcaataaaaaaaatcatatcctacccaaataattttcttttctgaaggaaatgagttggaaagttcaggtttagaaatgtttgtctcttaggggaacttaatcagttaaaacattccatcaggtttgaagtagccatcttggagtccacttcttttttccctgcacttttacaagtacaactaacagtgtggcatgctctgcagagaagggaaacatggaagttgagccattcccagagcccatgtttagagctgcagtataccacctatcttatggaaaaaggcaacatagcaagaattttccatgtatgtcccatttttgagattggcattctgctttcttttcatgttatttaaagttttaaaagattgacctttaggagaaacagacttggtaattcccaagaaatttctatgtgctacggataagctacccccaaacgtgccctttttgcagctgtgtaacaacaaggtgatgtgtaaatgtgttgtttattcttctgtgtctaacatggaaaatgtgacattcgtctgtgtgcattcatgttcaatcccaaaaatccctgacatctctttcatcatttattgacatcccattaaggttctagacctacaaaaacatttgtttggagttaacagtcccttaaatgtgaacctcagtactttataaggtcacagacagagttaaaaagcagggtctgagagtgtagaaaagagaacatacttgataaatctaccaaatgtacctaattcttggactgtgggggcccttgggacaggaggaatggtttttcattttcacgggaacgtgggacttttaaggacattatatcataggggattttaaaggagtcaccttaaaataattatatactgaactttggaagtccctttgtaccatttacatgattatccaactgggagatcactttcaaataagttaacctacttagaggttttaattattgtgtatctccttattaggggcagtaacagatacaatattcatcttggttctaatattttctgccttttttatagcataccaggtataacttgattttggaatatttagaaatgagaactaaaatttacttctgtagtagtaatttttttaatcttcaaagggtttttaaggtcttatatgagtctataagatcctcataacatctcaattacaattacaaagcaatgaagaattacacaatacaaagttgaaatttctttttccagaccctaaaatccagactttgcatattcttttgtgtaaaaataagagcaagaaccagtataggccctgtgatttccagaagtgcatctgtgaatgcagtctaccctaagacaaattggacatttagaaacaatgaattttgaatacttattaaattatttttggaggaagcattcccctaaagaagaatatttttcataatatagagctttttggaaacagaagcagaattttgagtgttctcctttcatctattttttttaatcctatattgtaatctccacaagtgaaagccagattttctgaagcaaacttttcctctttggtttgttacagctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggtaagtcttttattttaaatatcctaatttctaccaaaaggtaattatagaaataattgtcattttctattgaaaaaaaatgttattatatcttatatggtgacaacatcactgttgcaagataagctaaatagcaaaataaccaaataattttctagctagataatgccaaaaggtgtcccttaacactacataaaattttttatgagtaacgtgaccctaattacaaatatactatgtttcagaaatctaacttcaattattgaacaagatgtaagttttaaaatgtaactcactgtgattatttaattgaaatacttatgaaataacccaatggctatcaactgatgacaaatactttctttgttgttttagttccagagattttaggagagttttcattttcagaatgtttgttattaggttgggtacaaaaataactgtggtttttactatttttaaaatggcaaaaactgcaattacttttgcaccaacctatttcgtcttacaataacccattttgaatagctgtgttaaaataagaatttgaagtaatgtgaggaaaagaatttattgtgttctctgctaagaaatggagattggaaccaggttgtttatttctgattaatccgaagtcatttttgtatttgttttatccaatgtgagtcttggtgtcttctcattttctgagttagtaggttagttcttcctcccattcactcctgtggcctcagcctaggtcaagtaattattttatacattttcttttaagccattacattttttaaaaattctacagtattttccctttatgtagtcaggacaatttgttaagttggacaatttgttaagttgttaagttgtactattttgtcctcttgtcccagaatggcattttctgctttcagtttcttcagaatgtcctaggacctctcacttaagggtttcatctttttcaaacgatattgctcactttttagcatgacatggaaatgagaagagaggataagagtgtgatatgagtatcattgggaaactgttcttcttgttaaaaatcttgtggacttatttctccaataatcactatggtttgataactaaccattgtgattgtatagaacatattttcttctccaaaagtcttatgggataacttgaagagccttctctccttatttcctttccttctttcttctcctcacccccctccaccacctcctctcatgaatagagacatctctggtgccacatgtggaccgcttctccaaattctagtgtggtggggtgaattattttcttagcaggagcttcttccatttaactctgcacagggcctcagtgaccatacagtcagtcagtcaatgctttgtgatgcctagtactgtgcttgacgtgtagggtagagatgtgacctgatggtggacacaataatggcttctcagtctggcctgtaaaatctgacctgcaccctctgtatttgttgtgacaggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatggtaagttgttagcttcagggtccccttatgttttgggaaaggtattggaaccacattttggaaggaaatgccaattggagtatgtttagtatgagaggtgtattgaatatttatggacagtggagaaagcatgaactttggaacctacaaaactggattcatttcaaggctctgaccccctttgctgtgtaaacttgttcaagtcaatttgcttcactgtgcctcagttttcatagctataaaaagacaatattgcaaggtggaagaaaattacctttaagcctataagataattactattgggagactgtcttaattagggaaaaaatagtttgataaactgcttgatgtggaaggtaagtccctgagagcatgggttcaaggagataagataataaaagttgccaaactgctctgcaggcaaagtgaacggtaattcaacagaggcaggaagtaggttctaaagtgaccgtgagaatgtaagctctggagaaccagcagaaatattctgggaggatgttgtcctgttcacatggcatggaatggggttcatgtcaaatatctctatattatgaagagcagtgagacctcagctgacatccggtgtgaaagaacattgatgccttccttgccccgtacaaaccaatggtaagtaatgttagcctcccttcccttgaggccaaattgaggagccacagttagcaaatttggatatagttgtaaaatctgaaatctggaaaatactttagaaagtgttgtctaatcttcatcttacaggtaagggaactcaggcacagagtttaactgtgatctggttgtgaagaatacttttttataggtgtaattagggcacattgtgatgagtacaaggagcatgttaatgttattgaaggctggacttctgctccaaaatataagatgtaattaagcacctctgttattctcagcaagcaaagacttttatataccaaggagacttgttcaaatgagcaaatgatcaccatttgtaattaaagaattaattttagattgtattttaggtatcttgaccatttcataacctatttattgaaatttatttatgtatatttgatgactgttgtctggaagggatggattcaggcttccctatctcctatatgtattgttttgatcaatttttaatctttctaagtctggtttctgcatctctaaagagaggataataatatcaaatccataggatcattgaaagcagtgtctgacacatattaaatagtcaagaaatgttaattttttaaacttttttttagattcagagggcacatgtgcaggtttgttacctgagcatattgcatgattctgaggtttagggctaggaatgacctcattacctgggtactgagcatatacccaatagatgtttttcaaccctttcctcctccctctagtagttttccagtttcattgttgctatgtttatgtccatgaatacccactatttagcttccacttataagtgaaaacctgctgtatttggttttctattcctgcattaattcacttaggataatggcctccagctgcatgcatgttgctgcaaaggacatgatttttgttcttttttgtggctgcatagtattccatggagtatatgtaccacattttctgtatccagtccactgttgatgagcacctaggttgattccgtatcttagctattgtgaatagtgctgcaatgaagatgcaagtgcatgtgtcttttggtaaaacaatatgttttcatttggatatatacccactaatggaattgctgggttgaatggtagttctgttttaagttctttgagaaatcttcaaagtgctttccacagtggctgaactgatcaacaaatgttaagttttgttgttattgcagatgtctgcaagtttgcacaattaaccacataatatttcattgacctgacaggtctgctgcagacttaataagtgaccttgaaagggttgttaggggtcctcattctgaatctatatccaaaattcttttacttcagtggcattttacatttttcggggacaagttatattgctgagataacacatcgtcagcaccattgtgattcagtgacattctcactcctcgaaatattttatttgcatgaattgttggatgaactaattttcccacaagatatggaaaagaagttacactccggctgtgcctataggatgacaaaataactggtcagtaaatctaatgactgaagggacaaatcagtcaagtcagttgttttgtcatcctggatacagtctgtgtctaacgaagtgttttaacctctccatgttttgtattttattctgtttctgctgaatgtggagtcagcttagtatctttataatagtgtaccctccatctaaagtaatatagaatttacgtttctggtttaagatgaaaatagtccctggacagttaattaaatctagattagtttcaactgagatggtaaccacctacctacaagatagatcctatttcaggtatttgctttgcgtagttggcaatgaatagaaagctccatttttaatctctttctctcttttttctagctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccacgtaagtaaaatatcttattatacaggtatgataaagagaaattctaaccaatctagaggaagcaaaggaaaaatttctctgattgtaataaagatgtttttaagcacagaaaataatccatcaaaaacagttagtgcttgtgttgattatattgctctgaaggctcatctctgagcttagtgagagtttgaccacagaatgggtcagaatttggaaaaaccctagacaaaactggctattttaagaaaacaggataacagatttctaatactggatgtctcttacattatgtataacattaaaattagtttcatcattttgtagccagtactcttctttcaaaaaggaagcatcagcttttattttaatatattcattgatcggtacaggaagtcgagtaagaggaagttatagctaaacattttatagcccactatcatggtaataccagtttcttcctttggccatactggtttctacactggagactcacctcttccatgaagtcttccttgatcaagtttccttagtcattttcccttcaagttcctgcagcatggagacacccagattgtgagatctgttctcacccagtggtgtttggttgtcatgaatatagggccccccttctactgcagttcttccaggtgggaaggtcataaaccctccctgctctccctttgttcccaataatgccactgctggaaacaaactatacactcagtaagtactctatagactaaagtagcatatcaagcccttgtagacatctcaattgttctaaaatgaattttttaatagttaatatagaacaggtcttagaggtgaaagagacttgaaacttgctttattgtaatgaagaaaaaaacctgtttgaacccagcagggaaattacaaagagatcttgtacacaatgtgatccctgcccccattttccttttaactctatggtaactcattttatacattctattttcttcactgttttgtctagggatgtgaccattcaatgtagtagaaaggacataggctgaaaatcatgcagacgtggatttgaatgcaatctctgctgtttctagctgtggcttttggttaagttcctgaacatttctcagtgtcagtttccttatttttaaaataagcacaataaagtttaaataaggtcgttgtgacaattatgtaaggtgagttatataaagcctcttgcccacagtaggagctcagaactgccagtgtcctttccttttttactatccccctcttcccacacatgcactccatatagattcgaggagaagctaggggcagcaaggtttgcaaaggagcaagaggaaggagcgggagaattttgtgatacggttaaataaatggtaggaacaaaaagattatagtttttcttactcttctgtcagcatctacgccatgatatcacacagccaaatgttttgtaatagagagtaactctataggaatagagttctattcaaccctccatcctcagggtgtagcaaaatttctggaacataataggtgctctgtcaatatttgttttatgagtgaatgaataaactagtcctaaaacctacaaatctataaaattcattgttatttaggatgtgttataagaaacttaaaacgtactttttcacaaatctttctctgagaaaagaaaagacttacttttgaaggtgtaatggaattttatgtgtgtaaatctttaatttaatgattactaatttagttcactagtgattacaatttggttctgtgacaaaaccacccaaagatgatttaagggacgaacttaggtaattagtctggtgaggacctaagtgctaattgttgtggtggaagaatcgggaagtacattatataaattaagggaaaagaacaggaatctttcattctgctgcctcctcttcatttccagttaagtatttctaggtaggtaatgtgttcctatgataaaaaatttaaatagagaggcgtctacagggaaatgcctgtccttctccctacccttggcccagtctcttacttatccttagttcccagagacaatggtgtcttttggatattttcagagatttttttatataaaaaagaatataagtatttgtatgcccttcttttttatttaaatgatagaatatttcacacttgctatatcttattttttcatttactgtatctttgatataattttatataaacacacaaagctcgatctgtctcattttcctacagtgactgcatagcattccatcatctggatataccagaattatttagcctgtcccctactgatggatatttagattactttcattcttccctactgcaaatgatgctgcaaggaatatgtttttacatacttcttaaaaattgggtatataattttaatcccaaccctgttctactacagaaaacctgatttaaatttctaaatcacatacaaaatcaaacagcaaattcccatttttgtaggagaaaggaatggttattgtgacttgacttcagctttctcctgtggagttcagagaattttcacttgatgataacttcagaaaagctaggcattggcaccatttaatcatcagttcctgaaaacctgaaagaataatttttctatgaaatgtcataacaaagtaatcctgctcttggagtatattatggtggcattttacatctgtacagtagttaaaccctaacttgttttttacttttcactcttagatattgaaaactgttaacttacttactttgtatcttattttttcaacagtgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggtaaatcggttttctatccatagtatctatccttgtcatcctattctgatagtacacatctgcttctgtaccctgtggctgagctccagctcatgtaacaaagaggcttatatccacacagagcctgagcctttccctgtgttttctacctggatagatagctctacacattctgctgtcttctaggtgcacagcaggggtccccatgaatttactgctgctccgccttctctcagggtatatttcagaagttttgaaattagtggctagaagaagtattggccctaaggaaattactctctcttcaattagccagcccacaattctacctggtagaatgaccagatgtttggcaaacactaatggtattctttatccagtcaaaattttgagtattctagaaatcacttgattcttggttttggattgggctgggtttggtacctctcttcactgttgtatatatgttttcttatgtccttcagttcagttttcagtatctttctagtgctttgcagtttgttaactccaccaaatctctatgtatgttttagaaactcataatatagtgttctcaaagtagaagttttggtcctaatggccttctaggctgtgtgaactgagagagccagcttcctcctcataaggaccccttcccttcatttctcctatcagttagggtggttatctccatcaccgtgggcagcacagagaatggaaggagatgtaaaacaagttcaggcactcaggggcttatgtgacatttggggacatatggtaaacacagaaatgccgaaaagcaattcatctgagaatcatttttccccttgcccttgaaatataatatgctgtgtctacagcctggcttggataggtataggtgaggaaggaggatgggaaataggcaactattgtcaaacatgcagaattgactgggtgggggacagagggaggaattaatcattttatccttccttggcactctatttttcttgtcttttttgccttgtttttggatgttagacaggaagttctggttaaatttcagtgggtacaggtagaggcatatgaaaaagaatgagtatcttatatttgaaaaatgagaatattgtgtaggtctatagaatatatgtagataaatgtgtataagttacctatttcaaaaacgtaacttagattcattgtaaaaaacctattagcaacagtcactagaatatttagcatttaaaattagtttttttttctatttttgtgacacaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaagacttcagaaggatatagaaatgggaatgggtaactcaaagtccagggtaggtatcgaaaacttaccaagaccttaaaataaatgttctgtcttttttttcttgtcttctgatgtttgttcaataatttttatgtgtgaacttagaagatgttaaaagtaactgtctagtccacagtctttcacagactaatactaaatattttcatgatgtttcaagaagtcactgagtcgaggccctgcttttgatcagaacatcatataaactgccagattaaaaacaaacaaaaaagcctttaacttgttaaaagtaaccagaaaagtcactgttagaaaacactttgtttttgtatgttccatgcttctcgactgttattctgaagttaaatagtttaaacttctagccttcttggtttatgtatagttcaccaccaccatattctccttttttgtagaaactttttatttgactaaataatcttttttccattagtgtcataaaatagatacaggcccaagagcatcctcaaataaccataaatactcattttataaataagcaagaaacccttgagttatctcagttgagtcatagtttaacaaagaagataattttcatgatcatactttgttatcatgaactaactttcagagatagaatggtatagatagaaggatgtgagtgaacctaaataatagggaatgaggcagacaggaacaaatgtgtagagttaaaatataactttttctaaaattatgaaaatggtctgtagctataacatcctaaaagcccacgagatatcaatgttatccccataaagcataggccttcctgagtgaaggtagatattttttctcgttgaaactaggcgaaaaagttaagattagtgcaatttaatttattgctttttaaaattgttgtgaatcttcaagaattgtattctttaagaaagtgaccttttaaatctttttttgtttgacctggatatgggctcttaaggctattgaattacaagtcagcgattggttgtgacagcccatgatttaaaataatacctcatgtatgtagtgagaagcagtataagacaaagaagagagcttcgacattagacctggatttgaattgtggcacttagggcttattaacaaggaacatggataaatcacttcactactctgagccttaattgtccacgaattgtagacaattgtctaactttgtagagttgttgtgaggattacatgagatctacaaaattccagcctcaacaaatatcagtgcccttcctcattcacagtttacaaagtgctttcctgtacatttgaacctcatgcaacgctgtgaggtaggtattatcattattcccattttatagataagacaattgaagctattcagataatttgcttatgcaaggtcacattaactgaccagtgtggggtaggtgcagaattcaagtattttagcatcagatgcctagctctctctgcggcacctggatgcctcatgttcagcacctgagtccacccttggttactggcccacttcctctcagcgaggtgtaccttcagctgtgcggtagctggtctcttaaaggagccaggctctagttgtcatcctgggcagctcctgctgctactgaaattgactttgctttgagggacttttgtttttctggggatttattaactgaagctttattgcaaaaaagaaagtctctcaagtgtgggagctcacaactcttgcacttcacagaacacaccttgagttttctttctgtaggcaacaggtctcactgacttcattcctgatattatcataatgtagaagggaaaatactaaacgtcaggttgagaagagcacacgcagtaggcttgtggctacctagaccactgtaaagaaaatacagcctgttcacaggaacaagaaggaagcattacatttaggctgtcctctcctgcctgtatcgtaccattgacaggaaagaatagcttttctcagagaagatgctggaaatagaaagttggacactgatctctcaggaggcttgttcctcgacttcccactcttcccatatctggttaaaaactgccacaataaataataaaattttgatttcatttttaaaaattttgcatatagctgtttacatctctttaatattactcatattcatagatactcttcatgtattgaatgcagcagaaatttggagaaattatacttttctatttctcttttttagaagagaggaaggaacctcaagaaatctttccagctaacctagacagctaacctcagtcagcaatcagatactggcctccagtggccgattggagaattaactttgttagctaaggttttctccaggcacaattgtaagagaacaaatgaaggtccttgcctatcagtggcacttccttatctcttagcatcccacaccttcctgagttataatggtgggaagttaggtggtgaggtaaatcatctctttggctagagggccatgtgtttgaatcacaccttacagtggcagagcttggccacagataagaggccctgctcgtatacatgaagactaggtattacctgtgtgttcctcttgcttcctgttcctacccactcaaaagctaaaccttaaaaagaaaaagagagaaaagaaaaggaaaccaaaattctttagcccaattctctccaaaattgtgaacctggcttagcataaggccaagatgctttggaagatgtgttattttggctaatattttagggctgcaaaataccaaatggtgccatctgaacctgcaatatgtttctattcaaatctagaagaggaacttaggctcaggaacagatcaaacttctatggaatttggccttctagatgccttgagtacattttgataaagtatacaaggtccccagggaaaattatgtttattatgagccaatttttaacatatattttccattaaatagttctattacagtagtacatcctgccaacattttgataaatgtgagcatattgctcacagtaattttaacctttgggaatatattacatcacttacaaagctcaacttccacaaaatgtttcttgggaatgttgactccagaaatgttatcaaggagaataaatggattatattttttattccaaatgaatgtattctaatttactaggttaattgtattttttcctagttaaacctcttcactcagtctaactcaagagtttttgaatcacacagttttaacagcattctcaatcagccaacacgttatcaggtaagcattcattagacgtatctcttgatctctatgtgattccatatatgtctgcgtgtgtgtttgtgtgtgtgtcatgagttgagttatattcttgagatataccattataccatgaggatagttcagaacaaagaaaatgattcaacacctgtgaaattttttaaaaaaaaattaaaaataaaagaaaatagtatgttagttggaggagactttagaaatcagagtccaagtccttcatttttttaactaagagttcctctcacaatattgaaagcaaagtgttgctacaattgccaaataatgtataacttaaactggagaaagcagtagaagacagagtatgttagaatgaataatgctcccatggcaggaaaacttgttttttctctaggtttttctttcaggtgatccattttttaaatggattgtttggctatactgtttcatgagtgctactttaaaatatcttttgcattttgatactggatgtgacatttgaacactattctccaactcaggggaagttatagccctttgtttttcatctcgttgatcatttcgatcatcaagtctttgactttctaatgtgtataagttcacaaaagtgacgatcaaggaatttataatatattggtgatgtccgttactgcgtattgttctattttttatccaatttttttagaagcagtaaaccacaaaatggctcagcccactgattgtcaaagtcttttttttaagaaaatttttgtaaattttacatatttgtttatttttgttttattggttttgtctaactttatttttaattgataaataattatacttactcattgtctacatagtgatgttttgatacatatgtaggaatcagatcagggtaattagcatatccatcatctcagacatctatcatttctttgtgttggtaacattcagtatcctccttctagctatatgaaactatataatattaatatatcattgttaactatggtcatgctatagtggtatagaacagtggtccccaacctttttggcaccagggaccggttttgtggaagacaattttttcacagatggggtggaatgatggtttcagggtgaaagtgttccacctcagatcttcaggctcttcaggcattagattctcataaggagtgcacaccctagatctgtcacatgtgcagttcacaatagggttcacaataataggagaatctaatgccgctgctaatctgacaggaggtggagctcaagcggtaatgctcgcttgccagcctgtcacttcctgctgtgcagcctggttcctgacaggccacggacagatgccagtccttcatctgcgggttggggactcctggtgtagaacactagaagttattcctcctatctagcggtaattttgtatcctttaacaaatctctccatatccctccctaccccttacccttcccagtctctagtatccttcgtcctacattttacctctgtgagatcaactttttttagcttccacatatgagtttatgagttagaacatgcggtgcttaactttatgttcctggcttatttcacttgacataatgtcctccagttccatccatgttgctgcaaatgatgggatttcaatcttttttatagctgaattgcattccgttgtgtatatatactacattttttatacattcatctgctgttagacacctaggttgatttcatattttgaatattgtgaatagtgctgcaataaaacatgtgggtgcagttgtctctttgatataatgatttcttttcctttagataaattcccgtagtggggttgctggatcatatggtagctctatttgtagttcttggaaaatcctccatactgttctacataatggttgtactagtttacattcccatcaacaacatattagagttccctttctctgcattcttgccagcatttttttttttgtctttttgatagtagacattctaactggagtgagatgataacctcattgtggtttggttagtgatgtcgagcattttttcatatatcattgaccatttgtatgtattcttttgagaaatgtctgttcagattatttgcccatttttaattggaattttttttttttttttttttttttttgctgttgagatgattgagttccctgtatattctggatattaatcccctattggatgagcaatttgcaaatattttctccaattttgtaggctgtcttttcactgttgttttttcctttgttggtatgaaccaaaccaagaagcctttggtttggtatgatcccatatgtttatttttgcttttgttacttctgcttttgaggtcttgttcataaaatattttcccagaccagtgtcctgaagcatttctcctatgtttttttctactagttttatcatttcaggtcttacatttaggtctttggtccattttgccctgatttttatacaaggtgagaagtgggagtctagtcttattcttctgcatatggatatccagttttcccagcaccagttattgaagagactgtccttttcccaatgagtgtttttggcatctttgtaaaaactcagttggttatagacacatggattaatttctgagttcttaattctgttccataggtttatgtgtctttttatgccagtaccgtgtagttttggtttctacagcctggtaatatattttaaggtccgattgtgtgatacttccagatttgttctttttgctcaggattgctttggctatttggggtcttttatgattccctacaaattttaggatattatttctatttctgtgaataatgtcattggtattttgataggagttgcattgaatctgtagattgctttgagtaccgttgtcatttttaattcttctgatccatgagcatgtggtacatttccctttgtttgtatcctcttcagtttctttcatcagtgttttgtagttttccttgaagaggtctttcatctccttggttaatttatacctgagtattgtaaatggcattgccttttttattttctttttcaagtagtttgttgttcgtgtatagaaatgcaactgatttttgtatgttaattttgtattctgctactttactgaatttgtttatcagttctaaaagttttttggtagagtctataggtttttcaatgtatacgatcatgttgtctgcaaacagggacaatttgacttcctcctttccaatttggatacccttctttctttctcttgcctaattgttctggccagagcatccaatactatgttgaataagagtggtgatagtgagcatccttgtcttgttacacttctaaaaaacctttcagcttttcccagttcagtaagatgttagctgtgggtttgttgtatgcctttattacattgagattctttctttctatacctaatttattaagattttttatcataaaggaatattgaattttatgaaaagcttttatcatctgttgagataatcatacagtttttatccttcattctgttgatgtgatgtatgatgtttattgatttttgtatgttgaaacatccttgcattcctgggataagtcccactatcaagtgggattttgatgtgattttggatttggtttattaatattttattgaggatttttacatctatgttcatcagggatattggcctgtagttttattgtgtccttattttggtattggggttatactggtctcataaagtgagttaagaagaattccttctgctttaattttttcgattagtttgagaataattagtattaattcttctttaaaggttcagtagaattcagcagtgaaaccatttggtcctggactttattttatttttttgggagatgttttatgcactcatttaatcttgttacctgtttttggtctgtttagattttctatttcttcttggttcaatcttggtagattgaatgtgtctgtgattttatctattttcccaggttttctaatttattggcatatggttattcatagtagtctctagtgatctttcatatttctctattatccattgtgatgtctcctttttcattttctgattttatttatttgagtcatatctctctgtttttaagttactctagctaatgatttgtcaattttgtttatctttttaaaaaaaactttgttttgttgattttttgtatttattttagtctcaattttgtttatttctgctctaatctttattatttcttctaccaatttggggtttgatttgttcatgcttttcttgcatgcttttttcaagcattttttatgcttttttccctttatgtgcatcattagattgtttgaaatctttctagttttttgatggatgtaggcatttattgctataaacttgccccttaatcctgcttttgctgtgttgcatgggtgttggtatgttgtatttctattttcactcatttcaaggaatattaaaatttcattcttaattttttccttgactcattggtcattcaggaatatgttgtttaattttcatgtatttgcatagtttcaaatgtgccttttgttatgatgtctaattttattccattgtggtcagataaaatacttgatataattttgattttattaagttcctgagacttgttttatgtcctaacatatggtcaatcatagagaatgtaccacgtgctgattaaaagaatatatgttttggggttgggtctggtagctcacacctgccttggaaggccaaggcagaaggattgcttaagctcaggagtttgagaccagcctgggcaacatggtgagaccttgtctctgcaaaagtgaaaaaaattagccaggcatagtggcacatgcctgtaatcctacatacttgggaagatggggtaggaggatcacctgagcccaagaagttgagactgcagtaagccatgattgtacaactgcactccagcctagggtacagagtgagacactgtctcaaaaaaaaaaaaaaaaaaaaaaaaaaacagaatgtgtactttccagctgttgggtaaaatgttctgtaaatatatttttggtccattggtcttggtgtagtttaaatctgatggttttttgttgattttctgtctgaatgatctgtctaatgctgagagtgaggttgaagttcccaactattattatattaggatatatttctccctttagacttaataatatttgctttatatatctgagtgctctagtattgggtgcatgtatatttataactggtatattctcttgctgagctgatccccttattattatataatgcctttctttgtctctttttaaagttaaagttttacttttggtagttacattgtattccatcatatggttatacttatttaatcattcttttattgatgaaaatagaggatattgctaatatttagctattataagcaacactgtagtaagtcattttgtatatataacatctcaatcatgaacaaatacatggaattgtctggttaaagtatatttgaattttaattttttagctattatcaaactgatggagcttgtactaacttacattcttacaataaatatatgagagcacctatttcctccctaatttacaaacagtgtgttaccaaaggtttttatcttcaccagataggttaaaatgtgctgctttgcatttctttatcatgaatgagttttaccttcctttttatgtttaatgttatatatccttatgtctccatatatatttgctttacttgaagggctttttgttatcaatgaagaggaattcttcatattttaacaatattagcctttgtgttatgacttaagattgttttttaccaggttattgtgtgtctttttaatatttaaagtattttttcccattcacaactttttttatttttgtatagtcaacgttacaaattgtttatggcgtcaggttttgtgtcctacttggaaagatttttcccccataggagattatttaatatttttaactcatatttctttagttctttcacttctttggactctgaaaatatttgattcatatagaatatattttcatttaacctgtaggatgggaatccaaatatgttgtctttccagattattatacagttgggtgtgttgaataatctatcttttctattgatttgaaataccactttaataatttactaaattcctgtataaatttatttctaggcttttcattctgttccactgatctattcatgctgtagaaccacattatcataattattatagtttaagacaaaaatcaaacaaacaaaacacacatacatgtgcattcttgcacgtgtgtacatacacacgcacacacgcacacacacatacacatccttacttcagggtttttattttacagaatttcctattatttttcctttcattcttttttttttttttttttgtgacagagtctgcctctcttgcccaggctggagtgcagtggtgcaatctcggctcactgcaacctccacctcctggattcaagcaattctcctgcctcagcctcccgagtagctgggactactggtgcctgccaccacacccagctaacttttgtatttttagtagagattgggttttaccatgttgaccaggctggtcttgaactcctgacctcaagtgatccacttgcctcagcctcccaaaatgctgggattaaaggtatgagccaccagcacccaacctcttccttatttctctatttgaattttaaggtgggcttgtctgctggtatctttattttgatcacgttaaggcaaattgatgctttataatgttgtgttttcttttctaaggatatacttttcgatttattaggtcttttgtgtattcagtgacattttaaagtagtccccttattatttatattaattatgattaatttggtgcagttctcacaaaaccaccacatacaaacctttaaatggctaaaagaaaatagaaatttatttctctctcatgttcctaatgtggtacctaacaatgtcagggacccaggctttttccatcgtattactgcatcatgaatggctttcagtctaacattatctcatgttccaagaaagctcctggagctctgcctattatttctacattccaaaatacagttagaaagtgatagagaagaaagttccttcctataagaaatttctgtaaagttgcacaaaccacctatctgcaatggagcctggaaaataaagtcctaatttcaagtggccatgtgccaaactaaaaagctgtggaagagaagtggcagtgtctgctgaagtggattatactatatgtcttggtgtttatcttaatatttttaaacatacttagatctctgttaattgattgatatgtttcaagttttatcttttgatccttcagctctaaactatgaagaaaatcaatatccgtgttttatttacaccattttcccccttcctctcccagctcctgcttgttaaattattagaactgtgtttgttgggggaagaagaataattttcataatccctttaggttcagtacctgggggctatgaattaaactgacaactgactgataaacaggaggggaaaaaaggattatttatgaatgcagtgcacatacctgtagaaaaactcagtgatgagtggctcaaaggagtagttggcatttggggcttatataccaacttaacaagggacaagaagtttgtggagaagggatatgacaaaggaaaaagtgtttgggttgctaaaggtagtaaattgttggaaggtaaatatgtgggagaaactgatagaagatacaggttattttagtaaggtttgcttgtgcagaaccaccttggtgctgactttctgtccccagtggtaatgattgtttttcctcctgctaatctgggagggggagaggaagaagatcttcacaaagggaaatgtatgtcctgtttttaggcagatgggttagggcagagaactctttctgtgtttgctactttttaattgcctttagctcaaaataatccttatgccaaaatggcatattttggggtgacatattctgatccacttcactaccttgtcaggactatagcctacatttggtttagttttagtcccacagttaaacatagtcagtattcaccaccagtcttttttgccataattttctgtttatctctttcttagcttaactttgtcttttggtagttccttcaagaagagtttatgagaactatgttctctgagttattttatgttctaaattagtttctatttctatatatttatattgactacctgtaatatacttaggttataatttatttttactgtatgtgtagatgttgctccagagcctcctgaaatggaatgttgatgtggaagagtttgaggccagcctgattgttttcctcatatagttgaccggaggttttagtttgaatgccccaaatatctttatcttttaaatcctacaacttggtattgattgttctatagatggatctgtatcaatttttcctggcatacactatggcctttctatttttttgttttttaagatggagtcttgctgtgtcacccaggctggagtgcagtggcgtgatctcggctcactgcaatctccacctcccaggttcaagtgattgtcctgcctcagcctcccaagtagctgggactacaggtgccgccaccacacctggtcaatttttgtatttttttagtagagatggggtttcattgtgttagccaggatagtctcgatctcctgacctcatgatccacccatctcggcctcccaaagtgctggcattacaggcatgagccactgcacctggccacactatggcctttcaatatgtacgtttagtcttcttttaatttttgaataattttattgaaatatctcaagacatttttctgctccattattttgaatttcttcttcaaagacaccaatttaaagcctgctgaattcttcttgactgtcttccatatctaccattttttccctattcattttgaatttttcatccatttctatttttggctcctttttcctcaaactttattttttaattttatttttaattgacacattataattatgcatacttatggcatacagtgtgatatttcaatacatgtatacgttgtgtaaggatcaaagcagtgtatttggcatgttcatcaccttgttcatttatcatttctttgttgtaagaccattcaaaatcctctcttctagctattttaaaacatacaatacaatgttgttaactatagtccccctactgtgccctgtaacaccttaaattacttcttctatctaactataactttgtacctggtgaccaacttctccctacttcccattccccctgccctctccaacttctggtagccactattctactctctacttctatgagataaactttttaagatgtcacatatgagtgagatcatatgatatttgcctttctgtacctggcttatttcatttaacattatgtcctccaggtccatctgtgttgccacaaagacaaaaagtcattgtggctgaatagaattccactgtgtgtatatatacaaccatactttctttatctgttcatctgctgatggacagttaggttgattccatattttggctgttgtgaatagtgctgcagtaaacatgggagtacagatgtctcttcaacatactgatttcatttcctttgggtatataccagtagtgggattgctggatcatatggtagttctatttttaattttttaagtatctattcaatatactgatttcatttcctttggatatatacccagtagtaggatttttgaatcatatggtggttctatttttaattttttaaggaacttccatactgttttctgtaatggctgtactaattttacattcctatcaatagtgtatgagttctctttctccacatccataccagcatttgttattttttgtctgtttgataatagccatcctaactagggtgaggtgaaatcttattgtggttttgatttgcatttctctgatgattagtgatgttgaacattttttcatatgcctgttgtccatttgtatgtcttcttttgacaaatgtctcttcaggtcttttgcccatttttaaattggattacttgttttttgctgttgagttgtttaagtttcttatatattctggatattaaccccttgtcagatgtgtagtttgaaaatatgcttgatgtaatcccatttgcctatttttgcttttgttgcctgtgtttttgaggtcttatccaaaaactccttgcccagaccagtgtcctgaagtatttcccctgttttcttctagtagttttatcattttgagtcttacacctgagactttattttgaaatgatttttgtatatggtgagaggtagaggtctagttttatccttctgcatgtggatgtccagttttcccagcaccattcattgaagagactgtcctttccccaatgtatgttcttggtgcatttgttgaaaatcaggtagctgtaagtgcttcctggttcatagacaactgtcttctcactctgtctcatatggcagaaaagggacaaggaagttctgtggggtctcttttataagagcactaatcccatttgtaagggtggaacctaatcacctcctaatactatcacattggaggggtaggatttgaacacatgagcctggggtggacaaaacattcagttcataacaatgagtaataataacaattgtttagttgttagagattttttttcatgcagcctgattataataggtaagacttacctttaaaactattacagaacttggaggtgggcgtggtggctcacgcctgtaatcccagcactttgggaggccaaggtgggtggatcacctgaggtcaagagtttgagaccagcctggttaacatggtgaaaccctgtctctactaaaaaaaaaaaaaaacagaacttggtctgctaaatagggatttttctttcaaagtgataactcttagaatatactaattctaatgaggctatcacaactcagaatatttttagaacatctttaaagaattacttttataattagtccataagactcaaaaaatgtttcatttttttctagttactgaacttagctaattattcctattaataagacttagtgccatgactttgcatttttttaaaaaatgatcacatccaacttcaacaaacatgtagccatcaccaatagggtcatcaccttatgtgttttatatccaaatgagggtttttttctccaaaacaatttcttcaaagacagagattcaaatatgccccaaggggccacagcggaagagtttcaaaaatgttttgatcagggccagacatggtggctcacttctacaattccagtgctttgggaggctgatgtgggagggcagtttgagtccaggagtttgaggctgcaatgagctatgatcatgtcactgaactccagccctggtgacacagcaagacgctttctctcaaaaaaaaaaataccaaaaatgttttgatcaatagtggtatttatattaaaattaattattaatagcatgttgaagtaattcttttatgtgtgtaaagaattttttttaactgggcgtgatttttttctcaagaacatactcaggaggatggccatgattaaattctgctaattttaacaatattttatttattatttattataacgatatttgtgtttggttatttcaagttaaaagcacgcagatatgctatgatatgttaagaaataggaatttattgtgagactccactgaagctggactatgagttcttgagttttattctctctgttgtctcttgctggcagatctgctttcacagatgacttcgctttggtaacacccttggtccaaacaaatacagtattggacagtctttggcccaggtggtggactctggtccaatccatgaaggatatcattgatggcttggttttactggaagcacatgagagtttttctctaaatggggcaaaatgagatgttcctgaactccactcacagtgagcttcaggcacattcagggacaacccctgttatatacatgatgttaggttatacagatacaaagatataagtcatgccttcaagaatctctccattgaagtagaatggcagtgttgaggttaggaggaaggaaaggaaagtataagtagacaaatattcacataacgctacatgctatgtagtatagttatgcctatatatgaaatagaaataaatataaatgcaatgaaatataaataaaatggtttgggaatagagaaaacaaaaatagctcagagcagtctgaactatgtgaggtatgcaggcccagagaacatgagtatgggactttcagtcacagtcccctacctctacccacgcctgagggcagttgtttaaattcatttgttcctgacttgcagcctcacctgttatcttcatgtacctagaatttgtgatacaaagaacaatgtataaccagtcaaaagcttatgttatttcaatgtaagtccttgataaacaacttaggaactgcctcttcttttcctttaaaaacccactagtaattgctgcgaattggagcacatattcagggcaacttgaatctgtgctccccaggttgcagtccttaaacttggcccagataaactctctacttatatatttagtttgcctcagattttttctttaggtcaacagaactgggaaacctacaagagaagatattttaaagtcaatcaataggtttgcaggtccctcttcaaaaaaaacaaaaaacaaaaaaatgcagaaaaaagtaacaggtaaaagtcaatcaagtagaataaaaaacaaatttattctctgttaccccaaagaacagaatttggaccgatagttattttggcttcaaaacaaaggagttgttttctaacagctatagttgtccaaaaatagattaaaccagctgtctggaaaaatagcaggccctcaatcacagaagtttatacagaagctgtgtaatggtaatctttcacaaagtttcgtgagtggtataaaaacatgaaaaacaatgattcccaaggtccttttcctttctaaaattttactctgtacttctgagttttttttctatttgtctacatcagtcttattacccttcattcacactttttagattgttaaaattcatagtacaaaatctactaataagagtcaaatttggcttctctgtagaattaagtgagagaatgaatgtaaaagtacctgatagagtgcttaacaattattagttgaatttgaatcagtaaaaataccaagtgagaagaaaaactttcactcctttcaggaaggaagatatctaaccaccccgcagctacccaaccacccacatcttatttcttctcccagtcttaacggagggttgaaaaatgaacttgggtttgtttgcaggaaggactgtttgaagtaagtaccgcctggaatctttacctggttaccactcaatttcagttttggaacctctctctaggatttccataccctggacagagaaaatcaatagtctttatagagttagaatgtcttccttaaagagtgactcacaggcttgtaccaagaaagctatataatttctggaggtttgtggaatgtggaagttaatctatagacttcttttgtgttagttagttagcaatttgagcaagagggaaaaaagatgaatctgttattggtcagtttaattttttgtactagctttaattaaagaatcagttggaaatttagttaaaggtagtatttaaaatggtacttttacttgttacatatgagtttcatggtccttgcttgtggtaccatcattaagatggatttatcaagatttgctttacagaagcatagataataatgaaagaataatagttatattatttgagcacctactatgtaatttacatgtattgtctcttttacaagacactgtctagcatttccattacacagattaagataccaaggttccagagcttgtgaatgatggagtcacaactcaaaactacatgatttgttcttgcaactcacagtctcaactgtgttaaagaaaaccagagccagacagcagctaaagtggtaaaaacagattttattcaggaactattgcgatagggggagagagacctcaagagtctttgttgcctattacacaatactgtcttcggtttactagacaagcttcctaatagaatggggatggccaatctttgtctccttctctgagctgcagatcattttagaattctcatgaactatctttccaacatgaacaaagggatggactattaccaggtagtgtcatgtgtggcgaaactgatttctgtctaatctcaggtaccttcttgccttgtgcagaggctcaacttgtctcagcactacttgttaaatagtcatttcttttccaccaatttgtattactgcctttcaagctgctttcaactgatacacataattttgtattttcattttataggaatctgtcttcactgtcccctaaatttaaccagatccctgatatgttcacccattattgtgaatggttccatatcaatatgaagtttcactggactggggactgtgttcactgttgtattcctagcacctggtacagtacctgccacagaattggctctcaataaatatttgctgaatgaatgaatcagtccagtttaagatccatccagctgtgagtctgtcctgggatctagattctacaaaattcaacaggttttatgtcttacagtgactggaaaaatgagcttttccttttcagtagcgtgggccctctcagtctgttgttattctctgcataacattttgaatcttcctggattcttctcttttacttgaccttggcataatttctactttcttaaaattgaagtatatattttctactctcgctatgtctgcattttagttcaggtctttttccctttcctttgttatcttttatatacaacatttgttacatgcttaagaatatgtataatgcaaaataaattatgaagcataattacattcacacctatgaaaccaccaccgacctgacaatgataacattatccgtccattgcctctacttatatgcaccttgctacctactcctctgcctccacctaagagttaatccctatcttgaagttgggtttctcctcttcttgctttgattttcttttcaaatataatttcttatatgtgtcagtattcctaaaaatatattctacagatttacttgttattgagcttcataagaatagcttcatactctgtggtcttctgcaactggaatttttcattcaacattatgcttctaagattcatccacactgttgtgtgtggctatggtgcattaatttcattaatgaacacaataacattacattgaaaatactgcaatttgtctattcttgttaatatttgtttagattgtttccagtgttttgcaatttcagacagggttgctacaaacattgttgtatgtctcttggttcatacctacaaagtttctctaggccttttactgagaagtggacttctagctgaaagggtatgtaaatgttcaactttaaaagataataccacctggatgcagtggctcatgtctatagctccagctgcttgagaggctgaggcaggaggacagcgttgagcccaggagtttgaggcaagcctgtgcaatatagtgagactccacctctaaaattttgttaatagaaatcaatttaaaaactaaaaagatagtactaaattgtcttcaaagttgtctgcagtcttgccagtaaaatataaaagtccccattgatccatatcctttctaacacttggcataaccagatttattaatcgttctctttattagatgtaaaattgtgtctccttttagtcataatttgtatttccctgcaacagagtttgaaattgtttcttaagcttgttgacccttcacgtttccatttctgtgaaacatttgtttgtcttttgcccattttaaaatcgggttatttgagtttttcttattgaattaaagttctttatatatttggatataaattatttttaattacaagcattaccaatattttctcccagtttatggcttgccttttcactttctttatagtatctctttaaacagaaattttaaattgtaatgaagttgaatttatcagtcttttctattgtaatcagaagttttaatcttgtttttttaaaaatacaggtctaccccaaatttataaatatactctcttatataatacgttcttttaagggttcagaagctttgtctttcacatttaagatgcaaatggaattaatttttgtgttcatggtatgaaatagggctccaatttaattttttccatatgggtaaacagttatcctagaagagcatttatttagactgaaaatagtcacatatattgctattagagaaacgtatgcaatataacaaaatatatggcatttagaaaacataaaatataatacttacagtaattagtatatatacaaattttaaagaaaagatattggaagggcatacaccaaaatgaaaacagtgattatctttggctggtgaggttgccaatgatttcatttgtttattttgttcttctgtatattttccaaattctctatatagagtatacattgatgtatttttctaaatactgggaaataaggtagtgtctatgggtgataatgtggtgtcaatgtaatttaaaaagaaactattagttgaaagaggagccatgaattcaaatcttcaagcttaacttctttttaaaagcttcttccgtttctgaggcaaaaaaaaagtattggtggattatgcagtaagtctcagtagaaggcattaagagagttaagttctgaaacctgcgtaatttttctatacatagttataaaatttttttctcccctgagttgtttgctttacaggtatgtaagcctctttggaaaataggattggggcacttatgtatatcattggagatctaatcatttacttttgcccaacagcagataatgaaaagacttataaagcggtatgttttgaaagcacaagtagacaaagaaaatgatgaagttaatgaaggtaagcatctccaacttaaaaaatatccttttatagctaacttaatgaacctggaaaacttaatgttgaggcatattttaaaaatccaatcccaggttatagtttggatgcctctaagatgggaggaggatcttatgttacgtttctaaaacttcatcttttaaaataaacagttatttacaatattgatcagaggcaatttatctctactcatagtgccctaactgattcttagaatgtaaagactgacatctttctaggagttttttaatccttctgacataaggtagtcagtaagtattggttacattttcaatgagttcacattagtgttaacatttttccagttaagcagataaaagaacagtgactcaaacagaattcatgtcttcaggaaaacctctgttttattgttcagaaacacatttttaacctgtttttcttgtctggtgcgtctcttttgaatttcactttcccccctgcctccttactttaagcaagcttatttttttaaggcatatttgaggcagggcatctctctggactataaaaattttttaccaaagtctaggatgtagagctaaacacaggcccagagttggaaagaaatcaaccagggagaaataagttgccctaaaaatggaaactgtaccttccaacaccaatgagatgccactaaatctatctacactgataaaagaggaaaggactaaacttaataaaattgttcataggctttgaagccattacttgattaatacaaggaatgcattttaaatgtaaatcaatccaatagtgtatgtatgtagaagagaaacctgtgaatttataatcgataactagcaaaaatctaatcatggtgacctaatcaatctgtctcaggagaaaggattggaatgaggttgtagtttagaaagcagaagtctgatgagttgtaccgtaatctccatggggggtggggagggaggaacaaagtgggaagaactgtatggctaaaacggcataaaaaacaagaagcatttcccaagcccttgcacaaaaggggaaaatcaatgagaatttggagttttgaacaaagttcttactaagaaaatgtgtcatataatctcctcatttaattaatgaggaaactaaaatctgaagagtttgagtaacttgtgtttcctgaattggcagattaaatatttaatacaacacataggttgtagtctccccatgagtcggggacaaggaagaaaggatagtagaaggtgaagtagggcagggggtctcctgcggtactgaatggtgtgagaatccactccttccactgaagtctgcctcatgatttcaaataagatcagtttattccttttatattgccatatgccaaaggaagcacttttttttttttttgccacaaaagggctcctcaaatgttttgtgtgtattcctgagttagaattcttttcaaataaaaatgctctgacttttatataatagaagaatattgaaattatactttaaagcatattaaagataccaggaaatatcatcaaaggtgtgttttaaatgccattttattataaaaacctaagtcaatggtttgaagaatcatttcttagattcaaggtaaattcttgctccaacattcacttttgaaggtcagtggtttatctacattacggtcacttgcaagagaatccagtgtttcttttcttttcttttttaaccaaatactgcctctccttgaagagaatccagtttttaattgcaatatacgtatgctcaaaatactgccaaactgaattatgggagcaatttatttttatagcccaaactctcctattctcttcaggaatatattgtcagtggtatcatatctaaactcctcaattgcactgttgcttgttacttccttacgcattagtcctttgtgctggacaaactaatgtcttcatgtccattgccattgccttccctaataaacactccttactcttttttctttctttcccttacttcatatttgccttgaaattatttgcctgtcagatagattgattcatttttagtaaaatttagtttttctaggattccctttgatcctagcaatgggagatatttgatgcaggtgtcaacctttacacttgaaagaaacaaagggactcccttgtagtcagaaaggagatatcttggctatagatcagttaacagagaatcaccttatgttaaaatgtaggtcaacaaaaggacaatactttaagctgagtgttactttaaaaaatatagctggactatttttatagcttttttcaaaggtcagtgtacctttaaagacagatgtttcttaaatattttaaagaaaaaactttgaagtagctaccttggagaccttatgaagcaaatacattgatattgtaagaatttcactctttgttcatttctaaatccaaagagcaacttaccaataattttttaatatcaatactataggtgaattaaaagaaatcaagcaagatatctccagccttcgttatgaacttttggaagacaagagccaagcaactgaggaattagccattctaattcataaacttagtgagaaactgaatcccagcatgctgagatgtgaatgatgcagcaacctggatttggctttgactatagcacaaatgtgggcaataatatttctaagtatgaaatacttgaaaaactatgatgtaaatttttagtattaactacctttatcatgtgaacctttaaaagttagctcttaatggttttattgttttatcacatgaaaatgcattttatttgtctgctttgacattacagtggcataccattgtgttgaaaagcccaatattactatattattgaaacttttattcattttagagtaaactccacatctttgcactacctgtttgcctccaagagactatcagttccttggggacagggaccatgtcttattcatctttgtgtctccagcatctagtacagtgcctggtatatagtaggtgctcaataaatgttgaaaccaactgaactgccaacaaaataaaaataaaaagtcttcactatgtagcataccttcccttgtccaagttctgaagaggttttttttttttttttttaatagaaactgaagacattttacaaccagctatgacttggtaagacattcttagaattttaggtgtcactgataatcctagaaccactgagccccaagtgaagaatttaacaacaaaatgggttaatgaaaaatataattacattgtatatttaagtttcatagaattatttaaaacaacacattaaagatttttctaaaatatagactgcttgctttctgtcttagacttacgtttgttgtttttcagtaatgtgattttcttttaagttgggggttatgcagggttgtcattttgttataaccatctaatttctgcctctgctgctttaatgctaaatgagatatcaacagctgacttcatatctcacctgtgagctccctgctgagttttggagggtctgctcatgggaagaaataggaaagagcagtgactatgggcgtacttggaaagacatggccaagcatccccaggtgtgtttcagttccttttggggcatttattgccatcgttgcttacaatgattgacatctttgtttcttatcaaaggattccagttccactttctatataaaatatattgtgatatatctacatatgccttattacataattgtgctgaatgctggtaatatccgcaatgcctcttgactttaatgggaaaaggcatgcagaccagtaagttccccagtcacttcagagactataaaacactcaaagcattttttaaccagctaggtttaaatctctcatagagttatgtttaacatcctgagtctcttcagtcagttgctgtcaagtcgtataggaatacgaattgtgatcatagatcaaagattttcagaggtccttaaaaccaactaaatacatgctactttaaaatcattgctatcatgcagaaaagctctttagacatgaagacagaaataagtgttaaatggaactacataaagctctttaaagattatttcttaatttctactttttgggagttaaattaagaaaggaactttataaatgttttgctaccattgtagaacacttcattaacttttgtgccatgctaagagtattcgtcttaaacatttttcaaactttatgtactttatgttgtgtctcagaactgaataaaatattgaatttttccattgttatatgttaccatatgttaagatagtaaagatacaaagtttctataatagatgtttctgatagttttatagtatggtccaggattccaagtgtgaaaagtttttgcttatagctatggaactgaatattttgtaattttcttctttgcggttggaaaaatgttgaatgaaaaagtggcagattcagctggggacattcagcctaagattcttggaatctgaagatcagagaagtatgaagataagcctcatggtatccacaccatgtggataaaaagctgacttttttttttttttttttgtccatgcccctcacaactgtagagctcttaacaggcattttttctttatttactatgtacaaactggtatagttttaatatttcatctttttccttattcatcatttcaaggtgttgtttcagaagaaggtgtgatgacaaggtgtagtgagtgtggttgatgtttttgatgccctgcccagatgccctctactggaccagtgcacctgtctcccagattctcctgtgcagttcctagccaatcacttcccctggagaattgccctcagctaaaaagaagaagccttgctcgggatgtgatgcctccgcctccccatggccagtgactgatgggtgggggcacaaagggctggccccttgtctcaagatggggccaactattcagtgcagttcatgctccagagctcctgaaaggattagggtgatgccagactcaagctgagatgaaatcctggtttagattcttcctctgccttttccagtttccttccttccctttctcca

SEQ ID NO: 16290 - DNA, 10783 bp, Human
tcgatgcagcatgacatacaaataaggtaaagtcccaaagaagtggtctgtttaaatgaaaaatgttaaaagagaattagaagttaactgtgtatgtactttaatttcaaatgcttttttatatctaaaaatatttgagatataatggctttttaaagtaatgcttctatttcttttgacaaattgaactttctaaaactaaaagagtctttttatttttaaaacacaagtagaatgatttaaataggattttaatgaatttttggcaagtggctgttttaatttttaaattgagaagtaatatgtggaaaattaaaatatattcaaatgtattacaaggtacataaacacataaacatgtagaccgctttataggcttcaaaatgtatttttatatattaccttatttgatcttcacaactgttgtaaaatttgtcaaatcatataagaaaactgattctcagtgaaattttgtgattaagaggacatgctaatattttgtaaagctgggaccagaacccaagtactggtacttgctttgtgtcctggttactatgtatgttgccagctagtggaaataacctaccaattgttttttctaggagataggattgatttgcaactgatattccttttgcttggtagtgttttatgactctgctgcagtttgtggaaatgctggacttggctcagtgctataaattgtagccaggaaataagaagagcttacacagagtcgggggatcttaattagacatgctgtaaccagtggagctattcagcgtgcttcaagtgaagagtgcagaaatagtgatgccatcttagattttcctacactagtatcttctagatctctttttatcatatatgacattaaggctacagaagttttgtgcattaatcttaattcatatttattaatttcaagggaatattgaaaggttttaaaatggcatacagataatggaaaataagctttatgtttcaagaagggcagactcacgaattttttagaaaacagtgcttcttaatgatatgctattatacttattagttatgtgcaagctttgtatattcttatatttatatataaatataaaaatttgttaaaggcacgtatagttaagagagttttattttaataaggtcatattgtttttactatgtttaaaaaactttacttctgaaaggaacataattatatctaggtcactagaacgtcattgtgttttttgttggttgccacagcttggggaaaaatagaaaaaaattaatgactgtatttgaatattttgtaatgcactgctatttattatatatatcaacagtagttcaaggtgccatcttaaattaattgcatcttcattaggaaaaataaaaagcataaaacacaatttctggttactatgaataaacgcctaaatgttaagatgacattacagtcttgacacttgagtactgtattactatgtgagctccgtgttaaataatttatgcacattatttaatcctaacaaccatatgactgtagttattagtccctattaacacataagaaaacggagaatcggagatactgaaaaacgtgccccagattttagacctttggaaaaagtcacttaagctaactagacgtcccagagctaaaggctgggcaacccaaatgatagtcgccaaagtttaattccgtttaattccctaaaaggcttagagtcagccttcggacagcctcgctcactaggtggctcagcttaaaataatcggaagcgtcgggccctaaatcctacctctccccgccccgcgcaggcgttttctcccgccccagccagtttgtttctccctcctgccccgcccctgctcagtttcctttggtttacccttcactcgcctgcgaccctgtcgccttgaatgacgtcaaggccgcgagcgctttcattggtccatttcaatagtcgcgggatacttgaactgcaagaacagccgccgctccagcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggtaaagggatgcgggatatctgcaggagggtgggtcgagcagggtttggcattggcttagcaggcagagaagagtggcgagaaggcatgtcctgggcttttggaagggggccagggtctggagtgcagttggtgctggtgtgtggtttgccacagtaggagttctcccatattagcatcaggaccccgccaacactgtgtgtatgctgccggtctgctctctatagggggcatctgcctgtacataatggggtcaaaccaagctctaaaacgtgtagtcttcgctcagctccgcgcctttctctccacttttaaaccccaggcactgctgtaggactctgacccctatcctcctcacgcttaagagatgacctctactttagaaaagcgtgtacaaaatactttgcttttggcaaattccgccattttagccggatttgctctgttgctccaccctcgggcgacagtggtgaaccaacaatttttttgctgtctttcctaaacttgtcacgtattggcctgtcacccgacccttcttgtggccctgataagttttgcataattccacctagtgttatctattgatagcctttgtgggaatgcctgtgacaaatgggaacatcccttctcttttgaatactgaaactcttctttgtcccagaaagtttaattcctgatagagtatttgggagaaaaagcaaaggccaacacccataagagaaagaatgcaagactagtaggctcaaagccagttattaatttttttttaggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttggtaagttttaaggaaaatctgtgtggaattacggtaattataattattagatgatattaatgatttgcattttaagatgtcttatgtagtcattttgactatagtgagttaggtttaatgtaacaaggcttagaaaggatgtgacttatctcagatctcacagctaacacttgacttggtgacatacaaaaagatccttatccagtgctctttcaggttcactgccagtcacatcaatctaattataattagatcttaaatgcttattttaatctgatcccataaatgtgttcttggttgggagaatagatttcagttttatttaactcacttatatatcacttagtgctatttgaagatgcagtcttaaatattgtgattacataacgtctcttccagttttataattttgtttctataaaaccagtctggattagcatctgataccagaaagtgacacttttcctcctacaagtaaatagttgtaccatggctgtttactcttacccatgtattaaagtagcttctgtaaacagctctttgcagtttgtactatttctttgccctagggatattgagtcactggacagctcactaaatccaatctcattttagttttagttgtattgattgtgaggaaggaggggtgagcaggaaaagtcctttggaaataataatttgtgtgtttttatcaaaattttgcagaaaatgtttaatctcaaggtgatctttgaagtgaaaggaataatggatgatactctttgcttcaaaataatttatactacaaaaaataaattatttatagtgttaatccatttgcccataacaaacctaatttcttaataacacttgttaatagaggccatttaactgatgctagctattgcctacttgtgctttatatatgtcagactctgggatctgcagtttctcttgggacaaatcttagatattatctcaaaacttggattttaaaagtgttctgtcctaacagaaccaccatgccatttgctcctttctgttgtggaagatggatactttaagataatacctgattctcattttcctgttaggggcctaccaatatgtttttttttttttccctcattaactaaaatcattccaaagttctatgtacagagatactgagactagggtaaaatattctacatattttgtcatgagaagctctttttagtttgaagaaataagtgctttgttaatatgagattccttccatggcagtcatttttagctattaaactaaataggcaaacaattaatttaatcatatcttttgaattgtcccagagtcaccacatactatggacatgtcaattgtattagaagatgaaaagccagtgagtgttaatgaagtaccagactaccatgaggatattcacacataccttagggaaatggaggtaaaggttctctgaatccagtttgtataatgtatttgttaaatgtggctaaatgaaattgagaggataatgtttaaatttttaaactaatgaattattctaatgctacagttaagtttatagcatgtagcctctcgtaattaatggtaaaataatctaattgcagtttttacactagaataattttaacactataaataattttctcaataggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcgtaagtctaccttggtttgtttaaaagtgatcacgaccttttgtctagggaagaaattgatttttttaatggtgaccttttaacatacaccaggcagagtcagtgactactttagggatggcaatgtgctggggcttagggcagtggaggaggatgaaactgttctaatctagaacactaattttcccccaactggattccttgaacatgatatagtacactaggttacaaattttaaaacattttccttccaatattactttctggcatataagcagtgtctcttttattaagaagtaaaggctgggtgcggtggctcgcgcctgtaatcccagcactttgggaggccgaggtgggcggatcacttgaggtcaggagtttgagaccagcctggccatcatggcgaaaccctgtctctactaaaaatacaaaaattagctgggcatggtgatgcatgcctgtaatctcagctactagggaggctgaggcaagagaatcgcttgaacccaggaggtggaagttgcagcgagctaagattgcaccactgcactctggcctgggcgacagagcaagactcttgtctcaaaaaaaaaaaaaaaaaagaaagaaaaactaaatttaaaaatgaaaacatgaaacatgttttcctaagacttgtatttcctaaattttcagctacttggtgaactctggcattgttcccatctcgagaagtctcatgcctttcatttacttcctttgactgaactggggaaaatatctcaaaagtcctttattgatttgggccttttaattagcaattagctatccagtctctactagaaatgatgatcaagtgtctggaaatgcagttggtgtggattttggattcattccatattctgctaatgggatttcagaactgggataaggaagcttgcttctcttttaggactgattacttaaaacttttttcattgtagaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatggtgagttaactttcattttgttgaatggtgattctttggtaataattaggggtaagccctaattcctttgtaaaggaacctagttcctttgtacagcagtggtgaagagatttagtattcagagggagattaatgctgcagtatggaagaaagcctactgctggcaaaagataatctatatcaggaaagcactagaagcagaggtctaaggatgacatcttggggatgggtagtcagaagagttgttttttaaaagttaataaaggagggaaaatacaggatgaggatggaacaaaacactaaaatgattgatatgtttaaagatgaggctgtgagatattttttctagagttgctacagagccgttatcaaaggcaggaaaaaattaggttagaaggcagaggtttgacatttgaattctaaacgctcttgtgatcataaagtattttttattccagtttttgggagaattaagtttgatagatgctgacccatacctcaagtatttgccatcagttattgctggagctgcctttcatttagcactctacacagtcacgggacaaagctgggtatgtattacggtcttcacacacctatcttgtgactgaaatgcctgtgccagattaaataataattgtcctacaaaactgagggttgcctagatgttcttacttggaaaaacttcaaatatatatagttgacctttgaaaaacacaggtttgaactgtgtgagtccacttacacatggatttttttccaatcaaatgtggactgaaactacagtattcaggggattcacaacccatatatatggaagggtgactgcaggacttgaatatgtacagatttgggtatatttgggaagggtcctggaaccaatccctcatgtacactgagggatgattatatactgtttaaggcatgttacctgttgaacagtgtttgttaggtagtaagcttagttgtaacttggattgaaaggtgagcttttttaaaagcatctgacctgttgctggcagggaaagtagtagaaaatggatcgagggatggaataatggcctgagaaaactagtagttggaaaagttaaagattagtactggaatttaacataagcttaatgccaactatttactgtgtttggtgtgttactaaaagcaaaactcaggggttctctattcccttctctgtagcctgaatcattaatacgaaagactggatataccctggaaagtcttaagccttgtctcatggaccttcaccagacctacctcaaagcaccacagcatgcacaacagtcaataagagaaaagtacaaaaattcaaagtaagaattaacttggatattgaagcttacttttctagattatggttcagagatctttgacattttaaccttattcatgaatctgccatagcctccttgagaagctgttctctaaattggttatgtgtttgaagaaggttgtagttcatgctttctgccctgggtctgggggagaagagagaaggaagggggcatgcatgtgtgtttcagggaccagacagtgtttctaaaaccatcaagtcggtcagacagaaatagcattttttagttcccaatacatgagtacaaacattattccatgatctcctttacccagtgagtgtttactaaaaatgctttttttttccctacttacaggtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttaccttattttctttggattcttgtctggttccaaaatgatcatttcttcttcttcactatctgagagtattatgggagcatctttgtttttttattaatttaaaaaaaaaaaaaaaagttaagcaatctcttgcaaaatttatttctacatgaatttatttctatcagacgttctaaactcttatttctggggctgggcgtggtggctcacacttttaatacccacattttggtaggctgaggcaggtggattacctgaggtcaggaactcgagtccagtctggccaacatggtgaaaccccagctctattaaaaataatagaaaaattagccaggcgtggtggcatgtgcttgtaggcccagctactcgaggctgaggcatgagaatcgcttgaacccatggaggtggaggttgcagtgccactgcactccagtctgggtgacagagcaagactccatcccaaaaaataaaaataaaactctaggtggaggcttaatcttttctttaaatcagcttcttagagcactctagaactcatctgtaacatttgtttctttaaactcttatttcctacaggtgcttgaatggtgtgacaatttggtacatgtcataatagaaaagctagggggaaatgtatatagcatcttttgtagagacaactgaattgtttgtgctactctattcctccagaaatagttccagtttacattccaagaaataaaagaacccatttcccatatacctttggcattgctggtgtttttaatactgcccaaaatacagtaacaaaaaatgccatgtcatttttctttggattttatttgtattactgtcagggctgaccatgaaaaatattactggccattgtatactttgagaactgctccatgtattttgcccatttttctcctgcttattagttaatgatatacataaaatgtgaattaacccatatcaattatttgtatttttagttttcaattagtttctccctttgttcacatgctttaggaaggctgtacctgctccatttttccaatgcttaggtccaccttcattatattcagttgaaaatattattcactgttagaagaatacactaaacaaacatataagaggtatatgcaagtgcaaggatattaacagtgagaaaatggaaacaacttacatcttcaacaataagagaattgttaaaccaactagttatattcaatgctatacaagtatatgcagcattagcttacatcactgcacagagagtaaataaatacctggaacaagttctggaagaataataccaaatagaagtaaccactgggaaatttgagtaagggtcccaatcaatgggaaattttttc

SEQ ID NO: 16291 - DNA, 37822 bp, Human
  misc_feature (1)...(37822): n = A,T,C or G
tctgagggagacagtgtatatgctatgtatagggcagtgatgaggattgttgtgctaatgtgtgtaaagtgcttgacatgtgggcatctgacctaggtttcagacccattttcagcaagagagtgtcagagggaagcccttgtgaactggcttcccaaacctcagtaggctggagtacaagcaggaaatggtgagcatacaacgttgtttgggtgccccaaatgtcaaattctggtactgtgtgttctcactgtttactccttcctgaaatgaaatgccaacacaaaaatcatttacgttattagatttctgtatttgaggagtggagtattttctttctggaaaacaggccctaggaatactactcaggacttgaataataaataagagaacaaaaattgtttatatgaaaatataccatcaattgagacttaacattaaattgtcttcacctagtagtgataagtagtgatgagaaagccacgtatggacttgcaggatggaggtgggagtatagtctggtatagactagaatgattttctgctgaaagatggggtaattccactaactccaggctttcactaactggactgcaagctcagataagaaggctgtcgccctcaacaccatgcccaaaccttgaaagatctgttattttgaaaacctgcctgcccccaactccctttatttctctgaaattttcttattctttggaattctggtctcttttaacccagaccagcctggtcagcgtgatcagttttgaacaaactctagacagcctccaaatttgctaaaggttttccccaatcagaatcttcattgttgggtcatgggtgaatattttgctgccaggtctttcaggtaaaatgggaggtgaattctcaacccaggaagcctgtgtcactcatcacatatttccctgttatctgtcatcttctcctatgccagtgctcctttctcccaatcctttactgtactcgaacacatacatgctgttcgagtgtgattatacagtatataatggtggagataaatttttggatacagaatatctacaaatgaggtaatttaaaaataaaattttaagtttgttggtttggcacaagttttaaacaccaaactgttgtttttgttgcttctgattgtcattttacatttctagttttgaactgtttgaacatctgaaattaatttgaaacatttcagactgttttgaaccagtctatattggtctaaaccagtaaaaacaattttacagataactatagttatcaaactagtttccagcagttcgatagaggtagaaccagtgtgactcaattgaaagtggatttaatttgtcagcacagtttgatttagtaaaatatactcagaaccaactaaaacttttagaagcctgtcagaacctgcatgtccaagtcagagcctattggaactagctaaaaccagtctgaagcaattaaagctaattacaatgagactccaataattttggttagatatatcaggttttagccaaagtcagaaagttttgtaggagaacctcttttaactcaccgtaaaataatatgaaccagattcttttgaacaactatgaacttgctaaaatggatggtgtattttatatggatttgaacctctttttaagttgatcagaactcttttgaagtaaacatatctgtattaaatgaattgcaaatggttagaaccagccaaaaaggatcagaattatttgaaagtgatctttgttgactcagccgaccactttgagccagttagcaatcgtttgtgctagaaagacatgttttaagctggccagagtcaatctgaaatttgttctagatcttcagacccagtctgaacgtccacaatggggagaataaagtgagccaacagttaagtacccagtatatgccaaccattgtgctgggcactccataaacagtatctcattgaatcctcagaataatggtgtgaggtagtgtatattcttttttatagaacagaaacctggaaatctaaggctcaaagacatccaagtaattggtatctgggagatttgggattcaaacccagctctgcttgacttggtgagtttcctattaggttaccttgtaagataccatactactggtcactttaaagcccaatgtgcatttataacaaaaatgaataatggatatgaagcttggggtagaataggcattggacttggagctaggagatctagattctagatcgtgcaaatcagtctacctctctgggttctgttttaccctttagaaaactgaacccagagagtggaaggtctgaacatttattttcagatcaagaaagcagataattgtcttaaagatacaatctgaaaagtgcaaactatgattaatattgatggtggtgtctataccttcaatttatggtatttggtttgttaacagtccctttatgattacttggtcagtattgctattgtgaatagaaaacaaaactcacgaagatcatttgtagacttacatgtgtgattacccatggaaatgaaacacattagagatagtttcatttaagtctttgaattccacttaagtgagtttagagaattctagaatatgatgccattggtgacagcattttttcctgtaccctaagtgatgtaaaaaacatagttataccaacttttttttcaaattaaaaataaataggaaataaggtagtcacagtgtcttcttgcatcattctcactgcaggatcggtattgttatctgctgctccattcagtttgaggggaagccctcaaatgagtcaacattatctggacttgcttttcaattcttagctcttatttccaataacttagagccaggtgtgatgctgtgatatgacgtgctataatgttgatgtccaagttgtcgttttttggagaggaattctgttatatgtcattaatactggtgacctatacttgcaaatatccaagctataaagacaggtaaggcatcatctgtgaagtgtcactctttatagtgtgcaaatagaattttgaatgtttgtagaggctctgcccttatccacgggctagccatacctgaaacgtgaggttgcagatctgcactgaagcactctgaggaaacacactgcagtggcttttggggctcagcattcaggagttttcagcataaggtgagtccccaagttgaggatggggtgagggaggtaacactgaaaaccagtaaatattcttgtctgagtttttattaattttatggatatatagaaatagtcctacaggaagcactgaatatggcagccaagtttctggatatggtgctgggtaaaaaggggataacgccgggagtcagtagcatccaatgtaggacatctggcatgtgtatagatggataaatatgtatgtttgaatagtcatgtagagtcgtcagtgttaatgagatagctagttgtttttatgattttcaggagagtttattggcattggcgggggaaacggagagaggttggttaatgtgtacaagcatatggttagatggaaagaataagttctaatgttcaacagtagactagggtgactatagttaacaaaaatgtattgtgtattttaaaatagctagaagagaggacttgaaatgttctcaatgcatagaaatgataaatactcgaggaaataaataccctaaataccttcatgtgatcattacattctatgcatgtaacaaaatattacatgtaccccataaaaatatacaaatattatgtatcaataaaattttaatgaaaaagtaaacctcccctggagagagatcccatttctagttggactgatattttgggtttgaatctatttagaaggtaaatacaaatcatgaaaagtgctgattgcaaagaaccaaaaatagccgtggttaggtattgctgatataaatgaatttttcttctttaaggtggacttttgttttagtcggtactgaagagctgaatttttagcagttcttgatagagtacccaggtaaacataggtaagcgagcccttggttgtggcactgtggtctctgagcagtgactgttcaaatctggaactcagttcccaagtgagcagtgatactctagagaagtctggcttaatatgtagtacatattaatagtaatatgtaaggaagcagggactaaatttacttgtgaaataacagtgtctttgaaggaaccgtaataacatgtgaaaatgaatagaataaatgaaattgcctagatgtccatgtaaaaagagagaaaaggcaaggttctagcactaggagactttctttctttcttttttttttatttccataggtttttggggaacaggtggtgtttagttacatggataagttctttagtggtgatttctgagattttggtgcacccatcacccaagcagtgtacactgtattcaatctgtagtcttttatccctcacccgcctcccaccctttccacccgagtccccaaagtccattgtatcattcttatgcctttgcttcctcatagcttcactcctacatatgagtgagaacatatgatgtttggttttccattcctgacttacttcacttagaataattgtcttcaattccatccagattgctgtgaatgccattatttcgttcctttttgtggctgagtagtattccgtggtgtgtgtatatatatacagataaaaaaattgtggtgtaccacaatttctttatctactcattgactggtgagcatttggactggttccttatgtttgcaattgcaaattttagcactaggagactttgaaaaaggaggggaaattggaaccacttgcactctaatgattactgttattccttataacattctctttcctctgtttttcttgtattagtttttgttctatatggtctacagataagacttagtgactgttaccttcttgttgattatcattcccacttgaaatttttgtcctaatggtactataatatgtatgtttttatttttatttttatttttatttatttttttattttgagacagagttttgctcttgttgcccaggctggagtgcaatggcgcaatcttggctcactgcaacctccacctcccaggttcaagtgattctcctgcctcagcctcctgagtagctgggattataggcatgcaccaccatgcctggctaatttttgtattttcagtagagatggggtttctccatgttggtcaggctggtctcgaattcccaaccttaggtgatctgcccaccttggcctcccaaagtgctgggattacctgtgtgttaaattaaaactacactgttaattactatttcaatagcttctcatctagctagttattaggtcttcaaggatggtgaacaatatgtatgtaactctcttttcatacaacccgtagacatacaggttaacattaggtgttaaactgaatattgttgtcactttttaaatggataattaatgttttctaatggattttaattaaaaaattttgtgtgtattttacaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtaagttctatatccttctatgtaaaaatgtaatcgttaagtcaacatttgctggtctgtttagtttactttgtaggaattaggaggacaaaggttgggatctgaaattaaaggtacatatgaaagtgagttatgttcaatccaggcaacatgattgaaaaggctgtgctgacagcacttcatataaaaccaggcagacaaagtggaagtggacagttctttaaaatgtcaccttggtactcttttggcttgtatcttccctctgaactccgaaagttatttgtctacctttgtcttgaagcctgccaaccaccttgcccctcatactcttgttttatgggctgtgtcttccacctttggtatcttattatttttaatggcatttctcctaataaagtctcagcagttccacatggaacactaactggcagaacttatcactgctgccaggagggtgaggttggagtaggagtggggaatgccagtagtgaatgtgatgttctgcagaatgttgaagggagaaacttttatttatttattttttaaggactttgagactgaaagttattctagtgttggaggggaaggcagaaggtcatggtgtcacagttgcagatgaggaaagatggctttctccttagactacatttcttgttgaaaaatccattgttggcctgaagcaggtaaaccagttgtcaggaaattaatgacaaaggtcctttaatggatcatattctgtcagggggaaaggtccctggcttttaagacagaagaacattcccttttgcccattctagtattttattctactaccagagaggcttatagagattaagacccactgaataacagtagggccctaatgaaatttttagtattgacgtgtagttgatagaatctacatatatgtatgtgattatttttgttggttacttattgtataacttaaaaaatagatttgttgagatataattcacaaaaaaaggaaatccatccatctaaagtataaaattcggtggtttttaatatattcggagttgtgtggccatcacagccattcaattttagaatagtttcatcactttaaaaagaaacctcatacctattagcaggcattcctctttctacctccccttagccaccatgaattttctatcaatggcttctgcacacaccatataaatggaataatatatggccttttgtgtctggcttcttacattcagcctgatgttttcaaggatcttccatgttgtagcatgtatcaggacttcattacttattatagctacataatattctattgtattgatacaccattttgtttatccatttgtctgttgatagatactgttgtttctttttctattttctagtgcatcattttaattcccttttttgttatatgtttttgagttcttttttaaaaattcccttggggattacaattatcttaatttttcacaatctaattttgattaatagcaacttaattttaatactgtgtaaaactttgctcttatgtggctctgttttctcccatatttttgtgccattattgctatacgaatgacatctttctacattgtgtgccatcatcaatacagctttacaattattgctgtatgcagttaatttttttttcttttttctttttgagacagggtctctctctgttgctcagactggagtgcagtggtgagatctcagctcaccgcaacctctgtctcccaggttcaagtgattctcctgcctcagtctcccaagtagctaggattacaggcacccgccaccacacccggctaattgtttatatttttagtagtaatggggttttgccatgttggccaggctggtctcgaactcctggcctcaagtgatccacccatcttagcctcccaaagtgctgagggattacaggcatgagctatcactcccagcctgcagttaaattttaatctagtggaggaaaagggctacaaagaaaaaccacgtttatactgttttttatatttactatgcagttacatttttactggtgcttattatttctttgtgtggatttaagttactgtctagtttcctttcagcttagtcttgagagttgtctgtagtatttcttgtaggataggtctgctagagatgacttttctcagttttgtcttaatttatcctttaattttagaggaccgctatgttactgatttttaagttctttgaatatatttataattcctgatgtaaagtctttgtctaataagtttaacatctgggcctcctcaggaataatttctattcgttgtttttttcctgcgcatgagccatactttcctgtttctttgtgtgtcttatacgttttgctgaaaactggacatttaaaataatgtgtctattctagaaactcagattctttcccctacctgggtttcttgtttttactgcatatttatttatttttgtcgttgctgtttgtttaattatgtttctgggataattctgcaaaatctgtattctttgtatgcagctactgaagtctctgctcagtcaacttagtggacagctaatgagtggagagagtttattaaattccttgaactaataagtctcttagctttttctgagagtctctgtgtgtttgttggggtatgtgtttaatactactgcaggcagtttacaactctgccttagcttttattttctgcctgagaagaacctcaaagtcagtcagaagtgagagattaggacctttttagatctttcctgggcatttgtagagccctgcccatgaacatggccttttaggttccaaggaatatttgggagcattatagaaatctcatttcctatttttttctttaaattttttttttgttgttgttgttagacttttgttagccctaactggtattgctacctctggtagctgtgatgttaaataattactgctgatagttttcaacaaatgcccttgggatagggctgttctcaaagagcaagctttgagtgaggtcaaagaaagacaaagctggggcatggagctttccaaggggcttcctgacaatttttctcagtatgggacttttagggagctccaaacctgttgttcctctgctgtccacagtggtggctaggctgatgttttcacaacaaccacatttgtgcacatggtttttaagtcttctaaaagcttgagtgagggggatgggaatagggcaaggtaaaaaacacctcaaagcttactgtttttactgatattcggctgtttttcttgaataaatgctccttggaatgttgcaagtctttgttaattcctagagtactgaaaaagttgatttggacaatttttaccactgtttttgttgctattgtggaggaagaaatttttgatggtccgttctctgctgttctaggagtgttgtctataaaattcttttaagagcacttttaaaatttgggatgggacaagggaaaattgttctaccaaaaatacatctgcactcaaatgtttattgcagcactattcacaatagcaaagtcatggaactaaccctaggtgcttatcagtggtggattggatagagaaaatgtggtacatatacatcatagaatactatgcagccataaaaaagtgaaattatgtcttttgcagcaacatggatagagctggggaccattatcctcagtgaattaatgcagaaacagaaaatcaaatgccacatgcattctcacttataagtgggaactaaacaatgggtacgcatggacataaagacagaaacagtagacactagggactccaaaagggggaagggagtgggagaggggctgaaaaactacttattgggtactacattcactgtttgggtgatgaattcaatagatgctcaaaccccagcattatgcaatctatctacgtaacaagcctgcacatgtaccccctggttaaacaaacaaaaaagatgagattgggaaaagccatagaaaagtaatatttcctgaaactagtgacccaagagaactttgaggaaaggtaaactaattattatattttatacaagttgttttgtattcatattttacaatatatttataagatatatatgtatatatttcaatataacttattacattacctggatataattatttgacataaatacaaacatggttgtattccagatggcattctctttggaattttagatgcctttgggatttgtactgaacaaaaaggtgagaaggttcgctggtgttagaagttctcttttgttttctctttcactttgctgttttaggtgtacagagccagtgggccggatggagccactggcagaggccagagaatccacctgcagttatgggacacagcagggcaggagaggtatgagatcttcagttatgtgctccttactgaaggaaagggaaaaatagttacattcttcaaacagtgacctgagcaggaaaaagccagccaattcgttggtttgcacttgaatgctgccaaattagcaggaaatttgtcaagtctgagatgagaatggtggccttatttcatacaaggtcaagggagaggttatgactcttacttgtggacttttttcttttccttcttttaatttttttttgcttagatactttgctccatttccttttgctatttactcaaccacaagaaagtggccaagttacatgcattattcttacctgactgttgaaatctagtgggatatctggttggaattaattcatgtgaccaggggttacttgaccaaaataagccacatgaaatcttgatataaagttgctttcagttagctagaacttctgttttctttcacagccaccttgaaggattttgttttttaactttttattatggaaaacttcaaggatattcaaaagtggaaggattatatgataaacctatgtacccattactcagcttcaacaattatgaaattgtggccaacagaatttcatttataccccttacctcttctcaccccacccccttaccatataatttagaagcaaattccagacactatattatttcatttttaatacttgtggtaatgtagctctaaaagataagagctcttttttgttttttttttgggcggagtttcattcttgttgcccaggctgacgtgatctcagctcaccgcaacctctaccttgctggttcaagtgattctcctgcctcagcctcccgattagctgggattacagatgtgcaccactacacacagctaattttgtatttttagtagagttggggtttctccatgttggtcaggctggtctctaactcctgacttcaggtgatctgcctgccttgacctcccaaagtgctgggattacaggtgtgagccatggcccctggccaagaactctttttaataaaaacattgattaaaagtatttgagaaaaacctaatattgctgattagatgacaaattcataccaatattttcttccctggagcctgcctgtcagttacaggttttacatataggcaaagacgagaggaaactgactggtgatagggtggggttgggggtggggagagagagagagaagacagggaagacagaaggataaagccttggaaggcagagtaccaagacagaataaggtctgagtcaagagattcttaccttcaagccaaacaaatggctatcagagataagagatctctgcatattctgaaattaaaagatcatggaacacattgtaatgtcaagtcaagctttcacaataggaaaacatacactatattgcttttggccaaattaactcataattgtacataaattcttgggtgagactaagatcacaagctggttcttgtcatccctctccagcagcctcggttttcaaatcacatggtctgttaacacttaaactgatataagtgataaataactatcctatatacttttgaaatatcaccatgtagcttgttattggtaaacttttgtaagaggctgaaggcattgcttgtagttttatatttcaggagtggggccgtggtttaactgaccattctgcttttatgttcctaggtttcgtagcttaacgacagcgttcttcagagatgctatgggttttcttctactttttgatctgacaaatgagcaaagtttcctcaatgtcagaaactggataagtaagtgttattgttccccagtgtcctgctacacagtcccctcttatttatagaatgccctcttatgctctacttctgtgacaaatcgttttggaggagatcttagtgcaaatactattttaaggagcaaggtttttagtttagggacaaagataattgaaatactctgcttctccctggtactgataactttgatttgttgagtacttcctgtgctccaggtgcaaggcagcactttatgtgtgctctcctcttcagtctatcccacagaagagactcttattcccatttcgtagatgaggaagtagaagcctagagaagttaaatctctaagtatctgcttgtctattgtatgctatcaattcttctatcatctctggacattaaatgggtattacatagatgcagatagcttttaaagacttaatggatcatacccctggcttcatgtcttttctgtgcttagagtccccttctagcttttagggttagagcatctttcaggaggattctgccatggaaaactctacaactgcattggtaaaagtggtcaccagtgcaatatatgtcaacctttattttggagagattttaacctcctaaatgattggttcatagccatttcgaattctgccacttgactgcataacagctttcaaatgtatattttccctgtttggtcatgttagtgtaaccctagagaatctattagggaaggctgtaatattaaattcttaacatctaaatctttaaaacactgatttaaaaagatctgctacttaaacattactgttttgggattatgaaagggtaattggctgtagttttgatagtagaaaagcttagattaaaaatgagtttaaaaataatttagtgcactgtggttttcacatactttgtatctgatcctcacaatcaccctgggcaaagattcgggtcagtgttgtgtccttatttcaggagaaggacattgagccttaaaaagtaatagacttatccaaggatatgaagctttggctttcctttttaatggccttttttttgcccgttctcaagtcagttggccactaagagttgaagagctattaattactttaaatatgagttccccaaatatagtaatgcttactggggcttcacttcgctagatgcctggctaagttgcctcattatttcccttgtagctgaatgacagtggctgtttatggtctcttactctcagcccgtgttcatcatccctcctttgcatcatcagaacaagttctggggctttttaaaatcaactattttataaggatcactagagagtgcgcatagaatcttagcatcaaaaaataacgcacctgtttttcatatgtagacactaaaactctgagacattagataaatattgcctagcctggctaactagttggataaagaacaaaattatgtgaaaataggtatacatatgtatggattttgtgaggttttccttagagagtaaaagaatccttattgctcagttaggtaaagaacacttatacgtattgaagattttatatatttaatagaaagtattctccaccccctaccatttaaacaaaaaggtgtaatgttcagtgtcagaagtggtaatatcaaatcttaattaggaataaacatttgttaattatctgtacttttatttttttcttcttcctgtcagccttttgagtattacaatgatcattcatttcttatcttttttttttttttttgagatggagtttctactcttgttgcccttgctggagtgcaatggtgcagtctcggctcactgcaacctctgcctcctgggttcaagcaattctcctgcctcagcctcccgagtagctgggattacaggcgcacaccaacacccccagctaatttttgtatttttgtagagatggggtttcacccatctcccggggtttcatccaactcctgacctcaggtgatccacgcgcctcagcctcccaaagtgctgggattacaggcgtgagccacagtgcccggcccatttcttattttttaataaaaataatagcttaatacacacaaatacacactcacacacacacacacacacacacacaaatacataaaaatcagtggtgagtgccagaacacagtgttgcattaaagaagtagctgactcgtgggccctgattggcctgggagaggagagcaggtctatataccctcccctttccctttgctccttgcagacccctccctctcactcaatctctccatgccctcttgagaagggtgataaaagtctaaagtaagccccactcagatgaggagacagaacagaggctgagtcctctgggcctggattgaaatctgaaaggaatttggtagtgtggtagtcactgtcctgtcttcctggagttcagaggagtaagcacgtcatgcccagagtcactcttcatccagtgctagtgtgtttcctaaggaaactttaaagtagcctacatttctaaactttcttctgtagagtcccataagtggtgcaaaaacccaacagtatatattttacatatttttacttctttattttttattcccattattctctctgtctgaaaaaccctttccacacctgcccccattttttaaccaactggagttctgcttattctttaaaacctagcaaagatggcctctgtgagattctctgtaataaacttagttgtgttagatgttttccctccttttaacccctgttacattttatactgtgtatagggtccttattacatccattatcagactgtagttgtttatgtaggtgacttttttcttagtgaagtttttaaaataactgattaatttgctttttagataagcacaatcttagtagaaaaattaggaaaaatgagacaaaaagaagaaatcaccaataatcacacttcctagactacccaaaataaatactgttaaccataattactggtgatacttacatgctcttctaaatgctttaatatattaacttagtagttctcaaatgtgaatgtgcatctcagtcacctggaggactttttaaaacacagatttctagccccatttccagcattcctgattcagtagagctggagtgggacctgagacttgcatgtcaacaaattcttaggttatgctaaggctggtggctcacagtctttacctgcagaatcactggattaattcattttaatccttaccttgactgtataaagtaagtagtatcattatcaccatttacagatggggaaattgaggcagtcaaataacttcatcagggtcacacagctagtaaatggcagagccaggattcatccctaggtacactggatcctgagtctgtgctcatagcatgacactgggcatggacctataacaccttataaggcattaacagagcacagagccactctggagaccagaaagataatgaggtaaccatgaagcaagtcttgaaggaaggttgtggttaagtattcagtgatgtgggaacagcatgtgtaacaacctggaggaaagaaagggcatggcttttcatgaaatggtacacagtttagtctgtcctctgtaggtcttattaccccagttgccccatgagggcaaagaactgttgtgaaattccatgcagagtatcaggcctgtgctaatgctcagtaaacacctgcctacttgactttctcatgataagatatgatgaacacgacttcataatgaggaactaaaatgtccacacttttctggttaaccatgatgaaaaaataaattaggccataaactctgaagtatgtcttactgtgaacgtttaggccttaattttattctggggtgtgatgggtaagaaatgaggtgttattttcctactttgaaagattaaactatttagcttagtgaagctctttggtttgagtcaattgctttttataattgtgcctatttgcaggttttcaggtgaaataaaagctgcggaataagaattatagtcctctgcttccacttggctctggtgacagaatcacttactgtttattctgggtcttttcttctcattgaagcctgtatcttgtttgttttaaatgagttgattctgccctaggataatagaaaaatgtgaaaaacattttggatagaaatagattagtttggagaaaaacaattcttttagaaatgtcattgctatggagaaaaaaacacataaaaacagttttaagattagcagtaaaccctaggaactcctgcaactttcttttcaaatagccttcataaaaaagaaaggtgttttgtatgtgtgtgtgtgcatatgtgtgcgtgtgcacatgtgggccctcacacttgagaggtagcacattctcctataaactctccgatatcaataaactggggtatgtgcttaagaatggttttatatttctgccccaactattcagctttacagataagattactgatgctttgaaagcattatgtcaattcccaatatctatatatacattatagtcttcaaagcacttttgcatgtattgttcactgatcatacacttacattattatttacatatataataaactttcttatattaataggccagctacagatgcatgcatattgtgaaaacccagatatagtgctgtgtggaaacaagagtgatctggaggaccagagagtagtgaaagaggaggaagccatagcactcgcagagaaatatgggtgagtatttttgtggagaagtctagagaaaacattttcaatataaacattagcaggtgaatggtaatgaaaaagataaaagtggacaattaaagcaaaacctcagccataggccttggggcatgttgaatgtgtcctttttatatgatatgatagtaggatccattgacaatgcatgtggcaagggcctccttcagtgctttggtcccattttctcaaactcttggcatttgcagagagacaactttgagttgtctcagaggcgccttaagtatgtaaggccttctttccaagatgcaaataggagactcctggggtaaagaaatcctccatgttgagcgaggaaatttcttttttcatttcttttcttttttttttttgagacagagtctcacactgtcacccaggctggagtgcagtggcacaatctcggctcactgcaacctccacctcccgggttcaagcgattctcctacctcagcctcccaagtagctgggactacaggagtccaccatcatgcccggctaatttttgtatttttagtagagatggggtttctggtaccatattggccaggctggtctccaactcctgaccttgtgacccacccgcctcagcctcccaaagtgctgggattacaggtatgagccaccacacccagcctcagcaaggaaatttcaaagccacttcatgtactattgtagagaatgctagcatataagaagggcttattggttattgcagattaggtgctggttttgaaatttctattctgggagaggagtgtgagatctcctttggcttagtctatggtcttgtggtggagggtcagcaaaatactgtcgttctccttgagttctgggaataggatcatagcagcagcagcagcagcagcagcatgaactggacatgaaagaagtggtcagctgctgcttattaaagtattaaagtgttaagggtgcctctaaaaggaatttttactttactttctttctgcctctcacacaatgagaacccatatgtaaattcaaacccttaatagcattaaaagaggaaggaagcaagtgggttgagaagggaggggagggaaatagagatggtgtagatggtgtaggggatgttacctagtttgtggctttggtggttagcagaatccaagaaggccaagagaaaacctttccctttttattgtgtgatcactgctttattctttctttggttgatggaggttcagaaagctggtagggtttatagtgggaagggagggggaggataggttggccaggtaggaagaagccagactctggaggggtttgaataccaggtaaggagattagatttgatccctggaggacagggagttgctgaaagcctttgagcatggagggatgttatgtttacatttccagatcagtctataggctataggtggggagggaggaaagactagagattgatagattgcagtggtctgtgaggtgggcagaggctagctttgtgaaaaaggaaaaggaagaataaatcaggaaaaacacatagagtagggcaggattttaggtttttctcaaggctagctcagctgaaggattcccatccactataggcttactctggcaaggatttgcaattgcatgtagaggtttttaccctagggcagatggtgtttaaccatgttagaaacatccagagaacttttaacacattctcatgtctgggcttcacctctgaccatcagacataattggtttggaggagtttctcaggcagggttcacttgaagaagcatacctatacatgaagggatctgttacaggaatttgagcatatgcaattgtgggagctgggtaagtagtctctgtaaggtgttgtctttgtgtctgatgctgaagcttgaaggacaggacagtcagacaggaaggggagaaggatgtgaaatgggggatggatggaaaaagtgagaaccagctggtgcccataatgagggactaaaacccatgtcacttcctgttgcctctgacctggctggtgtgggtgtcctgcagaaactggggccctttgtcacagggctaacaacatcacctggcccaggtgcaggtctagttgcaggtttatgacaataagatgagccagcagataagcgacaatatatgagggctatgaaatggaggttgcttcacttcctacccccaaaattgcccnnnnnnnnnnnnnnnnnnnntttatggcatatcttcacataatttgtatgttgtttgataaatttacattttttgttactattatgctgtcttctattctcaattcataaaaacagatcactggggccaggtgtggtggctcatacctgcaatgccagcactttgggtaggccaaggcaggtggatcaccggaggtcaggagttctagaccagcctggccaacatggtgaaaccccatctctactaaaaatacaaaaaattagccaggtgtggtggcgggcacctgtaattccagctacttgggaggctgaggcaggagaatcgcttgaaccctggtaaggcagaggttgcagtgagccaagatcgcaccattgcactccagcctgggcaacaagagcaaaactctgtctcaaaacaaaacaaacaaacaaacaaaaacaaacaaacaaacaaaaaaaccccagatcattggtttacaattggttctctggaatagacatatcaaagaatcaaacaccatgtctcagaagaactttgtaagcctaataaagaacactacagtgcgaaaatggaatgttaatctgtgtgtgctgggacaagtaaatttgagaatgaggacttcatacaacagacaaaaatgtaaagggcaaattgtatgcatgataatgaatatcagaaaaaaaatttgtagtggcctaagagtctaccgctaattttccatgtttttttttttgttgttgtttgtttgtttttgctgtgaaacttggttaaattgtaatatgaagctcttaggtcacttcctaacaaatcaaagtgatctctgtggtaaaccaattgaattttcctggaacaaatgcaacataatggtttccaatgtattatattgagtgatattgtcaatgaagttggagaagagaacaaaacagaaagttgttcaaatttgcactcctgccagccaagtgattacagttcacatggttactgaaacactttaaaaagatagctacgaagtcagtgacaagtagaagagaaagctgaatgaaatattggcaacattcctcttttggaagacactattagatctcaagcttcagtgtgcatcagaatcaatcacctgaacactgggtcccgcagtttctgattcagtaggtctgggttggagcccacaaatgtatactgatgatcagtttctagatgttgctgctgctggttcaagacaacactttgagttcctatcaaagacgcatgctagcaaacattttgcttgacaggtgagcatgctagcagatattttctttggacaaagtcattcttgtacaggatatgaaccaattgtctacttgtgccatgcatgagtgagtgaaatatgctcaatgacttctcattggaaaatccatgctaaagagaggaagattttttttctcacccagttaattacatcacctatgatataggctgggaagggaccttggcattggtagtgagggagcaccaaccacaagtgagcagacaagggcttcactctgtgactaaatatggttgcgttgaaatgtctgtccatactttattcacagaggatagttggtggtcataataagcctttgttcttgattcagagttgaggaaaatagagaaaaatgtgaatatgatctaaagctgggcatggtggctcatgcctgtaatcccagcactttgggaggttgaggtgggtggatcacctgagctcaggagttcgagaccagcctggccaacatggtgaaaccccgtctctacaaaaatataaaaattacctgggtatgatggtgggtgcctgtaatcccagctacttgggaggctgaggcaggagaattgcttgaacccaggaggcagaggttgcagtgagccaagatcacaccattgcactccagcctgagcaaaagagcgaggctctgcctctaaaaaaaaaaaaaaaaagaatgtgaactaagaatgacaactgaatgtacatattttgtgtactgtgcaaagaaatgggcagcaaatttaagatgatgttctccctgctgaaggctgctggttattgctgaggaagatgctcaagagttctggaatgaaagaggaattaaaaatatttatttacaacattaataatatcagtatggatcatttcagggatttcaagtagcttaattcaacagcatgctcactgttttctctagtttgaactagatgaaatgcggtacaaatagcttgatctctaatagtttagtcttttaaaacttgattacatcttttcttgatttgagaaataacttagcgatgtagcattgggcatgtttgaaaagtacacaaataagtcaaacatacaagactgattcacagagctccatttaactcagcagaggatctggatttcatttgctgcaatatcccaggttcaaacagtcagcacaccagccatttcctggaaatgttgttcaattagcatccaacagactgtgaaaagtagtgtgaaactcacttctcactttagtgagacgtttgttcataatttctagatctacatgtgagccaaatatctacagccatttgacagaaccaccaaacatacttgctgttattcctggcaacctctaactgagatttaggatcttttagttttgtgagaataaataatggaaaagaaatcaggatgctgacctacgccacaagcaagatcttggtgaaaaactgcaaatgcttatgcccctctcattgatttgaatctgtttacttaaattttttattttaaaatttgtgattaatctatttttggaaatgcattataattaatggtctgcatgtactccaaatggcctttaagtggccacttacagactggtaataacgatgagcagtgctgaattttttcgtctttggcaatacggctccatggtggtgctacattagcaccaccatgtggagaaaaggaacaatagcactctttctatggttaaaatgggaacaatacatcctcttgaattttttttttttttttttttttttttttttttgagatggagtgtagctctgtcacccagctggagtgcagtgacacgatcttggctcactgtaacctctgcctcccaggttcaagcgattctcctgcctcaccctcccgagtagctggggctacaggtgtgcaccactgtgcccagctaatttttatatattttttttagtaaagacgaggtttcaccatgttggccaggttgatcctgaacttttggcctcaagtgatgcacaagtctcggcctcccaaagtgctgggattacaggtgagccaccgcctccagcctggaacatcattttcttatggaaagaaagtcttaattcagggtcttttctatggctctcatctagtttgctagatgagattacagcccaattactggcacagagctgagagtggagtgaactctattcacttattcctgtagaaatgaaaatcttactgcctcaaattgctcagaaaactctgagtgattagtctaaggatttttaaagttgttaacctgactcctggtcccatgacctagaggtttacaaatggcaagaaagtatacttttaattgaaagaagtttgttacttgaatttggagttacaaatctaaagtatgtcttgttaatattgtgtgtcttttagcatgagtaacttgaaaagttagagctcttataccttgaaattataccaattaaatatttgcttaagttaataaacattggacagtagctcacagctctgctagaagcatcatttatacgtcagtattaatcagtagagtaagatccattgtcttccagcatttcatgaagattgcttggaaagtgaggagtttaatgaggagtaagggaggcaaatgctttggaggcacaaagcactttggccaggacaggtctgagtgcagcatctctggtgtagggaggcgtggtcccaggtaccagaattagagcagtattgtagattttatagatcagctacattgtggattaaaccaatgttcatgggttagtttgcaaatttatttttattttttattctttttttttcacacaacacacagattgagaatttaatgtttaccatgttgctagtgacattgcttttttgggatgatgtattctgagtttttgtttttcttttctgagacagagtctccctctgttgctcaggctggagtgcagtagcaccgcctcggctcactgcaacctctgcctcctgtgttcaagagatctcccgtctcagcctccctagtagctgggactacaggcacgtgccaccatgcccagctaatttttgtgtttttagtagagacagggtttcaccatgttggccaggctgatcttgaactcctgacctcaactccgaccctgccttggcctctcaaagtgctgggattacaggtgtgagccacggtgcctggctgtgttctgagttttaaataacatcattacaaataagcttttatcacctaacccaattctgtgttggaaataagaaacatttattgtttgtacatgtgtcaggttctgatctaagtgctttaaatattaactcatttaatcattacaagaagatactgatgttatttggtattacagatgaagcagcggaggcacagaggttaaacttttgtcagaatcacagttggtaagatgtactactaggatttgaagccaggcagcatgactccagaggttatgacttctttttttttttttttttttttttgagacggcgtctccctctgttgcccagccttgagtgccgtagcacgatctcggctcactgcaacctccgcctcccaggttaaagtgattctcctgcctcagcctcctgagtagctgggattataggcgcctgccaccacgcctggctaatttttgtatttttagtagagacggggtttctggtcttgaactcctgacctcaggtgatccacccgtctcagcctcccaaagtgctgggattacaggcgtgagctaccgcgcccgacctgaggttatgactcttttttttttttttgagacggagtctcgctctgtcgcccaggctggagtgcagtggcgcgatctcggctcactgcaagctccgcttcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgccctcctcggcctcccaaagtgctgggatgacaggcgtgagccaccgcgcccggccggttatgactcttaaccattgatccatgttgttgataacttccatgcacaggttttatagttttcaaagtactttcactatgttttctcatttattcctcaaaaatgatggtgaagtaattttcaggagctgtggaggaaaattaaggaatcaaatgaggctggagactctggagttggaaagatatttgtaactgattttgagagaatttttaaaatgaagtatacattattgtgatttagcattttaaaaaagcttactgttcaactactttttaagaaatttccaatttattctgttgcgggagatctgagtttttcaactgctttttcatgtaatgtatttctgaaaggtgatagaatggtcaaaccctctccttaagtataagaaatgttctgtggacattaactgatttttaatggatataattgagaaagatcataatgaagaaaatgtaacaatttacattttgaaaaatctcattctaaaattctattcttgtaacaatggcatcacaagctatccccaggattttagctcaataatattatagattcttgataaataaacacatattgactccagtcacaaaggattgcctcttcaagttgttaatcaaatattacatgtgactagtgagggacagagatgcattatcttcattttgtgtgcaaggtgatagatggaggaaaaaagattgacagtaactaagaggcaagcaggaggtttaaaaactgcgaagaccatgtcatttttcccaacaaacttttttctgattaagatattttagagtcaggaaataaaaggatgatagaatatgagcatggtggagttaggggagcaactctgccttgcagaactcacaggtgggtggataaacactcaaatgaggtgatagtttctcaaccagtttttgttgttgttgttgttgttttgagacggagtctcgctctgtcgcccaggctggagtgcagtggcgtgatcttggctcacagcaagctccacctcctgggttcatgccatcctcctgcctcagcctcccgagtagctgggactacaggcgtccaccaccatgcctggctaattttttgtatttttagtagagacggggtttcaccatgttagccaggatggtctcgatctcccgacttcgtgatccgcccgccttggcctcccaaagtgctgggattacaggcatgagccatcgcgcccggcctcaaccagtttttaatagctgtgctaaaacagagaattgcagagattcagttgcaaggccttatcacctcctggaggaagttatcaaataataagacagcattactgaggaatcatactggaaaaatagccttatgtccctacacatatatcctctaaatcagtggtccccaacctttttggcactgggaactggtttcatggaagacaatctttccatggaccagtggaggtgtgggtggttttggaatgattcaaacatattacatttattgtgcactttatttctattatcattacattgccatatataatgaaataattatacggctcaccataatgtagaatcagtgggagccctgagcttgttttcctgcaactggacagtcccatctgggggtgataggagacagtgacagatcatcaggcattagattctcataggagagtgcaacctagatccctcacatgggcagttcacaatatggcttgtgctcctatgagaatctaatgatgctgctaatctgacaggagacagagctcaggtggtaatgtgagtgatggggagcagctgtaaatacagatgaaacttggcttgctcgctggccccctgcttacctcctgttgtgtggcctggttgctaacaggccatggattggtaccagtctgtggcctggggattgggaacccttgatctaaatatgcttcttagtaacatcagaagtgaaagagttctgaaaagatctgtaaaagcattaacaagttaaaaaagaaaactttaccaagctctcatatagaagctgttactagccaagaaagaataaaagagtaaggtaaattgtaatcagagtaactgatgtagttgttaacatgctatgagaatacagaaaaacaaaaacattcttcaagaacagtaatcgtggaggactttaaagttctaataaatttaagaaatactttactgaattcaattgcaggactccctgagataataaaataactttgctttgttgttttgatatctaagaacattttggttagattcctcacaagtggtggcaatgaagtcaacagttgaaggaaatacaatgttatcacgactttcatggctttattgaaaagcaaggtgaatttgtcacttgattaatcctgttgcaaagaccatctcaaatgtataaaggatgacttcgacaagaagtctgatttctcaagattatgtgaaaaacagctatacagttttgaagcaatgctttgtgagttatttaaaaattacacctgtaccacaggtctttggataacaaaacaaatgtatacttaagatttgatgggctgggtgcggtggctcatgcctgtaatcccagcactttgggaggccgaggcgggtggatcacgaggtcaggagatcgagaccatcctgtctaacatggtgaaacaccgtctgtactaaaaatacaaaaaattaaacgggcgtggtggcagccgcctgtaatcccagctacttgggaggctgaggcaggagaatggcgtgagcccgggaggcggagcttgcagtgagccaggatggcgccactgcactccaggctgggcaacagagtgagactgtctcaaaaaaaaaaaaaaaaagatttgttgctcttgagcaacttgatgctgtaaaattcagaatgtcttcaagtgtatggtccagaaatatagtctggagttggtaagtggcaaagcctttgataaacatggccagtgacctctgaatactccccaaagccagcgttttcttcttgtacagtgcataagatttatttattttgaaaatcctcatactagtttggaaccagtagaacctatggttaaactggctgcattggaattagctgtggacccaaatcctaactctgctactttctagcattgtgaattgggcaagttcctttcatctttctcagccttagtttaatcatttgtgaaatgggaatattgtgtacctgaatacagtagtggttatatttagtgaatcatgtatgtaagacacatagtattgggtagctcaagaaataattttagttattttttccttcaatcttaaatgactcatatatatcagctagtttcaattcaggcaaaccagaacactctgaagagcatatacaagaaatccctgaagcaaaaaagggggaaaagctaaaaaaaaaaaaaaaaaaaaggttatagtccaggaaactcatttaataaaatagcatgttgcaaaatttgaatttacccagtttttttcttctagttagtagttttggaaatcagtattctttgaactaaacactgagaagacatttcctattttgttttacaagacatagtatagtatatgaggacctgtataagaaaacaggaagagcctacttgcttctctgtcatttattagctgaataacattgatcagaccgcttaacttttctgggccttcttgccacaggcctgctttaagagtttttttctaacctaaagattacaccaaaaaacatttagaactgatcaacgaattcagtaaagttttaggatacaaaatcaacatacaaaaatcattagcatttatatacaccaacagggaacaatctgaaaaagaaatcaagaaagcaatctcatttacaatagctgcaaagaatataaaatacctagaaatcaatttaaccaaagaagtgaagcatctatacaaggaaaactataaaacacaggtgagagaaattgaagaggacaccaaaaatggaaaaatattccatacttttggactggaataattaatattgttaaaatgataacacttcccaaagcaatttactgactcaatgcaatccctatcaaaataccaataatattcttcacaaatatcgaaaaaaatcctaaaatttatatggaaccacaaaagaccctcaataactgacaaaatcctgaggaaaaaagcccaaagctggagacctcacactgacttcaaagtttactacaaagctataggaaccaaatcagcatggtactggcataaaacagacacataggccaatggaacagaacagagaacccagatataaatccatgcatttacagacaactcatcttggacaaaagtaccaagaacagaggggaaaggacattctcttcaataaatgatgctgggaaaactacatagccacatgcagaacaatgtaactagacccctatctctcaccatatataaaaatcaactcaaaatgaattaaaacttaaatatcggacttgaaactatgaaactactagaagaaaacatttgggaaacactccaggtcattcgtctggacaaaaactttttgtgtaagaccacaaaacacaggcaaccaacacaagaatagaaatatgggatttatatcaagctaaaaagcttctacacagcaaaggaaacaacaaaatgaagagataacccatagaatgggataaaatatttgcaaactacccatctgatcagggattaataacgagaatatataaggggctcaaataactcaatagcaaaaacaaataatctgttttaaaaataggcaaaagatctgaatagacatttctcaaaagatctgcaaatggcaaacaggtgtatgaaaaaatgctcaatatcactactcagagaaaggcaaatcaaaactgcaatgagataacttctcatccagttaacatgacttttatccaaaatataggcagtaattccccccccctcaaaaaaaaaaaaaccacacctaaatacaggcaatagtggatgctggtgaggatgcagagaaaggtgaacccgtacattgttggtgggaaagtaaattagcataagcactgtggagaaaagtatggatgttcttaaaaaaaaaaactaaaaatagaactaccatatgatccagcaactccactaatatatatgtgtgtatatatacatacacatacatgtgtgtatgtatacacacatacatatgtgtgtacgtatatatgtatgtgtatgtatacatacacatacatatatacactatatatacatatgtgtatgtgtgtatatatacacacatatatgtgtatatatgtatatgtacacacacatatgtgtatatatgtacatgtacacacacatatatatgcgtatatatgtacatgtacacacatatatgcgtatatatgtacatgtacacacatacgcacatatatgcgtatgtgtgtacatgtacatacatatatgtgtgtatatacatacacacacatatgtgtatatatgtatacacacatatatgtatatatgtatatacacacatatatgtgtacacacatatatgtatatatacacacatgtgtgtatatatgtatacatacacacatatgtgtgtatatatgtatatgtacacacatacacatatatatgtgtatatatatgtgtatatatattagtggaagttttcttaaaagttttatgtaagttttnnnnnnnnnnnnnnnnnnnnacagatcccctttatatgcaatcaatctacccatcaatggatgaatggataaataaaatatggtttatatatacaatgtgattgttattccaccataaaaagaatgaaatcccatcatttgcagcagcttggatggaactggagatcattatgttatgtgaaatagccaaacacagaaagacaaatgttgcatgttcttactcatatgtgggagctacaaaggtggatctcatgaagatagagagtagattggagaataccatatgccaggaagggtaggagggagtggaggatgaagagagattgattaataggtacaaacatatggtttgatagaagaaataagatgtagtgttagaaggatcagtagggtgactatagtttacaacaatctattgtatatcttgaaatagctaggagggaaaaattccaatcgttctagtataaagaaaagacaaatatttaagattatggcaatcccaagtatacttatctttacacattatatcagtgtattaaatgatcatatttactctgaaactatattatgcataaataaaaaataaaattttcttacagatacaattgaagtcccttttaaaattccttgctgattccattctccttcctacctcctcagagggaaccacactatatctacttcctatagcagatgttgttggttgcctagacaatattcatgcctttatttatagaatctcaattttctttagctatctactctgcttctagaggacatgctacttaagagaggcaggtgccagccaccagcccaggaagactgattggtttaagccagtgatggtggtgtaccattcctcttgccagagtttggtttaggcattggcatgtgatacagttttgaccaatgagacacgagggaaagtcttccagggacttgtgggaaagatttcctctctcctgagggaggcacacagaggaagagtcctttcttccttggaacttcggtgtgttgagatgtgatgcctggaatgttttaacttctggggtcatgaagggagtcagattgtggagaaagctgacatgtggaggatggcagaacagaaggatgatatgaatctaggctctttgtttctaccgtttggcaaccgaattaacactggaaactctctagttctgtgttcattatgcattacaataaattcctacttgtgattcatgccaatttgagccacaattttcggttacttttagctaaaagcagtcaaaattatatatttctagtccaagaagttgtacttttactacatagatgtttttataatgatgtgtaattgttgtcttcacacaaatgatcttgtatcatacaagttggttttttaattcaatgtttaatttttgccatgttgatacagtttaagcattgtataattcattgtataaaaatatcactattcatgcgcttattgatggacgtttaggtaaattttttccctattacaaatagttctgcaatatctattccattagacgatgccacgtgcacatatgtgagagcttctctagggctgcactatccagtgtgatagccactggtcacatgtagctatttaagttaaaattaaaagttcaggttttttggccaggtgtggtggctcatgcctgttatcccagcactttgggagtggaggcagacagatcacttgaggtcaggagtttgagaccagcctggccaacatgataaaattagctgggagtggtggcctgttcctgtagtcccagctacttgggaggctgagggacgagaatcgcttgaacttgggaggcagaggttgcaatgagccaatatcacaccattacactccagcctgggcaacaaagtgagactccatctctaaaaaacaaaacaaaacaaaaacaaaaacaaaaaagtcgcatttttggttgcattagccacattttaagtgctcaatagctacatgtggctagtagttattgtactggatgatatacatatggaaagttcctgtcactgtgggaagttctattggatagtgctgctccagcacagggtttctgaatatttttcataggatggcacctgcagaaaatgataatatttgtacagctcactgggataaatagataaggctgctcaagtttggaggagactggttcagggactctggctgccctaagaccttctcagttgccctaaggactgagggattgctgatgtctcatgtatccctgtaactcacttcctgcccatcaacatgccttggctctgctttagatgtatacccaggagtgctgttgctgggtcatagtgcatgcatgtttcaattttatcagatattaccgtcttattttccaaagtagttattaacagtttatacttacataagcagtaagtgcaagttcctcttttcttctccttggcaatacttaatattgggagatttctatatttttgccaatctgatgggtgtgagttaatataccattattttaacttgcatttcccttattttgggtgaggttgaacattttttcacaaatgtaatttcttagaatttcccgtgcatatccttagtctgttttgtattatcttgtttattactttaattcatttgaggaattattttttcggatgctaacccgtttgcaagttatatgaaatgccatgtatttcggcctgtcgctcatcttttaactttgcttatgatatatgttgtggcaccaaagttttaaactttaacattgtcaagattatcaaacttattctctgtggtttgagcttttatagctatattaagaaatcctttcttattccaatgtcaaaaagataagactgttgtatgttcttctaaaagttttcaagttttacttttcacttagaggaatttaaacggctttcataccaataatcaagttttaaattcttaaaactaggctgggtgcagcagctcacacctgtagtcccagcactttggaggccaaggcgggtgggtagcttgagctcaggagttcgaaaccagcctgggcaacatggtaaaaccctgtctctacaaaaaaatacaataattagccaggtgtggtggtgtgcgcctgtggacccagctacttggaaagctgaggtaggaggatcgatgcctgggaagtcgcctgggaactgagatcgtgccactgcactccagcctgggtgatagagactctgtctcaaaacaaaaaaccctccaaaaacttaaacgaaaaaagatttaattctgtctctgtcttccagaatcccctacttatatctttttataaattttttacagtaaatcagtatgtattgccaaaatatatatatggtcctttaaaaaatgaaaattgattttttttgagacagtctaactctattgcccaggctggagtgcggtggcacaatattggctcactgcaacctctgcctcccaggttcaagtgattcttgagcctcagcctccccagtagctgggattacaggtgtatgccaccattcctggctaatttttgtattttttgtagagatggggtttccgcatgttggccaggctggtcttaaactcctgacctcaggtgatctgcccacctgagcctcccagagtgctgggaggtgtgagccactgcgcccagccaaaaattgatattttgaagagtctaaaatttccagttttgcatatctactggaaatgcagtgtgagtattttattgtctttttaactttttaatgtactctggggtggtaaaatgtttgtcatcttgtatatttgtattctatcgattctctaatttgaattatcaagagcaaaggtcactctcctttccctccacatgttgttacctcagttgtctctgtcttccagaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaaaaaaaaaaaaaaaaaaaaatgggctgggcgtggtggtgggcacctgtagtcccagctactcaggaggctgaggcaggagaatggcgtgaacctgggaggcggagcttgcagtgagccgagattgcgccactgcactccagcctgggcgacagaggagactctgtctcaaaaaaaaaaaaaaaaaaaaagagcagggtcataatcacacagcagtgccttatatagttgccataagacttcagtgcagtacaacataattttacagctacatatcagggcatattctatatggtgtatttgtgttagaataacacattaaatgtctttaaacataaaaataagaatgtttgcatgtttcagttttcaagaaccaaatgagtaattagctatagattccactggccttaaacatacaattaagtgtatacatgatatagtgcacacacaaaagccacctttaattattgaaataacctgtattctttttggaaatcatttaagtttggtattgaagtactatattttttgtgcatcaatgtatttttctatttacaagcctatgtaaaagtgaagtgtatcttcagtgaaccatgtgccaattaagctgtaataaaaaagtggtctagtctgtcaaatttgtgtgtgaacgtaactgtatttattatcacaaagtttcataccagaggttgtaatgccaaaggaaatgaaattcagggatacacgttccattaggtgctcactgaggggccagccaagacaacatattctggaaaagtaattaaaaatgttatcaggttgggcgcagtggctcacgcctgtaatcccagcactttgggaggccgaggcaggcagatcacctgaggttgagagtttgagaccagcctgacaaacatggagaaaccccatctctactaaaaatacaaaattagctgggcgtggtggcgcatgactgtaaccccagctacttgggaggctgaggcaggagaatcgcttgaacccaggaggcggaggttgcactccagcctgggcaacaagagcaaaactctgtctcaaaaaaaaaaaaaaagttatcaaacatatattgagcacctatatttgggaagtgttgtagtagacaatctcagataaacaaaacaaggatgattgaggcctgaactaagatcatgcagggctgagagatgatgcaagagacactggggagggtacagtcatggactggatgaggagggtatatgtggagagatggcttctctgaccttctgaccttatttcttaccactgtccaactcactcttctcaggcacactggcctccttggagcagtcaagcatgttcctgcctcagatctcttgcatttgcagttccctctgtctggaatgctagtgttccatgtatacctctcctatcctttaagactgttcaaatgccactttgtccaaagaactttactgaccaccttatataaaagagcagtcactcccattcatggccccaaccagattgtcactccttgacctgttgttctgctttgcgtttcttcatatcactcaatgtaaatatttcaccacctgatgtatttacaattattcttagccaagaggctgacaagtgattcacttgacatatttatatatttgtctacatccactaagatacaagctccacaaacaaggacagggatttaggtagttttcttcaaaactgttaccgtcactcagaaaaaggcctggtacacaataggtactcaaatttttgttaattgactgagtaaaggacttaaagaggcagcagggtcaagagagttttcaaaagaggccactgttaatgttaaaagacagaaaaacgcaatttgaaaataaaaacagcgttaaaaatgtttaaaaaggttcacatatagtaagtccatactaattcattgcaagaaatcaagaaatctaggccaggtgtggtggctcatgcttgtaatcccagcactttgggagctgaagtgggtagatcacctgagatc

SEQ ID NO: 16292 - DNA, 13023 bp, Human
atttctatggcaggccccacaagccacatgcctgggccaaggagcacacactcttgagaagctggggtgggggtgtttagacaactacagagatatccagccagaggcaggcagcagtacgtcctgagtcagagccggtgagatcaggtcttttaaaaattatttttattttctttgagactgagtctcgctctgtcacccaggctggagtgcagcagcgggcaatctcagctcactgaagcctccacctcctgggttcaagcgattctcctgtctcagactcatgagtagctgggattacaggcgcccaccaccacgcccggctaaattttttgtattagagatgcggtttcaccatgttggccaggctggtcacgaactcctgacctcaagtgatctgcccacctcggcctgccaaagtgctgggattacaggtgtgagccaccgcgcctggtcgatatcaggtctttatggggaacaaagagtgcctttctgaagggagcagtgctgggtggggctcccagaaaggatggagaagatcccaggaggtttaagatgggggtgtaaggagggcgctcctggcggagagcgctgcaaagcaaaaggcaggaggtgtggaactcagggtgttaaaggctgggccattcctgttccatggaagccctgagcaaggactgagaggggacgaggctgctgagatgagtgtaggtggagacctgagagcaaagagccttggggtgtccctgtgccgtggccgactcttaacagtttaacactgttggctctgaattagaggcgggcggatgtggtactgtgtgtcgagggtggaagggcaggagttagggtgcaggagccaggagctctgcagaggcttaacttggggcagagccagtgggaatggagaggaagtagagtccgttaagaagatgtatggagggaggttttgatttttgctccattcttgggttggtggacaagtgtccgaaaggaactgctaccttctgtctctacagttgccgtcaccattggcctcaggattgtggttgggacccagaggacggtggaagtcttgctgcttgtggtagtttttacttaaacccctggtggacaaaggcaggtctgagatgaaccgggtggcctctgtattaacctagaagaggtgggagccacattattgaatggatgttcactctagcccggcgctaagtgcttcaaaacctgccatgttcctcccaagagcccagagatgaggtaattaaatggctgttcctaaggcacacagataaacagcggagctggacctcgtccttagtcctatttacagccagggaaactgtcctggagagaagtgcaatgcccgggtaacggctagtgagagatgcaacttggaaatggaaccatcgctaggccagtctactgcccatccacagtctccagcgtgggccaccgagctgggcagcacaggcccgtccatgccatggcccctggagccgtgagcggcaggaaggaggctccaagtgccctgaccctgatcttattcttccaacccctcctccctagagatggtggaggtggggcctagttcctggtcccgagccttcccaggcccagtgaagaccccgccagcaagaaggtggccaaacaccctgtccaggacgcgacggtcaagcccggggaggaccccgcaagctccagagggaagtgggctccagactagggggcgggaggccggcctgggcggagcaaagggcgctcggcctcgttgattggccgcggctgcagagctgtctctctaggattgagccttttctttagggggacggggccttgattcactcccaccaatagggttcaaggaatccacctcccaccagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaagggtgagagcggggtccgagggggtagcgtgtgggggcctggggttggtacagcatcgagggcattgaccactctccttccctctccctttcctggagcaggccgcccgggtctggcctgccgcttggcgtgcgggtccgcgatgtctgcagcaggggtttcccttcgcgtcccgtcttcctcaactacctgttttttcttgtccagaccggggctttgagctcacattcaagaccgctgatgaccccagcctgtctctcataaagtatggggaattcctctatgacaatctcatcattttctccccttcggtagaaggtaagggttccgcgtcgcccctagcactggaattcgagacccgggacttgatggattgctttcttctggttcttgggcatgtcctgggtcacaggatgggttgccagtcctggatggtgctaccacggagataaggaaaatgctcatttctgacctgaccctaggagggtacatctttctaaaagaaacagctaaggattgtggagtcaagtgttgctgcagaccgtggaacccagggccctgctgctctgctgagaagggagtttactctgtaaagggcctgataaaaagatggaaagctcctgggttgggtttgcctgggtggaaagaggaaatggcctgttattaatatggattgctataaagaggcattgtgcattgtggcagttgatcttaagaattcagatagattcatagtctcgggctgaaaaaagagccttagcaattatctaccaccccacccctcctcccatttgaggctggataaatatgtccagcagccttgcagtgggctagtcgtttaacagaatgaatatcttggccagattatccagttgatacttgagtattcttgttttacgaggcaatccactccaccactgaacaattctgttaagaagttcttatattaagaaatattgtctcctgctttattttgttcttatgctccccagcaccttagagaatagatagaatgcttatcttgtttgcaggcatagccttcacataatcacagcttattcggttgtttctcctccagactgaacatccccagctccttagctatttctcttttgccatacttttttggtgagcatgttagtcattctcttctttatttgcttcagtttatctttttcttaaaagactcaagttgtccctgtctgggtaagacaggactgccttcctcccttcagttaatgaagcttaggaagttcttcattggtgccttttttgtttgtttgtttttttgagacagggtcttgctttgtcccccaggctgagtgcagtggtgctatcatggcttactgcagcctcgacctcccaggttcaagtgatcctccctcctcagcctcctgaataactgggacatggcttctttattctctgtagttcatgcgagattcagttccaccgaatccctcaagtactttccctaggcttctgttacttactgtgtcactcccaactcccttgcaacatgtgcttttggaattggctttttggaggcaagattagttaggcggatgtcaccccaaattggtagaagttgaaatcttctgatgactgggcttcggtgcagtaactggtgtttgccaagtttttgctgtgtttgaaactttgaaataggtaccttacagtggactgggtgagatcttaaggatagggagtctgccctggaggagttttttcagtctgtttttgaggaaataaagacctgaaatgagttaccaaaccctgtgtcaggatgtaagatgaagcggaggcactgtcagcttgtataggtcagaaggaaaaaagcagtgaatgagactgctcgggagagggctgagagaggatactgttggtgggagaaatgacagagagtgtaaaacagtgtttcccaaactttagtcatttgcacacgtccttcatggtttttaccatgttacgtatctcctgtgctaataactacctaatatttttcttcaaattgacctgcttaaaaaaaaaaaaaagaaaaggctaggtatgatagcttatccctgtaatcccatcactttgggaggccgaggcagaaggattgcttgagtccaggagtttgagactagcctgggcaacatagtgagacctcatctctacaaaaaaatgaacaaaattagccgggcgtggtggtgcatgcctgtagtcccagctactggggaagctgaggtgggaggattgctgaccctcggtggtcaaggctgcagtgagctgagatcatgccaactgcactccagcctaagcgacagagcaagaccctgtctcaaaaaaaaaaaaaaaaagaaaagagaaaaaaaactaaaacaacattttaaaagggaaacaatagcgagcccagaattaccaccgaaaatggaaatccagtgtcatcacttgatgtacgtagaaggtaactataaatagaataaaaacaacacccgtaagttctagccagatgctgctgcctgccgaaggctttgaacctgaggttccctcttgaaaaaggagattagcaagcattagaagctctaacaactagtatcaaactaagacattctctttgatggagaaagcttgaaaaataaggaaagggagtaactttctgtctctgagattcaaggttatttaaagcccggttcccgcattcgcgttgctgccttttctgcctctggtggagtgggttccacactttggaaggtgctgctgtgggaaatcctcaggcgttccttgggaggaagctgcagggcagggttcggggtaggggtttggtgtctgctcccagggccctgccctcgtcccatgactactgtcactgtcaccctctcaggtgagtgagtgctggcctggcttccctgtctgtgccccagtggcttctttgccctctggcatcggaaggctcccaggtcactggcaatcatgtctacaagggaagaaattttcagcacatcctctatacccgggaaaaaccggatccctgttatagatggggaagtgggttcagaagggtgaagggatttgcctagttttaactccaggtggtctcgatttcaaagcccgtgttctgtcagctttacaagagtttctcaacaggtgcattcgtgacgtttcagactggataattttatagtgaggctgtcctgtgtactgtagggtgtttaacagcaccccgggcctctgcccattaatgccagtggccacttccctgttatgtgacggcgaagaaatgtctccagacattgctctgaggggcaaaatcggccaagattgcaaaccactgcactgtgccaataggctgcttttggaatgtccaagactgcctggcctctccaaaggagagtagatagatggctttttgaatgtagcatgagaggcagaggtagagaatataggagcttctgcgtatgcctgaaagtcagtcaggtaaggcgcttttagttttctgctgaagattacccctcaaaaaacagggctcttatattcagatctttacaaagtcatttccacctgctactgagggtctaatggacacacttctctgtccagtctcagaaattggcatgtccgtccttccggttgctcagccagactccttggagcttttctaatgcccctgtcgaagcatcagcaggccctgcggctgtgccatcagaaggcgtggaggcctgccgcgcctccctctgttgctgctccaaggtcggctcagcactcttcactgcctagattttcacagtggccttctaacccatcaccatggccactttcaccctcgtaccctagtctctaccccgctgccaggatcgtccttcaaaaataggaatgagatcctgccaggcccctgctcagaatcgtccagcggctccccacggcaggtccctcgtgtggggtgcagagccctgcgcagcctgggccctcacttcacccggccttacctcctgctgctcactcctttctctccagctaagccacactgggccccttgctggtgaccgtgcccacccccctcggggactttgcacctggtgttcactgtgctgggaatcctctgaccccacagactgcctggctcacgcttacatcttttcagatgccacttgcaggtcttccttaaacaaccttggcacaagagctcccctcccacattgtccactttgtttttcttctcggctcacaagaattactcatttaatgaataaatggattactgagcactgtcttcattaccttaggttgaatatcagagtacactttggggagactctggagcctcaaatagccccacccagtgctagttttagatgcttatggcagtagtcacatgatccaattaattgaccagaaaaggataggatctcacagttacagatgttggaaattaatgagcccttttggtgatcactttttaaaaagcagtgtactgggtagctctgttgtggatgtcatggatagaatctgtaggattaatagggaaaaatggattaatgccagaccagggagtactattgtcaagtgatggcatcactggagatgcagaagtgctcttcctcagaccatttagacagggtggaattgacaggctctggaaactggctccagtgatcagcatcactagcgtgaaaggtgcaggtgatgagatgaaatatgggcagtacggcatttccaaatgcatatttcctatgtgagttgaaatgtgtacagcttacttgaccagtgcaattagtggatgtttgactgtttcctccaaacctccagaagtttctaattctgagccataattttgagtcttcacgctgcgaggatggggccttgcccgttctgggatgtggtgtgggaagcctctccctcattgtggcccccagagggtgctgctctgtgagtgatcgtggctgctctgcccttcatgtcccctccctgccagtgtcagaggagcagggagaggagacctctgggtcactgtgtctggtgcctgctttcagattttggaggcaacatcaacgtggagaccatcagtgcctttattgacggcggaggcagtgtgctggtagctgccagctccgacattggtgagtccgacctgggaggttctggtgctttccacttctccagggagttggagagcattacaaacagaagctgccaaattagcattcactgggtgggccttagctggggagtcagtgagggaaccgttttctcagttcagaatctgactcctggaggcagaataccacactgctgtccaggggtccatctggggctgagcccagctggatgaagctgcagggcactggggctgacagagagggagtcacaaggaagccaaggacacttggcccaaggcccccctgtaagggctcagctaggtgtctcttcggtctgtgcaggtgaccctcttcgagagctgggcagtgagtgcgggattgagtttgacgaggagaaaacggctgtcattgaccatcacaactatgacatctcagaccttggccaggtaatcaggcctgtcaccttccaggtttcaggggcatatggcaaagctctgcttagccaaaagccaagagggtgtgaggaggttctccctggcttggggaaccttttcctgaccacccacctttccatctactctttgcagcatacgctcatcgtggctgacactgagaacctgctgaaggccccaaccatcgttgggaaatcatctctaaatcccatcctctttcgaggtgttgggtgagtgagtgagcagggagaggacagcagaaacctgggggaagaaggggtcacttaatttttttgggaaatcaaggcaaaattgtaattctttaagggtacgtagatgggattaatttgttatattaaggccgagtatagtggctcaacctgtaatcccagcgctttgggaaggcctaggcaggaggatcgcttgaggccaggagtttgagagcagcctgggcaacacagaactcctctctttaaaaaaaaaaaaaaaaaaaaaaaaaaaaaaaagttggccgagcgcagtggctcacacctgtaatcccagcactttgggaggctgaggtgggcagatcacccgaggtcaggcgtttgagaccagcctggccaacatggtgaaaccccgtctctgctaaaaatacaaaaattagacaggtatggtggtgtgtgcctgtagtcccagctacttgggaggctgatgcaagagaattgcttgaacccaggaggcggaggttgcagtgagccaaggttgtgccactgcactccagcccaggtggcagagcgaggtctgtctgaaaaacaaaaacaaaaacaagtcagactccattgttatatcaagacaagagctaagtggttggcaattaagaaaaaaggattcattcctgggaagaactggctctcggggatcccatgtccttgggctcagttcctggggccagtgctgggctgctctcgtcctgctgcaggatggtggccgatcctgataaccctttggtgctggacatcctgacgggctcttccacctcttactccttcttcccggacaagcctatcacccaggtaagggcttcacaaccttgaggcttcgaaataaaaatgaagcagaacagcacatttggctgaggcgaaggaaatgactagttggtggggtggggcatgggcagaagcggtgtggtctcaggctcccccttcaggtagggccagggtcgttttggtctggcctgctgtcctcttgttcgggaggcgtggcagcttttcccttacttggaactgcttgggtcacagcctcgttttgttcccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtagctgccaggaggcttaggggccggggatccgggtggtgcagtgtgtgtatatggggaggactcagaaggggaagaaggaggcttttagctaaaagtgtcagaggctgagtgtttcaggtgctgtcagattatttcagggctttattgctatattgctggtattggcacttccaattttttaaggtagtagtgacttatctagagatccctaacctccaccgttccttttagaaatttgtgtatttgttgtgcagatgacaagcaaccagccatatcttttcgtttgtttcctgcgttccctttaaccatgagtccctaggtgcccaaggcctacaggcagaacttcgctagggtactgtcatggtggacatgagtggtcctgcccatcaggcaccactggaaaggtggctctggtgcccaagctgctcctgtttccctcctgcaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggtaagagatgtttggggtgggagggcccaaagggtttgccaagctgactgagctcagctcagaagcacttattgaacacttctttgctggcctaaagggcataaataaagatgaataagttaatccctacacctaagcatgccaggtgagatgcagagcctggcgtgaaaactgatgtcctaataggagcacttcttttgaagaggtgtgtgtatttgctatggggggcagcagtgggaggggcttcactgattaactctgcccaggaagttggacttaataagagaaataggtcattaggatgaatttgttaggcaagagaaagcgaatatggaagcatgaatacttgaaagtgcctggcacatgtcggggcaggagggtggtttgggtccagactttgatgggccatgaatactgtgtgaaggaatctaggccttcagagaagaggcagagatgctgtgttgggggattaaccttgctgaggagagagactggttactgatcagggccgggtggcaggggcatctgcaggtcttctgaactcctgggcattcctgccatgttcgtcgggtgggaattaagtgcagctctgcctgcaggtggtggaaggcctccagtcatggccagccctggctaacctggccttttatctcaggagtatagcatcgtgatccagcagctctcaaatggcaaatgggtcccctttgatggcgatgacattcagctggagtttgtccgcattgatccttttgtgaggaccttcctgaagaagaaaggtgagtgtagttcctgcacgaggatgctgccagaaacggccccaggcctcacttgctctcgaggcccaaccaggaaaagctctgggaaacccctcccggttattcttgttggttcttccgcaggtggcaaatacagtgttcagttcaagttgcccgacgtgtatggtgtattccagtttaaagtggattacaaccggctaggctacacacacctgtactcttccactcaggtaagcacaggtgacagcttctgttttcagctagcatgtgccctgcctgggctctgcagtggccaggtcctgccacctctgtcctcctgcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaacttcacctggccccggtcctggtttgctaatggctgtgggtgggggttgctgtgggtgatgactgactggatacaaaatcctaagtggcttcatgaaattttgcctaggactggactgtctttcttttaactgtgaaatgatggttctccctaacgtctcctcaaaggatacaagaaagttgttgttgctagtagaccgaggggtgggaatcactgaaatggaaaatctagatgacagtgctggggaagagaaaactagaacagctcagttgaagacaacctttactgcatgttgacgctgatttaggcaatagcttcctaaaaatcatgtataaagttagttagttagacatgaaatctcttccccaatgttgatacctgcccacaaaatattctcaccttcagagtataaggaatcattcttaaagccaaatattcagttcaaggcacatacgtcatctgcagttgtaaatttgcatttaatatttcacaattcctgtaagagaggctagtcaggagggaaaccctcaagtttaaatccccacacttacttacttactgctcatccgtcactttcgctaagtgagattaataattcagtagctggtccagaacgcacagcttgggaacgcagaggcccaggcctcatgtaatttcccactcccgtaactgaacgtgctgacccatgttgatgtctgccttcatccaggtggcaaatcagacatgctacgctgcccccttcaaacgagttcctcgtgttaggggcaaaggtcacagccaaactctgccactgacagccagtgccttggcctggatcctctctgtggatgcaggcctacccctcctcagtccagcctcatctactagaccagcttggccattcacttttcagatgtctgtgagcacaggactgcagactgaactctcactcaagttcttccatttgccaagcccgaggccttttccggctaaccagccctctctgcgctgtcttgtctcctgactcccaccctcaccattcacagaccatcacgacacagaggatgccaagttcttttagtaattcaccagctccatgcagggacatcacagggctgccctccatgagcagaggaggagggctgcctggcagagcgtttcacactccaggttagccagaaagagcatcttcatttttgtttccacacaacacttctctgtgagcctgttggccaacaaagtggcggccgattgttggaggagccagccaaccatcttgtctaacttcagattcttcagggctagaatatgttcaccccagaggcttagatgaagcacatttgcggctactcgggcagatggtctctgcaacaggaagggaagctgtagctagaacatctgttaacacagtctcaaccc

SEQ ID NO: 16293 - DNA, 133063 bp, Human
  misc_feature (1)...(133063): n = A,T,C or G
tagggtacccagtaaatttccttccttccttctttctctctctctctcttttttttttttttttttttttttgacggagttttgctcttgttgcccaggctggagcgcagtgtcgcgatctcggctcaccgcaatctccgcctcccgggttcaagctattttcctgtctcagcctcccgagtagctgggattataggcgcgcgccactacgcccggctaatttttgtatttttagtagagattgggtttctccatgttggtcaggctggtcttgaactcccgacctcagttgatccgcccgcctcggcctcccaaagtgctgggattacaggcgtgagccaccgcgcccggccaagtgtccctcttctagtccagcatccgaacagtagatttcaaacaaatacaaagttaagtggaataggcaacaaatggaaggggtgtgagacttcaaaatgtctcagagataggacccaaccaaatccttggcctcgccaagcgcccccatcactctggcagaacagctccagagaccagccctggccagccctgggtccccatctgtcctcccctccaagctggtagctcccgcgccctcttggtctgtcctttaatctcgcgcggcggggaccggcaggatggtggtctccccgcggttttgcctttcaggctctcaagtaaagaaaaccctcgaaactcctgatctcgagcacagcacaagctccgagctggcaccgggctgagtcaagatggcaagccccggactgaacatttgaatgtccctcagtcttccccgcgcccaagccccagtgcctctgccctagccgaggcctctgcggtcttcccgggcgaggagccgattgggggccgccggacggcggaggaccctgctcctgcttcccgaactacagatcccagggtgcctctcggactcgcgctccctccctcccttgctccctcccttcgtccgtctcctcccccggcccttgttgttttggctggaagcactccggcggagtttcagagaaagtctgggcagaaaccggagccgggcctgaacgtgggaaggggaggaggagagggaggaagaaggagcccggcggccgggagagggagggagggatcgggatctggggccgagccgctcaggacctgccgcgagccccggggtgggggaggcggcgggggaggagcgcgaggggacgggacagcgggatccctcccaggagccaagccgccaagcgcctcgttcctctgctgctccccgccctcttcggcggccgcgagagcggacccaccctccggcttgacctgcgacctccctgcgcccgccgctcagaaacgccccgcgcttcgctgccaaccctgcggctccctctgtgacccgggaccagccccgcgcccgctgcccgtaggcggctcgcggcttcccctttcctcggcgttcaccgagcgccgcgaagtgacccaccctcccccgaggagagggaaggaggatcgctccgggcgcatcgaaaccgagggcgggtgggcgggcgagcgggcaccgcgcggggcattgtgtgtgtgtgtgtgtgtgtgtgtgtgtgtgtgtgagcagcgctgtgtctgtttcggaaagcgctctggggaggtcttgtccctagggggcggagcgcaaaggacagaagctccggcaccgagtcggggcagagtcccgctgagtccgagcgctgctgaggcagctggcgagacggcacgtctggaggcgaggcgggcgcactgaaaggaggccggcgcgcccgcggccccggctcgcgttctgttcaggttcgtgggcctgcagaggagagactcgaactcgtggaacccgcgcaccgtggagtctgtccgcccagtccgtccggggtgcgcgaccaggagagctaggttctcgccactgcgcgctcggcaggcgtcggctgtgtcgggagcgcgcccgccgcccctcagctgcccggcccggagcccgagacgcgcgcaccatgagcggtggtgaagtggtctgctccggatggctccgcaagtcccccccggagaaaaagttgaagcgttatgtaagtagagctgcgggcaccactccgcgggcctcggcgtccacacccctccccagtcggctcgccggcggctgcagctggccgcgcgcggggctggttcttaaacgaatgccggtctctttccccttggcccctacccctggcgggctcgggacagggtgccttgcactccctcacgcccaggcatccacttggccggacaactttcttcctccaggttccagacagcctgctttgcgggcctgttcgccccataaaaggacctagacgtccagctaaactcctgctgcatgctttttttcttccttaggaaggatggggtgcgatggagagaggagccttcttcctgctttattcctgcatctgattattgggctgatgtgtgctaaagctcccgcaccgggaaaactgccgaggttttagggctcactagccctttctttggtgggcgctccctctcctccgcccctcgagatgggttgcgggaagcgggctgtggagctgaggagttggtagtagagacaagcatatcgaacgcgcgcaaaagggaaagaaagaaaagttattacgcgccctgccgtttgcttagcagggttcacattttcgcggttttgaattgagggactttggagtttggcccgggagccttggcggtttgctgcgagaggagggcgctgggggggagcctagtggctggtgtttgggcgccttggatgtgctgtcaaactcggcaggaggggacagctgaagccagaagggatttcagttgcggtcctttcccagggaaccagagtggctttaatggtgtttgtgtaattgatacaagatgctatgtgttaaaccgttttagctgttaggaaaaatattccttgaaagtatcaaccttgctttagtggaaacctgtgtcctcttcagaggtctgggatcttattcttcctccccattggttgttttgttgctgctcccttgcaaaggaaagaaatgacacttttgtgctgacatctggatcaaatatttttctagtaaaatgtgtttgcaaaagcaaaatttatgcccccttaaatataatataaatttaatgcctgtacgaagggaacccgtttgtcgttgaggaatatctacacccagtattagagctcaggttaatcctgttagtcactgtttgcttgtatagaacagagtgaagtacacagagtgaagtatttaacttcactgacaactcaccagtgaatttctgatttactttctgccagaatttattatagacaagtaattttattgaaagactcgatgccacaaatcataagaaagctctccagagatgtgtaatgcctccaaatcctgtccatctatcagttttcctgaatatcctagtaaaaatgctaactttattccaaaaatatgaacgaggcagtgtttttttttccagctgttctaaagagaaaggtaggggtgtgtgtgtgtgtgtgtgtgtgtgtgtgtgtgtgtgtatgtgacagagaaggaagggagaaaggggtagggagataaatatatttgttttgagaaggcccaatttaggaaaaacagattcttggaggaattaaagaataacatatttgctgaacgtgaaagtgataatataggtttaattcattctttcacatggttagttcatggctcactcaaaagacgccaggcactgtattagacaccaaccataaggtcacaaaatacagtaggaaaaaggaaaaaagccctgcctcttgggcttagaattcaattgaactattaaccaggaaagaaatcagccaaaaagattatgtcttaacaagaaaaacaaaaaggaaagtataatttgatcattacaactgttttctgaggtaggtgtcatctctattttacagaaaacagtcctgcatttgaacccagatctgcctgattgattggactgtaaaaggttaacgactctcacctagttcatttcaaatgtggagcttagactaggttatctctaaaggtccttcaggctcacacctgtaatcccagcactttgggaggccgaggccagtggatcacctgaggtcaggagaccagcctggccaacatggcgaaactctgtctctactaaaaatacaaaaaatagccgggcgtggtggtgtacgcctgtaatcccagctgctggggaggctgaggcaggagaaatgcttgaacctgggaggtggaggttgcagtgagcagagtttgtgccattgcactgcagcctggatgacagggtgagactccgtctcaaaaatagcaacaacaaaataaaggtcctttcagattataacttttcctgactctgaatattagttgagaatacaagaatgaggtggactatggatcaggtgcacagtgctaaagaaatgtaagacctagtctttgcctttaagtagctctttgagtctttgggaccacgagacaagtatatgtgaaaaagccaacagtgcaaagtggtatatgactgtgtgtctaagttgagtggtatgggtattttttggctgttctgaggaacaagttcaatgtagactgaaactatgggaacatttgagagagacagtgggctgcctacattgtgttttccacaggaggatgaatgtgcctaatagcttgggagaaactaggattttctttgcctggtgtagcactggtgttttctttacccacgaataaagtagatggagatagtcctggaagacagtagacagggcggctgtcagaatagaggaaaccagcatggagtgtaatgagttaaataaggcttatttaactgtcaggttaaataaggcttgtattttacctgtcaggttggtggcccagaagattttgacattcccagattattgatcttttggctttgctgtccagtttagatggtttttgctaaagtagctttgaccatcaaagatatagacatgtatacgtgcatttcctatgcttgttttttttatgtagaatgtttatttttctggataaaggaaacattgttggccacccagtaggcaaaatgtttgtggataatgatttgtaatgaatggatttgctatgaaaagatatcttggatgcttgatactataattattaaatgagacttcagggagtttgagcatcatgattctgtttggaaatatttggcccatgggactttgacagttgtctcactgtttacagcatttatagggtagtccgaacactgattaagatgatccataagggcttttaagtgacaaaaaaattgttttagttttttttaattaatttttttttgagatggagtcttgctctgtcacccagactggagtgcagtggcactatctcggctcactgcaacctctgcctcccagatacaagcagttcttctgcctcagcctccccagtagctgggattataggcatccacctccacacccagctaatttttgtattttcagtagagatgggatttcgccaggctggtctcaaactcctgacctcaggtgatccacccacctcagcctcccaaagtcctgggattacaggcatgagccaccacgcctggccttaaattgttttagttttagctttaaagccatctcatatatggcccccaatgtattccatttacagctccgttttatgtttactgtttcatagtcaactcaagcaggattgttttttgtacacgctagtgtgttagtctgatgtgtaagcttttcttgaattttctaaagaatgacacacaaaaaaatgaaagtcaagagtagtcagcagattccccagcttttccttctctttttaattttttctatattcgcaaaaggttctttcttgtatgtgtttcattctcctggaagtttttaaaatctacttaaaatgtaggtgaaaattttaatgcttcttttcagggttgctactgtggtgttgctgttttcatgctgtgttatatattaaacagctgcttttttactttgttaaggacctgatggaatcataaacagattactgtcactaggattacagaaaacaagtaaagtcttggtagtatgcactcaacaatggtgctcagatttttaaagaattatttaaagaaatgatggtgaaattttcatcagaacctgaaattttagctgaaataagatgcaagtctgtaaataaagtattgtttcaagacagctggctaccaccatcgctctggaggaggagcttccttgcctgaagcccaaacactaagtttgggctcctccatagcccagctgtcagcattgggcaggtgcacaatctcagcaggagaacctgcttctgaggccagagcaaggtggcctgttagctgacagccagcctggtagcaaggccccagccagttcttaggtaggtaatctgtacccagcgtgggctctctgtctgctctgcagctgtcaattaacaggacaactcttgtctggacttcaaaaacacacccctggttctggaaatgggcctagaaacagaaatagcctctcctactgggtgggcacctgacatctgacatggaggagaggggcgtgggcaggccaagtgtcagcatctccttggttcaaggacaacccaggacctgtgctaagcatgaaacccctgctcaatagtgtcactacaacaaagaggactgtcatgtctagaagctcttcctatccttttttgacaattaccactagcaatcaatggattctgatgtttctgcttacagtgactgaataagcataattattctattgaaggaaattttttcttgccatcctcatgttagtaaacataattcagactcccaatgtttttaccttttcaagtgtagcaagaatgttttttctgttaacagagatcatcaacttgcaattacattaagcctttatgatggttaatgatagttcatttgttgtgcctgggctgaatgataagtgtagaactctccacgtgcaacttgctgaatctccaaatctgattgctaccttttgagattcagaattactgttaggaaggtgcattagtttggagggggtagtttgagaattctgctggctctttaaaattatttttttaagagatcatcttggaacaaaaagtggcaagagttatagttggataatctgtttgacaagtgactggttatttcagtgtattttgccataacctgcttaaaaatgtaaggagtaaaacacacagcgttttttgagagtaagtaaaatcccatattttagacttaacataaaaatatgtagataagctattgacaatttgcagactgagaaagtttcagaggtgatagattcttttttttttttttttttttttttttgagatggagtttcgctcttgtccaggctggagtacaatggcatgatcttggctcatggctcactgcaacctccatctcccggatttaactgattctcctgcctcaacctcccaagtagctgggattacaggctcctgccaccacgcccggcaaattttttttttgtatttttagtagagatggggttttgccatgttggccaggctggtctcgaactcctgacctcaggtgatccgcccgcctcagcctcccaaagtgctgggattacaggtgtgagccaccgtgcccagccagaggtgatagattcaaaacatgtgttaggtactcagcagtcctaattttcttacagagactgacagccagaaggagcattgtagtagatgggctactactttacttttgaagaattttgtattaaaatgtaatttgatgcacccactgatgcttttagtggggatgttttgctatagtggaaggaaactcagactgagtgtcaggacccggattctacttggttttgccattacccacccacaggagcatttgaccattctgatcctcagtttccttacctgtaaaatgggggagggaggagctgtagatcttcagcagaagccctgttgcagtttagcgttcctcttctcagacattttcttgggtggaagggacaaatggggagctcttcaataagctgcaacataaatttttgggggacataaatcttccttgtggggaaatctttactatttatcttaaatagtttagtgactgcttaagcagtattctttggggactcttggtttttaactgaaggcagacctgcatgcagggcctttggctgctgtgctcctgggctgggtgctgtgtcttgagcccctgtgcaatgcctggctcagagtaggagctcaacagatgcctgttgactgaataataaacaggtatcgcaggagcttttgttatgtgccatgtgtggaatgcaaggaaggaaaggcccactccctgcccttaaggagtttctaatctgtttgtgaagacaagctgtcagtcattttataggagctatgatatatgattagttgccaaatgaaagtttagagtgagaacaggggatgcaggggtacgagatgccagggaagactccgcaaatgaattttacactttgcttttagaagagctggtgtactgctggcagcaacagcaaaatcttaagggagggctggttttaaaggaagaacaaagatttgtgttgagtttagatgtcctcatgaaaaaaactgcttcccagcaccccagtttcatgtgaggagtttggctgtcagctgtatcttctagtttgagaagtttttgtttctgctaagatctaatgttcctcatgggttcctgagcacaagtgaattttctgcatcaaactagaaatgaacaaaacaacttgtttggtcacctgaacttattaaaattccaagggacatgagttgtttaagatttctttatgtctgttttaagctaagtaattcattctggcaagcagttagtttacaacagagagggagcatgttctggtgggagggagaataaaagagcctttgattcatttgcttctgagttccagcagcaggaccagggctgccttgggctagcgtcttatttcggactttggaagccatcttagcccagctgtgtgagtgccagctcgtgttgggggggagagaataacaccaacggatcacatgaaaccccctctccctgtggatggaggggtttctctcatttcacattcctcgcatcaacatggcgcctaatttccaccaagttagagctccatctgaatttgccatttgaacttggattgaagtcacgatctttctgtgactccttttatctcagtctgccaactaatacagaaaacttatcaagtcacagttctctttattctcccctcttggggtataacacacataaaattagcattctttcttttttatattacccctggcaaaaagtggcccattgtactgtggatttccatatttattaaataactaggctcttccgttgccagtgggatggctataggagcctcaataaattgtagatgacaatttaggcctgtagaattgctgagaaaagtcatttttaggaactggaattttttgctcattctaggcttctatgtttgagcatcttaaataatagaagaatgccctaactggaaaaaagaatcatttctcttttaagcaattcacttattcataggagcgaagttctccctagtttaaaaggtcgcattactgaataaagtacactataacctaagagcttttgaccttctcccagcccgtttttaaaaagaattaagactatgcactgtaatgcatgtttggttgttatctctgttacattagctcttgaagcattctgattacaacttgtagctgccaagccctgtcctgcagtattatctggaacaaaaattttccatgtggttgtttttagcagagctactatatgcaaactgcacgtgaaggatataagttataaaggaatagagcttctagaaggagaaatgtgagttaacttttttctaccatttaatcattctttcctcacctcttagtgtgtgtttcaataatgtttatcatctttctaaactgagttttcttttatttttatatattagaaagaatgccaaatttaccaagtgcttttctgatggtggttttcttttctcccagctttttactttgaattcatacttggcctaggtagttctcttaagttatgtgttcaaaaaacaatgtcctaagaggaaaaaacaaatggccacattgtctcatgaattaaaaacaacataccaagagtccaaacatttcaatgtaaaaatattaagcctttctttttttaggaagacaaatattaaactttgctttaactatcctgttgtttttcctttcccttttttatttattttcttttggtttgactcatgtagtttaaatttattttgaaaacagctttatacatacttctttaagaatactgcacgtaggggaaagcatcaaacttccattttacatttcaagagaaaagtgagaggaggccatcctcctgtcagaagaggggcaaaatgtcaaataataccaaggtcttctaacttacttttacattgcttggttatttatcattattgcctagagatatttagctatttaaacatgaaataagcaggtaaatgtaatttaagttaagcaagtttcatatttgcttttgtgaaacgaaatcctggacataagcattggaagaactcaactcattttgttgtagtttttgttttaaatagaaaatagagacagggtctctacattccccaggctggtcttgaactcctggccccaagtgatctcttgcctcgttgtagtttttattgttgtatttaactcattagccagccagttgttgtaacattttatttgctaactttttaaatgagaggaaggtaaaagcactctgtgccatagttccctactctctcttttcctattcatttctgcttctctgtgatataagcctagacatcaaaaatcacaaaatatttgtgtcccaatctttacacacacattctttcacgaaacttttctctaaaaagagagtgttaatttgtgtcactcttacttagtaatcaagaatagaaataataatgttccaactagcatgtagatgtttttctctcctgaaatgcagcttttagttactgctgtattgggaaatgtggttaggccactttctgactggcagaactcctccctgagatgactacctgatgaaagaattacctgcctgtgtgccttcccagttccagtccttagcacattcccatcactgctgtggccagagttggagttgccaagactaaggtgctggtggagggatgactccttgattatcgagagagaagtgctttaatctttgacttttgtaagagagatactaggtaaaagctaccttcagcgttttgaattccagtgctgttgtgtagagcttgatgaggaacgattacctcattcagctagggaggtattttttgaaccctctaccctctggcaaagttataattgaccccaaagttatgtaggattatttactttacatgttcttgacagtttcaggtttaaatgtttgaagtgttgagaaaaggtaaaaggaaatattgaactcctaataatgtaaaatatttgggaaggtactttgttcctagtgatgctgttacataaaaccaaagccttctgagtaatctttgctgggtatgtaggtcatttacctccaaagaaaaaggcacacaattaaactggtgctgttgaacggtattatttttctttctattcctttaagcagtcaaatagttgagagtcaaatttataaatgttgactgtttcaaatgggaaaagcaagcgtaatatatttttctagttgattttcatagtgacccacagtatacagagaaaaaggtatatacacaggaatctgtgaaaattatggcttcatttatcattcttcggtgtttgtaataggatattaatttccagaggacagagatggcatttgttctcttgtctcaaatatacagtatggtgccttgcatatactcttgaacagcacaatcaaataattgtagaattttgagcctaaaattgtaaattctcttgtccaatgtttcttaaccttttctaacccactcctctctcatgtattgtttgagtgtcctttggcttttaatccagttttactttctatgatttgcattacaaaaacaatagctatattgaaacttttttctaattacacatatctccttctccaccagtcaagaatccaacccactccttttacagggaatgaaaataagcctaagggaggtgaattgattagtccaaagtcatattacttaaccagttgttctgttggggtccatctctcccctcccagataaaatcctttccgtcagagtgaatgcccacatgaacagggcactgtgaagaatgcaaaagaagaggaccaagtgaacactgttttcacctttgagagctgtgtgctgctaggggacataggttgcacttagttctacaaattacatcatgatcagtgatgtgtgagacattctggtagaagaatccagcagagaggttaattcaggtactctgtgaaggcttaatgaaggtggcaagaggcatttcaccagcaccttaaaagatggattcagttttcaaagatgaggctggagtaagatctgatttctgtttctccttttcccagccagactcttgcattgttgtttacatttggctcttcctctttttcacctgctgttcatttcataatggaatacagctgggtcctttttccatcacccttatttaaacaccagtctctgatgttcctaagtgttggagttcttgagggttccagtgctagccctggttggtctcctcctcttttcatctttgttagttggttcttcatctgttgtgaaatcgtgaactcctttgaaaatttgaggctcccagttcccataagaactcttactaacttatacacaaacattattataatcttggatgttttctgacctttaaagctcatctatggctcttaacacctagttaaatgccctgaattatatgttgataatttgagtactctttctcagcccatttctcattccagatctatggctctaatggtttaaatccaaaactgcttatatagcccacagcaactcagagtcagaatgcccacagcagatcttatcatcctttcccttaaacctggtcctcttggctgttccttgtacagtggctcagccagaaggttttctttgacttttctctctctctcattctccacacccagtgaccaaaccctgtcggttttaccttccaagtatcttgatttattggccactcttgcctaggcgatatttgcctttcttctggattgctgcaatagccagttgcagttgctgctctctgcctcctcttgggcccctcttagctgtcttatcaaggcagccagagtgacttttctgaaataccaatctgataatgccattccatagctcgaagctgttctgccgcgctcttttgctcttcggagtgcctctgcctcttcccttggcttgcatggccctttatgtggcagcagcacatccatccagtagtgtttgttgcttccttctccactcagtctctccccttcagctatactgaactttcatggtccagatcagctctgagatctctctctccgggcctttgcacatgctctcctctcctccaggagtccttgacactctcttttctgtctcacaaccaggctaactttgggaaccttctctgaactccaccaccactgccacatgtacacacagacatactgtgctgggagcatctgttttgtcctcctgtcatgctctgttattctcatagcatagcacttgccacacttgatatttgcttgtttacttgcttatttcccctcccatggtggggccatgttgtgacttttgtgagccccaggtacatttgccttcataggtcccccccttcctagattaaaatattctaacctggagtagttatatattatttttcattttttattttgatttttttttcacgcttaattcactttatttttcttgtataaaaaccctacgttgtagccacagctggagcctgagtccgctgcatggagactctggtgtgggtcttgactaggtggtcagtgaagtcctgatagggagacttggtaaatacagtctctttccagaggtcaggggtcagatagctgtaggtcttagaaatggcatcaaaggtggccttggcgaagttgcccagggtggcagtgcagccctgggctggggtgtagcagtcatcgataccagccatcatgagcagcttcttaggcacaggtgcggagacgatgccagtgcccctgggtgcagggatgaggtgcaccagcacagagccgcagcggcctgtcaccttgcaagggacggtgtggggcttgccgatcttgttcccccagtagcctctgtgcacggggacaatggagagcttggccaggatgatggccccacagatggcggtggccacctccttggagcacttaacacccagaccgacgtggccattgtagtccccgatagcaacgaatgccttgaacctcgtgcgctggccggcacgggtctgcttctgcactggcataatcttcaaaacctcatccttgagagaggcccccaggaaaaagtcaatgatctctgattccttaatgggcagagagaagagatagatctcctccagggacttgatcttcatgtccttgaccaagcggcccaacttggtgacgggcatccactccttatcctcggccttgcctccgcgaccccggccccggatgccactgccgaaacctccgcggaagccaccgcggttccccatcccagggccaccagggcctccgggccctcccgctgcaccggcgtcatccgccatttggtgttttctcggaaaagaagctgatttttaaaagaaaatattaagacactttttgtgtgctcctaaatgtatcatgggccccaagcactgtgccttctgtctgatggatacgttggccctgttaaatgaacagaaatacttttaagataaagttgacagcatatgtcaactgcctgattgggactaagaacggtgaggagttactcagttattttgtcatgtggcactgttatcatggcttagctcactaaaacactcttaaggctttgtgttttaggctgggcgcagtggctcacccctgtaatcccagcactttgggaggcggggcgggcacatcacctgagttcgggagacagagaccagcctggccaacatggtaaaaccccgtctatactaataatacaaaaattagttgggcgtggtggtgcatgcctgtaattctagctactcaggaggctgaggcaggagaatcgcttgaacccgggaggcggaggttgcggtgagccgagatctcgtcattgcactccagcctgggcaacaagcgtgaaactccgtctcaaaaaaaaaaaaaaaaaaagaaagactttgtattttaggccctggtaatgggaaaaaaattatgtatagatttatataaaatatatttaaaaatatgtatttaggagcaaaaattgattatgtaaaaaaatgtgttctatgagctgtttgactactacgcacatttcttcatgatgtttctgtgtacagcagtttttagtagaggtgggtaggtgatttgtcccctccacgggacattttgaaacaggaaaggttcccttgtccccctcgcagggcatgcaatggggatgtgctcacttcttcagggccccactgctcaaacctctaggggagcatacagaccggcaggccgaggggctctgaccccaccgcagtgtctaggggtgaaagtttacagctgaggccccagcgggcgtgtgttacggggtgctcttttagtttgccgtctataggcagcttgtgttaaccagttcagttagaccccctcccttatcacaaggacagagtgatttctgtatcccagtgtttcttgccttggtgtaccagaagaattggatcacacgtggggctggagaatgagtgcaaggttttattgagtagaagtagctctcagcagatgggggagccagaaggcagatggttttcccctggagtccggccactcagccgcctgactcttctccagcttctccggccataccccgagttgttcggccagtcgatggtcagcttgcctgcgggtgctcttccgcggtgtcttctcccgccaacgagttcgtcaggatgtccagccgcttgtgtctgccacctagggtctggggggtttttataggcacaggatgggggcgtggccggccagggtggtcttggaaaggtgacctttcggcggcaaggctggagtgcctatcctcacctaggttcgtggggatggatccctagtcagggaccacgccttcctctaccaggcacttcccttccccacttccatatcatttaaagggaccaggctcttcccgtcccagcacttccataacaatttgacaatttctggagacattttggttgctacagctggagggaggaatgcttctggtatctagtgggtagaagcagggatgctactaaacactctattgcacagatttatctggctcagaatatcagtgtgctgaagttgagaaatcctcatatagaggggttcataaagcttggttcttacatttattttattcatttagtatatttccctatgttgccagttggattgtgtcatagcaccggaagcaaacatttatttttctgactgaagtaatgtttgagaaaaacagtcattgagatggctgagcctttgatcactagagggtttaggtgataggcaaattctctctccaaggatctgttgtcatttaaatcattaccaaaatactcatttttactttgctctcctagcttagagtacagccaattgttgtctggtagggggatgctgagtcatttattcatgcattttattacctcttggctgcaatatcaccattcattgttcacaagccacccagcttgtttactttttataaattacatgtaatcaagtcctcttgcaggtctggctactgtaattggcagcagccacagagcagggctgacaagtctgcatttatgctgatgtctcatattcagcccactctccaagctttctttcctcttccatgtgtattttagaaggaaggcaaatagaaggaatgcaaagagagaactgttaaggagttttctcttttcagatgatcttaagatacttatagcttggcagagtccttgtgtcatttggttgggaaaaaacaagggtctagagcagtcagtggtccttaaacttcagtgtgcataacaatcactgggtaacttctaaagtgaagattcttgggccctaccctccttctaatgtttttattaagtctgggtagaggtccagaaaactgcagtttctaacttgaacccctgctgattctgaagtagatggtccttaggttattcttggagaaatcctgagttgggcatagagggaaaaagagacaagaaataaaattcaatagaagtaaatacttataaagaaagcaagaaccaaaactgagagagtaactttaacctctcttctgtgagatgaagggagtgagtatgctgtgctgcttaaaaagataagcgtttagttttttctggcagtgaatgagatcaaactgtcctccaaagacgacatattgagaggattacagaagtgaaaaggaatttttagaaaggttagaatatgagaaagtacctaactgtcgccgagaaactcaaaagacatgattaaatcaaagaaagtgttttgtaggtatctgtttaaaaaagaatgtgcattcctgaatcaagagtttatgaatagcttaaagatgaagaggagagatgaaggaggattagctgttcaccagaagttctggttattctggttattggatctgaaagcatattattaaagtatcgtctagatttcctggaatagttctcatttctaatattctttcccattgtttttataatacatgtctgatttgccctaatttttggttagttgaggtgtggttgatttgtaaaagaacaccaaaagtgggtctacttgactgaagaagctctcttgctttccaactttgtgtttgtgtatgtgtgtgttaaatgtatgttttctaatctatctcttttaacctaaactttgattttaaagtccacattagagaaagagcaatagagacagactgactccactttagaaaattggtcaagaagtggaccaggtgggaatggttacttaatcctagcagaggaataaagtacttgatttccagctacctactgaatgcactctgctactagacagctattcttatttttttttttttgacatattatttccataggggaactttatagttcaattcagtaaccttggagagagatcctgaccaaaaaaaaaaaagagagagagaattttggaagttacttataaaatgatgagtatcaccagcatttgttaaatcattctttctttattctaattatctctgtattaaagtattgacttttccacatacatgctctagaaacccaggttgtactttagaacttttcaccactatagtatattaactagcttgctaatcctttttactgtctttcatgttctctccctgccatctgctcacaagattttatagaatcttcatatctgctttgtaagtgttgaggatcattattgttattgtacgaagtgtctaccacaccctctcattgcactgagagtccgagtaagtttagttagtagatcactttgctctgaagtgaatagaagggttgttgctgtatgctggtggagacccaaaaccagcttcttccatttactcaatcaaggaaggctagactcctgtgacttgtaccctgcactttgaagactgggctcaggacttgctctcttcatttcaggtgaccttattttcttgctttcttttgtttttaaaatcgtacacttggtatatatcttggtgtatctcctttttatgagcctctgagtattcctaactttttttcagatttttttttcttccttgttatttattctaactcatatactgtttaacatagtgatgggtgtttccaatgaatatttatattttctgaaaacaagtgtaaatgctcttagagagaagcataacattaaatagctatccaaatgcaacattgagaaatcacttataaattttcagtgggggtattttaacttacagttttccattttgagtttaaagtatagagaaaaaaagggttacaaaatattaggtaagcagatttattgccctttgcctaagttactaaagggaagtgtttcttttaaaaaaaacttagtgtagaagatttatcattaaactataatatacatatttgaccttgtaatatttttgtttacttatatttgaatagaaaatgtgcatagattcacttaaaatgtgtagtacattgttattcattatttctttgttttaagttataatttttaatactcagagatttccaaatctttaatatctacctgcttatgccagtgattcttaaataactaaaaaatactcttttatagtagcttttatgcacaatacattttttagcaaatgtgctttgccccaagttggagaattagttatatgttgagaagcccatgcttttactaagtgaaattgaaacatagatactgaaatatttttcatccttcaactaagttctagcattgaaaacatctgtttgttttcaaacaggatctgttgtttttctaaaccatgtacttccaaagcagaacagattttcttcgagatttttattgaaatacctcaaggagaagaaaatgactcaaagaggataaaggctaatttttcttaatgaaagaagaaaaacattttttactctttctattcttaatttaggcctaggaaataccctgagtccaaggccagctggtttcagcatgcagagataagactagaacacagcttcctgatgcccagaccagagctgttctcattaccatttctatatccacctccatctttagtgggttgctgtgatttccagcattcaaacccttgcacatttccagagccttttagctgtctcgtggagcagttcatcccaattgctgcctttttaatttttattttcaattgtgtttaaaacaaaacaacaacaacaacaacaacacataacataaacttgaccatcttaatcatttttaagtgtacggcacagtaggttaagtattcagattgttgtgccagcccaatctctcctgcttcaccgttcaatctcagtaacattggaaacaacagaagggtctttatgcaaatacctgtcaggaaggcgtgcgcctcacctgtgtttgctccttcacagtagtaggaagttaattatgtgggatttgctcacctgatccacacagctgatcctactgtagtgcacatttggaaatcccacacccctttcttcccctgaggaaaaaattctttcctcatcctagattcagtgctctgtttaatcttgagcatatgagaatgagtcaccatgggtaagagtgtaatctcatttatacctttcttccaaccctcctttaattttttaagtttatgatactggatcctgctttcctacataagggctggtgatttggagactaattttgggagtgcgaggtgttgagattttttttgggaaccagtgctttctgttctgctgaacatgaagctgcatggcctaagttctgaaattcaggctatgtatggaatgtctgtgtggatgaagaaacaagccaatgcctttttttgggtcggggccggggggagactgggagaaagatgaatgaaaatgttaagatagtctgattttgtgggggaaatattcaaattttgagaatttgtgcaaatcaaagacaagcagttagttgctttgtgattttattttacccacaaaagaaatacttgatattgtgctgaagatgttgttgaataggtatattaactcagataaaataactgagttctacttttgattccagttatccctatctatgcaatgtgtaaatgctatttccatttcttcatttgtggaatgaaaaacatttcactggaaaattgtttttaaaaaagtacttgtaaagtacattggaatctttaggatactttgaacatggtgcttaaagaatgtaaatggttaatgcttgctttcatacccaatagaggaatatgggagtgggagtcacttgaatatcaaaatgaaactctgtatccatttttaaatacagtatgcatttgagcaaagcccttctccctaactgcttattttaaattggcagttgctcagccaacagtcagtaatctcagttagcaagtgtttggcacgcctgttttaacctgcacaggttcagttcacacaaagaaagggagggttgggttatgtgatgcaaacaccacgttagcctcattaacatattttgaataactgtatttgaatatttgccagctaagctaggccatctgaaggcctgccaaacaaaatgggggtttctgcgaggagtgcagagatttgagcttgtaaactttttactttttcttcttgaggggaaagattttagatgatgctatttagaatactttccataccctctcaaaagaacaaccttttttgtgtgtgttttaattctgcagaaattttggactttctctttctaccacctttttatatatctttaaaagaggtaccttaggacatgtctctgaaatacctttaggtaatctatcctgggtgggtttgagtttctactcagcctgtttttttgtctttgcagaatttagtcctgaagctctttctgtgagtctagctggagaacctcttctgcaaacttaatgtgtgaataccagtggttggaacagaacagataggataaactagggtatctgtaaactcctacctagtggatgcccagatcataaagatgccagcctggttcaactctatatagtatagacattgtttttacaagccttcagttttgtggcctgacatctgtatctgttcagaaatacttttttgactttgacacctgtctggctgaaaccacaactttggactctaaaactgggcaagggaggagtccattggaaccaggggttatcagatattttaatatacagggttttaagggtgagaacatgaggcagcatacacttagctctctagttttcattctgggggacaggtgaggggagtatcaaaatcaccagggaactctttgaaaatcattcaccttgattatttttttcctgtttacctgttgtgaagggtgggtagggatgacagtgtgatgaggtggcatttgaatctagaatctgcggaagctgtgggtgctgaccacagtgtggtagtttccatagtttgggccaatttgcaacctgtcttgtacttaccctttggaatagaaagatacagtctcatgatgccaactctcacccctccttaagtgtgtatttagtagtatttccaggaaatgattccttctaccctaagggctttttcctttcctttatctcttcaaagatggttcttaagacttagttttaaatcatatatatatatatatgaattatcagaaagagggaagaataaatttgagcattcctatttttttatacatgttttgtaaatctctcctttagtggaagggaaagaggatgcaactatgctgagaaatgtgtctgttatataaattgctattttaaaaaaccacttttaaaaactaagaacctaggaaagaactccggtacgttaaaccaagccctaaattttcaacagacattttaatgattatatattttatacgttgtgtgtacgtgtgtgtatgccttaaagtttttagattgaagttattaaatttcacctgtcttttgttgctcttaaatgatttacatgtaattttgtcagtgattcttacatgatcaccatctactcataattaattgtatagacacaattttaagtttcatagctttttttccagttgaattgtaacagcctgtttaaaagacaaatttataggcgattgtaatcttcatgaagcaatgtgagttgatgaatacctttgaatgttgtttcggtatttttcttttttattataaaatgttaaatatttcatttgtagagcttctctcatgtcaatttgttgtatttgacacaataggaatactcatgcagtgttaccagtttcgtgatatgcgttcaacatctctgaaggtggtgaatataaaatctgtttttcaaacaagtacacacatgaaactaaaacaatttattcaagtcctaaaacaacgttagtgaaacttcagttctgccactgtgcccacatttaagctgacagcatgtgtgtgtgagaagaagatacacattactgataatctctttagaatgcattaatattttcaggcccaaatatgagtattcagtaggttcatcagattaaaaaagctaaatgaaatttaaatattgacttgtatgtttcctttaattaattttggtgacttactaattggtatttgtggggatacgtagaattttttgaattggtgtttgtattctccatgttttagttataaagcactatgaagagaaagtgaatgaagaggctgccttcaggtgtagtaaggtttaacttctatcccggttccaacttgtcctgctgtcagcttgctccttagctccctggcttatttacatattgtataatccagactggcttgtcccgtttggtaggttggttataaactgcagagctaagtaaatgtgtgataacattttaaatggtatgagaagttaaacagtacttaaggagtgatgtcgtaaagaaccccagctgtcaggtgccccagggttggcctcctttggggccatttccgttttctctgagtaacaggaaataaatgtgaaactatagtaaattctggtcagatgatgaccccctcatccagatgagatgtagcatgctggatctgatactgaaaatgtttgatactgaaagtagattattaactatttccattaatgagttttgtacacaggcagaacaaatcaacaaaaaacccacggaagcatttttatctgtctttacccaatatgaaaacagtaaaggctagacaagtcctgttctcctcctccctcggtgtataatgagagaacatttccatgtgctttgtgatgaccatttctagtggctgcatgatactgtgtccagttgtaggattattgggtttcccaaaacatcactgctcttcagtgtttaacattatgaaaagttgtgccttatcccctgtgtgagtgctctaagctctctgtaaggctgtgtgccctggtcattgttgagtatgtccttttcatattcatttataatcaggccagccaaagattggaatctaatggtggatgtcaaagtctttcctagagtacctcttccttccctactgggtctctctgagattttcaggggttgccagtggcaaagggtgtttgttaacccctaaagtgatggtgatggtttctccctattgtgttatactgtgcatttgctccaatttcagggttccttggttcaaaggaacgctggggaaccctaactttgaagatctcaatttgacagcaacctgcctttttccatgagtcactgttagttcaaaatacccaaaaagagattctcatttctgtaggttgggcaagttgcagcctgcttgattttttagtgtctttggtttataatgattttagagagtagaagaggaaatggctgtttattgtatgttgcataaaactatatggccttgtgcaaatgatctaactttatatgaatcctggattgaagacagatgtttcttttgtataagtagattcaccactctgtgtcctactctgaaataatgagggggagaataatcccatatatatcacatcaattttaaaaaaccggaattcaagaactgggaaatttttcagtttacattctcctgattctgattttgtttcttacgttatttttctattttaaatttgcttttattatttgagataaaaaatactttgtttccattctaagttttgttttttgaactaaaggttaaaaaacctgcattcatggaattgttgccttttcagtggttaactgttagattttataatcagaagattgagatctttaaaggacaaaatggaaaataaaattaggtttggggtaaggaatcctacttggacactacaaaaatagaaggaaaaaaaggtgaatgaataattggcaaaacaaactctttttcctgtaagttcccttttcccaaattcttgccatcatgctaaaaaaagttgtctcgtgggttgatttttctcagaatcctgatgcttgttgttaataagaatttttttcatgtgccaaagttttgtttttcgtgtgacttctgcggcaattttggtcttactgaaaatatttttttaagtaccatggtaaaagttactggtaataagccaaaaggagaatttaaggtgaacttctatacaatttacttttattgactaggggaaatcaaatgcattgcccaaggtaattgaagtcagattattgtaggagaaatatcaattctaattaaaaacaaagtgtgagtgcttatttccagtttcaaaacttacattttttaatttctacctcatcctttccccaacaagacatatttttgctatcaggctaacataaagtgctgctactgactgagccagcctaatggaatggcatcactgtttctgttggcatagttaagcagggggttaaaaattcaagtttttgggaaggagtttttttttttggagggatttcttttgcaatacgcaaccttcagacattccagaaagtaactgtggatgcattttagggtatagccagtgtcctttgcatctttcagtctgataggcaaaatcatattttagattactattaaaacagcatgctgatttattcatcttgtccttccttttaagaaatatatttcagaaatgctagtaacatcttgctcagcagctcactctgacaccctgacttactcttactggggagatctcactgttttgtttgctctgcagatcttatagtggcctttgaccaaaggcaatgaaatgttacctgacttgcagtatcagtcaggattctcagttacaagcaatagacatctctgactaatttaatcataaaaggagtttattaagaatattaggtagccacagtttctctggaaaagctgagaactcaccttggcagcttatcagccaggatcaatgatgctgaactgatctggggaatatattgccactgcctcctggcacatgatcataggccctgcatcttgcaccaccagcacagtcacacgagaccccaaatgccaccaccgctgcctttgggaactgcatcactgcccctacctctggcccaggtttctgtacggttcttactatttgtaactgcttgagattctaaatctgggatggattatttggtggagccagtgtacctagtaatgtgactgcagtctgattgcaggggtggttgaaaaagcagttacttggagttttcagcttttgaagtgttgtgtgtggttttttttttgttttttgttttttttaagaaacatgatcttgttatgttgctcaggctggtcttgaactcctgggctcaagcaatccccccaccttggcctcccaaggtgctgggattacaggtgtgagccaccacccctggcctgtagtgttaattgttaatgattttccaaacataggaaggaaagttcagatgctgggtaacctaaaagaatcacataagtccaccctacatggcatactggaggtggaggtggaaggatagaaaaataaggacaacagctaccttcctacattacttaagatgctaataatagttatgagaaaaatgttataacagaacccatagtttctcagtattttcgtaatagcagcatccatatgttaccagaaaggggtcctgagccagaccccaagagacgggctcttagatctcctgcaagaaagaattcgagacaaatctgtggagtaaagtgaaagcaagtttattaagaaagtaaaggaataaagaatggctactccatagagcagcccgagggctgctggttggctatttttatgcttattacatgctaaacaaggggcggattattcatgagttttccaggaaagggatgggcaattcccagaactgacggtttctcccccttttaaaaagaccctaaggggtaactcctgatgttgccatggcatttgtaaactgtcatggcgctgatgggagtgtctcttagcatgctaatgcattataattggtgtataatgagcagtgaggatgaccagagctcactttcataaccgtcttggttttggtgggttttggccagccttttctgtgcatcctgttttgtcaacaaggtctttgtgacagtgtatcttgtgcccacctcctatctcatcctgtgactaagaatgcctaacttcctggcagggcagcccagtaggtctcagccttattttacccagccccattcaagatggagtcactctggttcaaatgcctctgacacataggcataatactctgttgaacagttgctgtgtgcttgatagttctttgttttataattttatctctgattcatacagcagccttgaaaagtagacattattgtccccattttgtaaaggaactgatgctcagagtaacttcccaaaatcacacagtgcatatggcagtgctgaaattcaaacccgcatgtatctgcttcaacacctctcttcctgctatcataccagcattcctcctcatagaaattttgtgaaaaagcacagataacctccttgatttaaactagaaatttttgagagtcctgcattgtttctcttaataatccactacttatcatttatcatgagttgtgagatcctgctaggttcaggagagtgactgggaccagagctacagactcaggagtcataagaccttaagagctcctgggtgctgtgggcattggtgaggtggtcctgggaagaacttgcagagtaagagaagtagtactataggacctaatgaaacatgagctggaggtgggttagaaagagacagagtggtttttatttggtagaaggaaaacctgaataggaacctgttaggggagcccaagagcatagttgaagaaggaaagtgtggttgggagccaggaaccaaaataggataaggtggaaaataagccattggagtggatggccaagcgggaagttatgctcgcctctgtagtttgaaatcaaatttgcagaatctttaccttctctgtgagtatgccatgaggtgcggtgatagaacccctgcactgttttaggttcatatactcagtggacacatgcaattttgtgtttgaatttttagtttcttgttttttaatgctgcctttgctctggtggtccttggggccacacccaggcagtgagcagcctaggtggactaggatgttccccacatcccaccctagagttacatctgttgctttagaggccatcatccctcgagaatgacttaaattcgtgctggccgtggtggctcaggcctgtaatcctagcactttgggaggctgagttgggcggacaggagttaaagaccagtgtggccaacagggtgaaaccccatctctactaaaaatacaaaaattagccgggcatggtggcaggcacctgtaatcccagctgcttgggaggctgaggcaggagaatcgcttgaacccgggaatcagaggttgcggtgagctgagaccacaccattgcactccagcctgggctacaagagggaaacttcgtctccaaaaaaaaaaaaaaaaagaatgacttagattcattctctctgtctgttattttgtatctgcccacattgatgttaatctgtcactttccttcctacgtgcatgggcttgtgaaatctcctgaccatttatgctatttgtttgtctttttgcaaatcaaaagagcctaatgtcaccttaaagcatcatggtaattaaacttaagaaaggatgagtgattacagtttatttaattcctccctctttagagaacttctagagtacacaggcatagacatacaaatttagtttcaagtaagaatgagagtatacctgagtagtttacataaaattatggggaaaactggatatgtgttggagcagacaatgtttgtggggctaggtgtccagagtcaagtctgtctcggatgggccttcagcagaacggctttttcctgacataggtgcagcctcatcctatgcgtgctcatcacaagagcatgtttctcctttgttctgggggatgggaatttccttcctttgattcctttctcttcactcctacagccccagtgtttgcttgttcactccccgcgtcccacatcaatgccagtcaactctggcctgcactagttggcatcgagatctgtgaaaaggagtagaagcaggggagacaaaaattaaagctctccctgcatctacttttttttttttttttttttttttttggagacggagtctcactctgtcacccaggctggagtgcagtggcgctatctcgggtcactgcaagctccgcctcccgggttcatgccattctcctgcctcagcctcccgagtagctgggactacaggcgcccgccaccacgcctggctaattttttgtatttttagtagagacggggtttcaccgtgttagccaagatggtctcgatctcctgaccttgtgatccgcccgcctctgcctcccaaagtgctgagattacaggcgtgagccatcgcgcccggccctgcatctactttttagttattggttcctcatcctctctaccccatttgtgaagcagatgcaggtagaggaagaaggagggggaaatgatacctaacattactaatattcttttctcttcatcatacccctactctccattcaccctcatccccattctcttttctaatccttcagtatctttcttccctattagactgtaagatccagaaggataaaagccatgtcaatgttggtctctaatgtgccccatcaatgtctagtacaagacttgacatatagaagacaccaagatgtgcttgcttggtgaatgagtgaggcatgaaagggggattgggggagtacactgtttttctctatacccctcttgacaactttaccctgttctgatttttcacctgtgtatcccccaatctctgatcttgaaggggcctgcctcctggccagcagcaagaacatggttcccacaatggatgctgaacacattttcccatagagcatttttctacatggtggttagtgtctgttggaactatactgtatacttaagggagctttcgtggctggccatagtacccataatgtacaacattgtttttatgggaaaatgcattgagttcaaatgaatctacttacatgcagacttttggattaaaacttttccgttagttggggactaccattacatgttctcctgtcaggcttttattcattactaatacataaatgaacaataagccatttttttggagaaagaccagaggcagaagtctttctttctgagattataaatcattacattaaaatgaatttcattcatccaacaaacattgctagtttatttcaaatgtatttatagggtgcctggcacatgtagggctttgtacaaaggaatcatacgtgaataaaatagggaccctatcctggtgaggtcatagtcagatttctgtttaaatcgaaattagcctcatagtccacaaggtcacttccagctctgaaattcagtaattctgtgatttttatgctgtattcatttgcgtatttccttgttgtatgtggttctgttatcaaatttatctttagataatagagaaagcatatttacattcattaataacaattaagagcagtaaccccaccattatagcttttaaataattctaaatttgttgttatttataaaaatgaaaaacccaggaacaaaccatttaattctagctttttattataaaaagagtagagccacatacattatgaaattgacataaaaatagaatgacagagacttgactttaaaagtttattccataaggataatatatatgggtgttgggattgcaaatatttttgtgttttttctaaatgtatttctgtagttttcaaagtttctatattaggtattccctcactatcagtaaacactgttattgttattccctcactatcacctcatatacatacatacatacgcaggcacactccttccttgttattgctgaatagtatctcattgtgtggatatatcacactttatccaaaatggactacactaaatattattattttgagacatggtctggctctatcgtccaggctagaaattttcaatttgaaaattttcaatttgaaaaaattgattttcaattcaatttttgaattgaaaatcacatggtcctcaagaccctccataatttcccaggctcatttctcttacctgtctctgtccacgtctcatgtctttcgtggttgggtgccattccttctttaaggactatctcaaatggtacttttttcccaaattttttccccttgattgaataacagtgtttactgtattctcactgtattttgtccaggccacagttttagcttgtgctttttgttacttgtataattgtctctcatttcagattctaaccatgagacagggacatttctgttggtatcagaaatagccttgcaaaggctggaatgtagggtaaattggtagttattatttctaattgggaagctacaaaactttgtctcaggaattaaggaggataactacattttgggagaaaacctatcttcccatccttgatacagtgatctaatgttgtgcatgtagttggaactcaataaatgcttgttgaaatggacccaatatctggtagtgggactggtggcattttcaatgtccctggaaaggaaattcgatatttatttatacaatatacttagaagtcctaagtttaaaagggagagagtgagaacatatgttggtgaaacgaagaaaatgtatataaagtacctctttgcaggaaagccccagagccattgcttttcacttttatattggacatgccatatttggatatggtcagtaaatgtttgctttttttttttttttctttacagaggtataagttccaataccttaatgaaacaatctgtaataaattctcctgtaagtgcaaaggctgagggtatgtcttccatgttttttgatgccctatttggatcaaccttaagtcagagatagaagtgcaaatcagatgagggttttttttttttttttttttttggagacagagtcttgctgtgttgccccagctgaagtgcagtggcacagtcttggctcactgtaacctctgcctcccgggttcaaataattctcatgcctcagccccccaagtagctgggactacaggtgcccaccaccatgcctggctaattttttgtattttagtagagatggagtttcaccgtgttgcccaggctggtctcaaactcctgacctcagtcagtccatccgcctcagcctcccaaagtgctaggattccaggcgtgagccactgctgctcggccagggtccttaagttcaaatcatggagcagtccacagagcactcttctcaggtgcagagtggaaaggactttgatcgtggactagtatttttagtcacatccacaggcctttgaaagggaaaaaatatattattgataggtcctgttttttgaggaaaaaaaaaaaacaagcattcctaactacctggcaaataatttcttctattctaatgataattaatttatgtggtcaaagatcagagaaagggagccataggcaggacagcagcccagtattggtaccacactcttagggatctcttaatttttgttttcttcataacaattgtcagttttcttacactgtgctgtatttggagtggatgatgctggtggtgattgtctaaaacttagatatttaaacagtttgaaaacttgttggagtaggaattataaaagctttatagttttcattatcttctccattcccactcttccaagttactacaaatatgcctaatttttataaatatatgcaatttaaaatgttttaattgtaatatacaagtagttcttggcagtagattccttcggagatttttcttcatattttatagagttcttcagattttttcctctttgcttataatacttataaagttatatttattttcttttgtctaaactcattcaatgtgcatttttctcacctgctcttttgtttgcttgctgcgatacaaggctgtataaagaaatacttggtgctttctgtgacagcaggccatataaagaaatacgaactcttttttttctttttgagatagaggctggagcactatggcgccatcttgacttactgcaacctctgtctcccaggttcaagcgattctcctgccttagcctcccgagtagctgagattacaggtgcccatcaccacacccggccaattttttgagatggagtcttgctctgttgcccaggctggagtgcagtggcatgatctcagctcattgcaacctctaccttctgggttcaagcaattctccagcctcagccccccgagtagctaggattacaggtgtgcaccaccacgctcaggtaattgttttattttttagtagagacggggttttgccgtgttggccaggctggtctcaaactcctggcctcaggtgatccacccaccttggcctcccggagtgctgggattacagttatgagccaccgcacccggccatttttttgtatttttagtagagatgaggtttcaccatgttggccaggttggtctcaaactcctgacctcaagtgatctgcctgcctcagcctcccaaagtgctgggattacaggtgtgaacaaccgcagctggccaagaaataccagctcttaccaagcactttaattcatttagtttttcactctggctacagtgagaaaagacaatgtttttacacttgatatactttttataagaaaaaatcaatgcaggatgaaaatatcctgttgctctagtaattcccacagaaggtcagcctcaataatagaagatgaaaaaagttttgtggtgtttgctgttttataaactcatatttggagaaggaacacaatatatatatgatttcctcataactgctgttggtgccccagatttgatattgttgcatgataacctgacattgcttcctgcttctgaaggaatgattggatttgaagccaacatgcttgctaaaccgggaagctgctattacagaaggcacaggaagtcaagctgcctatgcagttgtgctgagacatgagactcatacgttgtgacccgtgcctattgtatgtctccccatctttataactgcttttgaaaactggcttcaaataagcaaaaggcctagtgttatttccatagcagcactaaaattaatgaataagagttacagagttggctgaatataaaggagatatgtctaacaattacagttctccaaaacctagtgtgctccctctttgtccttgtaagtggtcaaacaaaaatggcataagcactcacttaggtgttgcattggtcagggacctggtgggaggcggatggcacacacaagttggataatttggggaacatttcataaaaagacagtaaaaatgtagggtatagtaagaatatacaagggcaagtaaaagggtatggggcaagggctaatatctgtacgtgaggaagaaagaggaggaaatgttatcaaaccactggctgtgtacaaatggctgccttataggagctgaggtctgcagtcaagggagactgtccactgagaacatacagggacacagccagcagttctgttccctgaccctgggctcttctgtctccagccattgtcccttttgactaaacacaaccagtgtagaacaaggattgttgcagtccttgacagatcagactcttcaggctcaaagagtacaaataggtggggagtagattggagttaagtggaaacagtcctgtgcagatgttatagtgagtgggatatccctgctgtcctcattgatagtacagaactcttttttttttaaattaaagttctagggtacatgtgcacaacgtgcaagtttgttacatatgtatacgtgtgccatgttggtgtgctgcacccattaactcgtcatttacattaggtatatctcctaatgctatctctccccgctcccctgaccccacaacaggccccggggtgtgatgttccctgccctgtgtccacatgttctcattgttcagttcccacctatgagtgagaacatgcagtgtttggttttctgtccttgcgatagtttgctcagaatgatggtttccagcttcatccatgtcactacaaaggacatgaactcatccttttttatggctgcatagtattccatggtgtatatgtgccacattttcttaatctagtctatcattgatggacatttgggttggttccaagtctttactattgtgaatagtgacgcaataaacatatgtccgcatgtgtctttatagcagcatgatttatattcctttgggtatatacccagtaatgggatggctgggtcaaatggtatttctagttctagatccctgaggaatcgccacactgacttccacaatggttgaactagtttacagtcccaccaacagtggaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtctccttttgagaagtgtctgttcatatccttcacccactttttgatggggttgtttgattttttcttgtaaatttgtttaagttctttgtagattctggatatttgccctttgtccgatgggtagattgtaaaaattttctcccattctgtaggttgcctgttcactctgatggtagtttcttttgctgtgcagaagctctttagtttaattagatcccatttgtcaattttggcttttgttgccattgcttttggtgttttagtcttgaagtccttgcccatgcctatgttctgaatggtattgcgtaggttttcttctagggtttttatggttttaggtctaacatttaagtctttaatccatcttgaattaatttttgtataaggtgtgaggaagggatccagtttcagctttctacatgtggctagccagttttcctaacaccatttattaaatagggtatcctttcccgatttcttgtttttgtcaggtttgtcaaagatcacatggttgtagatttgtggtattatttctgagggctctgtacagaactcgtttttatgaagaatcattgactttcaaaaatacttgaggttacccagttcaagcatccaaaaatacagacttcctgttcattcagcatctagtttaatgtattcaattatggagagcaaaattttacattatgaaacatcttggctgggcacggtggctagtgcctgtaatcctggcacttttggagccccaggtgggtggatcacttgaggtcaggagttcaagaccagcctggccaacatggtgaaaccccatctcagtttaaaaaaaaaaaatgtatcttgttccattgttgaacaactgtagaaggttattcttgcattgaaatgttccttcctgtaccttctgttgcttgctagttcttccgtttgctattctcttgccttctgtcttttggtccctttatgacatttttggtgtttgtttaacaggcattcacttattcaacatctatttattgaatgcttgctgtaggccaggacttgttcttggtgctgggtattcagctgtgaacaagacaaagcttctgccttacatgaaacttacattgtagtaggtagagacagacattaagcaaatacataatatggtctctgtaggtgataactactgagattaacagcagttaaccatggtcacaagagaaaactgtggcttaaattgggtctgaagtcattctgagtcaactgtgtaatgcagtggccaaaaagcctaaattcatcttagactatttgaatcaaatggccatgttagagaggtcatgtttgctttcttattgtcaagctgagcctggtgtatagcatttactttttgaagagatattggcaagtggaaacttgttcaggggtatccccatgatagccttgtaaacagctgaagaaagccatcatatttgcatggagtgttccctaggccaaacctttctggttttgccaacagtttctcaaatggtatgatgtctatactctttaactgtcctggtcttcctccagataattaatttcctcttaaaatgatgctcccagaattcaactcatctttccagatgtggtttcaacttaggtaatgcttattagactatttcttcccttgatctggttatttaattttagtaacgcatctgaggattgaatttcctttaaaaacacacacacacacacacacacacacacacacacatctgtgttacttgactctcagtgttgagctaggctgtaaagccaggtctccagcacttctgttcgtacaatttatgtacataaatatgttacccagcatctctattaaaatgtcatctcatcgctgtctgtgcagtattctacattaagatcctttggaatattgtctttcatctaacttggtgttgtctacataattaacaagcatattctcaaacttcatctaggtgtttaatataattgtttaattaaaaaagaataatagcaccagacctttccttcagattatagcagctcaataattaatcctgttttagtatgacatttcaaataactgtgaacagccttaatatgtcatccattttacatttctgcattttatccaaacattttgaaaaatgaagatacagtcttcatttcatgatggcatttctatctggtactaggcttaacaaaaaacatactagaagccaggcttggtggctcacgcctataaccctagcactttgggaggccaaggtaggcagatcacttgagctcaggagtttgagaccagcctgggcaacatggcaaaaatgcaaatccacaaaaaatccaaaaattagccggccatggtggcatgcgcctgtagtcccagctgcttgggagactgaggcacaagaattgcttgtgccaggaaggcagaggttgcagtgagccgagattgcaccattgcactccagcctgggtgatgggagtgaaaccctctctctctctctctctctctctctctctctctgtaaataaataaatatatatatatatatatttttacctttctaacattgcagggagtgacctttctttttcattcagtctcagttatgtgtccaaagcattggtatatgttttggtttagtttttaatttgcaagctccatgtaagactacagtgggttttttgtcagatgcctccttatttatgagttggagtgaagacagggagagtattgacctcattcttcctggagatcttttttgttttccaaggagtttggtgtcgtattttataggattttctagattatatgtataacatcttgactccactcaaatgcccaagaacccatacattttggtggcagcatgactttcaagaggagttgcttctcttgcttagtacaaagtgtccatggatcagaatgtgattaaacaagtcaagtcaggtgacttgtcactgagggtttgtattggttgcaagtaccagaaatgtgcctgtgccgattggggaatcaggatattagtcaaaggaaaggaaaacctgttcaacaatttttcttgcttttcatgtgctgcagagaaaaggctaaatcccatctggtgcacactattgtgggaatcttatactttagattcataaacacagtatgttcagattttctagatttgacatttgcttgaatgtgttcggtgtgtattttatactgagtgtcaaatttcttgccttttgacgatagctgacttttagttgactaaaaaagtagtagtcatagttaggtttactatctgtggctatcacagggttcacatgggcatcattgtccaaccaaagttgcttctgaagtgctgccatacagtcttggctctcatgaacacttgtcctagtttttaccgttgtcctggaagaattactttcacgagtgtctgggtttggaggaaaaattgtatggctcctatggatacgtctcaaagtattctaggaagcaagttgttcccattgtgcagttattgctttgacatctggccttccttacttacctctgctacagaaagaatccagaatgacttgtaaggctggtaaacccagtgattcttggaatactttttcaagaatgctcctccaggaatgctcttggagtctcactctgtagcccaagcttgagtgcagtcgtgtgatcctggctcactgcaacctccgccccctgggctcaagggattctcatgcttcagcctcctgaatagctggaattataggtgcccgccacaacgcctggctaagtttttgtattttactagagacggggtttcaccatgttgcccaaggtggtcttgaactcctgagctcaggcgatgtgcccgccttggcctcccaaagtgctgggattacaggcatcagccactgcacccggcctgaaaacacattttcttaatgggactaaacttttctagctgaattgatctattttaaaacttgccaatgaaagctccttagtagtatctgctaattaaatgcagtttttatacctaacggaccttttaaagaatgtgtgcactttgcaaaccccattgcttcttgccgtatctgagcacttgccacctggtggtaaggagaccattccatctccttcactagatggtagcacctggaagtcagggatcattgctgacttatcttgcctcccaacattgatcatgcagtaggtgtggatgagaaagagggagataagggaagaaagggggctgtgaataaacgctgttgctttctgcttcctttttaggagttaaaagtctcttcagctacctgtttaggagtatgaaagcaaatctaggaaatggcctctgcagttttccgaatatgacaaatcatttagtttcctaagcttgttactctacagtgggacttctcaacctctgcactgttgatattgtggcctggatgattgtttgttgtgtggcctgccctgtgcattatagggtgtttagttagcagcagcatccttggtctctgcccactagatgccagtagtgcaccccatccccagctgtgacaacaaaaatgtctgcaggcattgccaagtgtgccctggaggcaaaatagccgccccctaattgagattgagaaccgctgctgcataggagctcctgtctgggacaaatgcccaccagagaaaccagcaagtaatagaaatgtggctttggaagggaacttagaaatcatctggaatgttgtatcctggagaactcctcgccccacaccagcgccagcacccctccccaaccccctacaccacctccacctttatacttatgctttatacctgcagaactataacctaagggaaggaatgaatataaaaaagaaaaaaatacaactatatgaggtaatactgtttagggcttgtagggttatttgttttaagtttgcttacagatcatgaacatgtgtctactttcaggttactcaaaataagaaagcataagcttatagaaataggtcagggagaaaaacacagaaaaactaatgtgcagcactactaaaaaagaattcaaggtgtatgttgaacatttttcagattaaaaagaactcactggaatgtggctggattgctagtatcgccctgtggagctatctgggcttcatatgaggctattctaagtacatgcatcaaaaaagagatatagaagagtatttaaagtaatgataattggcctttttcaaaaaatgacttgctttctaaacctgaaaaatagccatcatgatactagagaaatagctgagatattaatatttcctctgtagattgttttgttttataagggcattttgtgtcttactaagaaatctcacataaaagtaagaacaccaaattaaatattagctcttgtggttattttaagactcatctcaataaccaagagaatttggttctcacactttgtaccttttgattgtaaacagctttaaacaggtttatgttgtacttcatcaaaaattatagaggatctgcagactgagacgcattgggactgaaattaggcaattcagagtttctcatgcatgtaagctgcttttattttgatccctatcattcttagtctgtcttttcaaatattctactggaaggactgttgtgagttgagggcaaaggagaaaatggcagggtctcgagccaccaggcctcataatacctgctctttgaggtagagtaaaagctaactgatgaatgttttccagaataatatttagatttagtctggtggtttttttttttttcttgttttgtttgctttggtttaagctcaatacagtcacatctgaatttacacaacaaaaatgtttccgaaaagttgtggatgaatccatttttaataagccaagtactataaaaagcatcagaagaacttgttaactgaacttatcctaatgttctgatcacctgtttcttttaatagacatagtggttgcaacaatgctttgattagttcctttttggaagctggcttttgttggggggagggtttttgtttcttgtatcttaaacttgacaccttgattctcattgaaaaaactttcaaccatgtatggttggtgatttgttgaaatttataactgaaaatctgccactctgcttttagtatttgaaatgccttggcagggagacgtttttctcagaacagatcttttggaggacctcaggaagttaattattctggcaagaagttctttttgaacttttttggatcattatgatattatgctaatttatctaaaaaatggattctaagttgaataactgtatagtcctggcagataagagcatgtcagatgtcttggcacagtttggggacagaggggactttcccacttctttatgtaatccaccatcataatgtgggagttttatgaaatttcttctgttatacagaaatacttagctttttaggccgtatgtgctgctcagtgaaaacaagctctgtgtatgtctgtatatgtttaaatgaaatgaaaaagagaagtgaaatccaagaaatttctggtttgcagtggtgattatttttagccacgttcatgtgttttaaacaatcccttttaggtctgttgaatgtagcttggaacagaacgtcccatagaaatgatagtatagtacacgtggtggcaaagtttccatattagccctcaaagattatttaactcatcatatactcacacgctttgccgtacaaggggcaatgatgtatagcgtataaaaacactgtttaataatactcaacctacagcaactttcaatactaagaatgaaataaaattgaaaaattgtaaaaatgcataaggataaattttgtttctctgaaaaggttgcttttgaggaaaagtagttttaaagagacttggtggtgtggtagaagaactcccagcagacctgaagatgtagcagatgtatagcagtttgggcatcttggacaagtaaatcatactcgcaagcctcagtttcttttaatgtcatggggatagttgtgtggatcagagcagaatttgtgtgaaggtgatttgcaaactgtaaagtcctatgcaaatatacaatatatgttctggttcttttcttaattatgaaaatcttgtatcctggcctttttcttgacactcatatattagtaacaaaaatctttatgcttagcaacaattagtaaggtcctatttcgctcacaaatacaataaatgcatgttattttgacctacatggatgatagaaacatttgcttttttgtgacagcctattggaacttccaaagtgttctctctctctctctctctctctctctctctctctctctctcgtttttctagtctctaaacctctcttgttttttctttgtctgagtatctttctgaaccaccgtctcaagtttcaggttatacgacagagctcatactccaagccctggcctctctctgaccttgtgcctctggcctgggacaagcttcacactgccagactctgcagctgaccctttgtatctcccagtagtctgagcagcattcatttgctcaaggtctcaccagagaccaaacaggggcagcctctctggagagaccatggcctcccaacagtatttttgatgtcagtggcctagccttaggccccgaagccaggaactatatgtgataggggccaaatcccccaaacccgaggagcttttctggtagaaaatgtgttatgaaaaaaagggggactcagtggccattgcagaccaaagcctcattcattgaggtggggtaggggttgctggggactacaattcagagttatatatgtaacagagttatgcatataattcagcaaacaaagaggcaagttgaaaagggtttattaaagtattaatgtttgtgtcaaatgtataaaattcaggaaacaggcagagcaataacatttaatgttggaagaggacttagagatacaaaaaatagagtttattcattctggagcagagaaatcttaagccggataggttaactgatttgcaagtgtctcctgccttccaatcctgcatccttaaggatatccttaagatgatacatctgggttttgcgatgctctgttctccaggtacggttagcagtgattttgcataactatgtgctgagaccctaggatctaacaaactataaaggttagaaatgaaatatgaggtagcctactatatcagccacctctgattcccttctcccaccacagggagaattagattgaccggctgatcgattgcttgattgagacaggatcttgctctgtcacccaagctagcctgcagtgatctccactcactgcagcctcgacctcctgggctcaagtgatcttcccacctcagtctcctgagtagctggcactacatgtgcacaccacagtgcccggctaattttttgtatgttttgtagagacaggattttgccatgttgcccaggctggccttgaactcctgggctcaagctatcctgccttggcctctcaaagtgctgggatgacagatgtgagccactgtgcctggccagtaatatgtattaagtaaggtaatttgtaggagcttagagagaaccagcaatatgacacagtttctgctcttttggggcttacaatacagtattatatcatcagagggggtccattctgaaccataccttgaattaggcattagcatactagattctaattttgtttcttccattgaatttctaacgtggaccctggttaagtctaagagatcatttaaatcgtgggcctcagtttttttattcataaaatgagaatattgacatgggcctcagtttttttattcataaaatgagaatattgaatcttgaaaccctgttatttttacattctgtgtacaaaagtctcatggtactatctttaattttacttatcagattttgaatctctagtgctctttttatttcaagatattcttagccaagctataaaatcaaactaatttatatgctgttatgaggcaacttagcaattcatataaccacaggctagagaaagtttggacatatataatggttcatttcttcaattttaaggcagaactacatcccaagcttatgtaaaataatttgaattattatatattcccatagttctgcctcaaataaaatataactgtttttgaaaattcaaagacttagaaagtaaattagaggattgtttattataaaagaactttggaccctacaaaggaatttaaccacagttttcttttctttgttaatagagtctcactgtgttgcccagattggtcttgaactcctggcctcaagtgatcctctttccttgccctcccaaagtgctgggattacaggcttgagccaccactcccagccaacagaattcttttcaacagtgagttcctctagtgcactgaaaatgtaatatgatttgcagatgtttagtttatgtacaccagaaagaaatagttacgtatatttacagttcatggttctctgcagcagcgctgagtgtatgccagatatgctttccgttaactaattgtagggattttctgtgggttgagagtttttttgctgttgtgttggaattttactgacctatctttcctccctctccatgttcttcccagtagttcaaatagcattcatatgtaaaatgactggttaaaatatgggagatcatctctggctgttggagaagtcacccatttaggggatcaacctgtgactgaggaggcaggacactttctgtagtgggaggaacatgggccacatacaaacagatttagttcaaatgccagtgctacctctcccttgcattaagcaagttactgaaaccttcagaatctagttttcatctgtaatataggaataatgatgataatgcttatatcaccagggaatttgtctttctgaaagggctagcacacagtaggtattcaatgcaagttagcttttgcccttgccttcaaatccagggaacacatggcagcaacaagactgtagccctgggagttgctatgtctgcagcctctttaaggtgttaggcagacaggatgtaagcactagaaagattcagtatggtatcaccggctgtagtggttcagcccttggcctctgtagcccaagagccagtgttcgggtctactaactctgtgctcttgaaatgtctcctacttttaagtcagtttccttatctgtaaactgagactaatggcatttacctaattgggtcgttggagatcaagtaccttaattgatataaagtgcttagaacagtccctgggaggtggtattttgctccagtctgttatagggaggatcattttgttgttagagttcagtgaagaccgttttttaaaatcgtgtggaatgactataggcattataaagacaactgaagaagctcttgtttctgaacagtacttggccagtttctttaacaggagatggctttgcttttagaagcctgccccagagtcttccatctcttccactctccctgcacgtccgctctgtatggcttttgttattaatgtggagcagttgaagtcactgacttgggtgcaggccaggccagcattactgaggtcatatattactttcctagactctagtcatgaacaggatgttggaagtcagaggtacagagaagctgcctttttaggccgctcacatgaaaggtgtgtttgctttcctcaatcatttttatactaatagattggaatcttattcagtatcttggtagcatttttttcttttactctacaacctttatgccgccaggctgtcatttggcttattctttggttagacagactaatgctgttttgttatgcactttcttcattgttatttcattgttgaaacatctcttcctcggttaactaaatatttatttaaggcaggtagaatttctcagtgaagctgtatatttgtttaggtattatagatatattctaaaacatttagggattattcagtctatatatttttttctcttggaaatgaaataatactgtggagaaagtattcattgaaataacaagtgaaagtgtgtttccctcaggaatagtgtaaaaagaacttgcttttattttctgctttgcttttgtatttgggacttggggaaactatgcttttgttattttggaaaagcaatggaattttatcagacattttcctgaaactccctactttctctttttcctgaaatactaccttcaaagtcctgttttgctctgttaggaggttccatcattcaaaaagtgaaagagcttggttagttgaggttattttgttgatctgttggctttaaagaaagaagagactgtcagagaaagtctgagaaacaacacttggaggatcatatgaccaatagtgtgaaactgaggacgctgatttgttagcttgagcagttaagactttttttttttcaatgtctgcaagtaaatacgtggcctcagaccctgttatgctttatgatgggtgagagtgcagagaaagtaacgttctccaggtttaaactttattctgactctgttccctaatcgtgaggatttttatgttttttgtaactgttgttgtgaagtagaaactgatttctagttgactttggctattactaaattgtgacatgcatgcacttctttttaatttaacagttgttttctgctgttttctcagtttgaaagtagtaattatgaataagaattcctagaaatattcttcttccataatgatatgtcacagatgtttgagtgctacacacacactcctctccatttttaagtcaatttagtggagataaaatgtagataatagctgtgtgttgtaatgactctggcccactccccagaggctctgtatttccataagttatgggacccctctgatctttctgaaatggccaccatcagatcattgagacttgacatgcagtttaaaatgtgtgtttctgagatttctatatatgatttggacacagaataacttgtgctgtttccaaaaccacattctttgtcctcttatagaacccaatgaaaggaggaagctgtgccttaaatgtcatgttctttatgcttagttcctttaaaaatgtatacttttatcatttgttatagtagaagattttgaaaattctgagaagtgtaagaaaagaaaaattacttgtaactctactactcagagaaaaactgctgttaaaatattgaggtatttacttccagactgatttttctatacatatttatatagctatatatagttattcttttgtaagagtgactataaactgttttgaaactggcttttttaacataacaatatatgtgagcacattttccacatccccaaatatttttgaaaaatatttcttttaaatatctgcatagttttgtacccattataatttggctctggaagaagttcaagatatgccaaatagtcttggcacaatggctcacacctgtaattctgacacttttgggggccgaggtaggaggatcacttgaggccaggagttcgagaccagcttggtcaacctagcaagagctatttccacaaaaaagtgaaaaaactacccgggcgtggtaacactcccatagtcctagctacttaggaggctgaggtcaaaggattgcttgagcccaggagtttgaggctgcagtgagctatggtcgcaccactgcactccagcctgggtgacagagcaagaccttgtctctaaaaagaaaaaaaaaagatatgtgaaattaaaaagtccactttggtgataaggtcttccttctaaattatagaaataattggcttaaaagggaaattgagaacatgctaactttgtgctttattcaagatagacttgtttattctttgctgcatttctataacaaaacatttcagctgtataatccttggtatagcaatgactagttataataattaatttttaattagctgttcatgaagttttcaaaacatcaacttttatcgcattaaaaaagtgaaataattttgaaacatttctttcctttaaatttgaagtaaggttaaagttttttgcaaccaaatttggggttcatctaccatggtaagttggtgctattggctgtgctataatttcagggtgaacttgactttccttgagtttccaggctgtacaggacaggaaaggctgtggccgtcagggaaatggagccagatggtcctcatgatcgatgccaagctcccaacagagacaaatgctacacccgacagactaggggcaacagcacatgttagggtgattgctcaccctttcctggagaggggagagctcttcccttctgctggtgtattttgcagctagtttttgcaggctctgttcagtctggtgtagcaagtgtccaggcagttaacttctaatgggcagtgaaggaggaggtgatggcagtagctggggccgagttggcagctagtagggctgtctgatgaaatccacattttggcatccttgaagtctttcaaaggaatctgactaagtcacttaaccttgtgtcattttggtttacttggcttttaaagggtagtggtaattaaaccaatgggagccattagttagtagatcttagtggcagttttcagtttaaaaatggaaacctacagtcacagagccattgactcgtaataacacagtggcttgtccttgacccaagggagttgatttggggaaatgaacatatctgagagtcctgtgtcctgagtttatatatcagcatagctacttaggagcagtatcactttgggcatatttcttaacctctctgaatctcctctgtaaaaataatcataattcttcaaaacataagtgagagcttatattttatataagtatgtggcacagttattagttcctcactagatattaattagttcctatgaaaatgatagattagtgccaagtcatctgacctccctgtgtaggcttattattgatcactgggggtctgtagccctggaacagtgttttcttttctgaattaattacagcctcatgtactgagctaaactcgaatatgcaaatctttatgaaaagatgcccaaaatacagtgacttaaacaagttaagaggttgttggtgctttcctcctctcagaagagctcaagggatccatactgattcaggactagcatggtacttcaatagaaaaattccttcctctcgtttctctgccatcttgagagagttgccctcatcttcacagtcaaagatggctcaccatgatctcatttcagcccaagggaaaggagatgatctacaagttgtacagatcattttcatttacatcctattggccagaacatgaccacagcaagcttcaagggaggctgggaaataaaatgttagccagcagacaccctgctagagcttctgttactatagaacaagatcagcaaacagtggtctgagtgccaagtcagccagccagaaattatttacaaattaagtatagtttgtaaataaaagtgtattggccggttatggtagctcatgcctgtaaccccagctcttggggaggtcaaggcaggaggatagcttgagcccaggagttcaagacaagccggagcaacatggtgaaaccctgtttatacaaaaatttaaaaaaaactaaccaggcgtggctgtgcgcacctgtcgtcccagctatttgggagactgagatgggaggatcagtttagcccaggaggtcaagactgcagtgagccatgatcacgccactgcactccagcctgggcaacagagtgataaataaataaaaattaaagtgtattggaacacagatgtgcccatttgtttataaattacctgctttcacatggcagtggaagagttgagtatccaaaatgcatgggaccagaagtatttccgatttcagatttttttgggattttggaatatttgtgaatacgtaatgagataccttggagaagagagtaaagtctaatatgaaatttatgtttcatgtacaccatatgcatagcctgaaggcaattttatataaataatattttttatttttaagacagagtcctattctgtcacccaggctggagtggcagtggtgtgatcatggttcactgtagctttgacctcttgggcacaagtgattctcccacttcagcctccccagtagctgggactaaaggcatgcactaccatgcccaactaattttttgattttttatagggatgaagtcttgctacattgcccaggctagtttcaaacttctgggctcaagcaatccatctacctcaccttcccaaaatgctaggtttacaggcatgagccactgcgcctggcccaattttatacaatattttaaataattttgtatatgaaacaaattttgattgtgttttgactgcaacctgtcaaatgaggtcaggtatgtgaattctcatttgtagtgttgtgtcagtgcccagaaagtgtcagattttagaagattttggattttcagattagtaatacacaacatgtagttgctgcagagatcatatggcctgcaaaacctaaagtatttattatcttgccctttacagaagatttttttgttgatgtctactgtagacaatggggaaatgaacatgggaggagcaactggtagtctctgccacagtaaagagaatgataagaagggtgaatcactgcctttgaaatgtagagttagaactttgtacttaggcatactagtggcccatggggcagtgagttggtatgcaggtgattggttttttgttgttgttgtttgtttgtttgtttgagacagagtttcgctctttttgcccagactggaatgcaatgatgctatcttggctcatcacaacctctgcctcctgggttcaagcaattctcctgcctcagcctcccaagtagctgggattacaggcatgcgccaccacgcccggctaattttgtatttttaatagagacaggatttctccatgttggtcaggctggtctcaaactcccaacctcaggtgatccacctgccttggactcccaaagcactgggataacaggcgtgagccaccatgcctggcaagtgattgttgaagaagcaatgttcagggacagatttgaggagccaggcatgaagtagcctggtggaggtaaagggatgaaggcacagaaggctgcttactgacgtgagcttccatctttaaagtggagcatcctaactcctggacttttccctcttcctgcagctcactgctctgtcttgcattcgattcttgcttatcagcagtgccacccctgtaggtcagactctttcctcccattgacttcttacgggtctccctgcctggacattcaccctcctccacagtcacctcctctaagtgtggctcttatattagtcccatctcaagaacttccaaggagtccctgttacctactcagtaaagccaagcctctaaggtcctcccgctccttgatcctgatcttgatcctatcctgtcttccttcacagtcttacacacaccctagattccagcccaacagaaacaccttgtgcctgcgctgtactttgccaccaccacgtatttgctgttgtctccttgcttctgtccaaagggtttggggatttgggactatggcttagcacatggtagaacattcatggctgggcagagggggtttctgactttgttttggcatctctctacatctgtatttccctctccagcccctacccccttcccttacaacctaaggataagcgctccctttttgaatgctcccttttttaattataccaagtactatatataactcccaaggcacttactgctttctgtgtgggattatagttattccatgtatgtttctaatcttcttgcagagaaagaatctgaggccaagtccagatctgactgatcagtttcatctagtaggtgcctagtggctattttgttgatcagtgttgcaatgatggtgtctacaaacagtgctacctacaatttagtgtgtttcactaaaaatgtaacttaacacctggaggaatttaagtgcaaatgcaaatagaggtttttttgtgtgtgcgagacagagtctcgctctgtcgcccaggctggagagcagtagagcgatctcggctcactgcaacctccacctcccaggttcaaggaattctcctgcctcagcttcccgagtagctggcattacagacgtgcgtcaacacgcccagctaatttttgtatttttggtagagatggggcttcaccatgttggccaggctggtctcgaactcccgacctcaggtgatccgcccacctccacctcccaaagttctgggattataggcatgagtcactgcgcccggcctagagttctaataattgtgttgaaaataaatgccacttaagatcttaaaaacaccaatttttaggtagtttttagcagaaaagaaaaaaaaatctatttaactgttttcttcagacctgaagcagtatttaaatacattcatatttagaagttttaaacagttccttgaaaagccaaggctgagccagaaatcaggcagagcttttgcaaggcataaggaggagcatgtgggcagaaacccctgtgagtgcaagaggtgggccacctgcaggaaaactgcccagtccactctgcagagaaggattggagcattttctacaccagcctgccagggacacacctgactgcacaaagatccatctaaaatcactcacattatactcacagaaggtggtattttcacagcttcatctttccgcagttggtaatcaaatgtaagaagagcttttatttttataggaatgatttagcttatggagtaccaatctcatccttttccttcctctgtctttttaaccaagcatagaatgaggagaccaatgtatataatcaaatacttgcgtatgctggaaaagaatttatgtcattcactcatctccttttaattaaaacctagtgagattggtggcaatgttgggaagcagatggatgagcatgaatttcaaatgtgtatttagaaaaattgaaaggattggtaggaaagatattaagtaggcagtgtggtcgggagttgaacctgtgagttcaacagcaggcgcttgtagcataaaatatagtagtgcttccagacccctctgacctagggatgtctaagagataaggagggaaagtgcaggggtctcttttcttgtggtttatgcattttgaagttattaaagcataagacaatttgttctggaatttttactcaagataaaaactatgaccattgtgtgaacattactgcttcacctccctctcctaactctacttttgtttactattccatatccagtgtctagcagtgtactcatcaaacagtaagtgctcagtacatatttgttgaatgactaaataagtggattctggcacttaattataagagctttttggaagatgaaaagattcttaagcaaaatgattttttaaagatgtaaagacaaaagaagcttatcttccagtccccttcctcacttgactctgccagcccccttcaatacatgcctcactggcacctctcctggatttagctttaaaagtttgggaggagtgaaggtgtgtgtcctcatattactaaaagaagaaccctagtgttgtgtaacagtgtttcacaggctctttcataataaacataatattagacacagccaaagtaagttcattttgaattaataatccagtatttcatagtgctggttcgaggtacagatctaggccttgtgtgcaacagaatagaattttagaagtagagtaaaaagtttcatccactaagctgtttctcattggcctgcagtctgatttctttcaaagttttggagtttaacacaaatttaggtgttcagctaataataagattaagggtgtttgtgggcaaaccaaatataatttatatcccttaattttgagctcataatgtttctgctctgggtttataagagataccaccgaagaaaaatctcaattagagtgagataatttgtaaagtaataagtagggttttttttgttttttttttttaggaagcacactagtgtagtggttaggtttttgactttgcatcatagagacctgcagttgattattttaccaacctcactactcttttgtctcaaccctccaaatctttgttttttcacctggaaactgggaatagtaacagtactttcctcagagactcattaataagataattcatgtaaaacacccagaacagtgctacataatagtgttcataccagttatgattaagcctatgctgctgggccaaagagcccccaaaatacagtgaattaaagggcatacaactttttttatattgctcatataaaagggtaagcattccaggcttgcaaagaatcatgttctttgcagaaattcaggcacccagatttcttccatcttgttgctccatgcttcctacatctcagggttcatctacatagtcaaagataggtcgcaggtatgtctgtgtcccagcttgaggggacaggaagaagtgtggaggcagcatgcgcaatgtcttcatgctcagtcctagagaaggcacacatcattgccatgtactttgcactggggagaattaagtcacatggccgcccacatctggctgccagagaggctgagtggtataatttctacctggatgaccatgtgctcagttacaattcattcattgtggaagaacagaagaacagatttgggtgagcaggtaatggtctgccccacagtgcttaataaatgcaaccattatgtatttatttaaaaataacatttcaagtaacagtctaaatgtctttgttctggggaagaggaatcaaagagcttctgtaacacagaatttgtgctacatagcacatatctcccataagtgttatttttattttttggaagggagtcttttaagtattgaacttcaaatcaaggtaaaccttgagggagaaaagaaagagtggataaaaagcagtagaagggatgggaatgtattaaaaggaatgaatgctaattagctatatgctcttccttcctctcagccagccatctgggcaacaagaaaggcttactacagttagataaatttaaccccttctctgacctggcaaggacaaagtacactggcttctgaagaaactttttcttgggagcaaggtagttatttcaaagcacagaaaaaggcggcggggggcacagagaagcacagagaagcgggggcagttgcacaggtaaaacattcatcttggcttttctttttaaaagataaactttgtcccacgtaaagaggaaaactgcatagatattcattgagattatctgatttgtcactgttgccaaagaaaaaacaaaggtaaaatacacgagtttctgcattcagaagaaagtatttcaggtaaaaattaactattaagcaacttttctcagcagaagaaatgcccaaattcttaaggacagccaagttgtgagttagagagctagtgttataacagatatttttaaatacatatatgaattacctccttacgttactttattcttgtgtttttagcaactgttgaaaacaattataagaaatgaaataatgtcctgagctgccacatggtatgttttaaaatctgcgattttattcttgacaagtaacatacactacatgcttttgtgtgcaagtaatgctcagatgtttgataacggagtgatcttaaagaggaggcatctgtttttgtttttataagtagttcattgcctaactaccaaaaatagctgcagttattttaaacagatggtcccaagttaatagggaagaaagtagaagtgagtctatttccccagtttttatttttaccccacaaaaatggtaaaaataattaacagtatataatttgaacaaattctatcagaatgctttcttctaagttattctttctgagagaggggatttgtcaattgaagtatatgatgtggtggagttgaaagccaatataaattgcttaaatttctactttctgatagcgttcatcaaaatgattgctgcattgttgaaatagagcttttgatttttaaaagacaattaaattgtggtaagatacatgaaacctaccaaaacttacttcaaaagttttgaagtcttaagagggtggtaagtggtggtggtgacatgttaagagtaggaccttgccagatgaccagaaagaatatgggttgatgacattaatatttttatgatttctgaattcctcaggagtcctaagttaatagttaataacctactctttagtttctgacattgaagataatgaatattttgataatgcaacaacgaatttgtatttataagggactttgaagaagaatgcatttgtgtggtatacagatgctgttactatacatcagtttcagtagattacaatagtacttgggcccaactactatcgtatatagctatccatctgtaaagaagatggatatctgaggttttttacttctgaaatactaggctgttaaagcttactgagatttttactttctattagtgatagcagtacctttttcatgtctatgggctatatttccatgtatatgtccacaaagtacctgcagttctttgattttgatttttgcattttctttactgtttcatgtggactatgggctgtaagctgcttacattgaatctttcagttttgcttctgtctgaatttgtctagatgaaaaatactagactggctcatatgaaatgataaaattgtagaccagggtagcaaactatggcctgtgggcctgatactgtttaagaaggtttttcacatttacaaaggtttttttttttaaaaaaaaaaaaagaaaaaaaaagaatatgagacagaaaccatgtgtgtagcctacaaaacctaaaatatttatgatctggccctttacaaaaaggtttgctgtcctctgtcatagacaaatagtacagtgttaagtggttaagggcacaggctctgggtgaggccagactactaggttcagatcctggctttactatttccagtatgacctagtcaagttacttaatgtctttgtgactcgttttctcatctataaatgggaataaattacagcctacctcatagggctgtgatgaggattaaattaatgtataaagtgcatagaacaatgtctggtacttaatgagtattcaataaatgttaataattgttattgcattggaaaaaatcttgaaagatcatgtaaactaattttggctttccagtggtgagtgtccgcattattaaagaccatttttctgatttctgcatcaagagtggagggtcattttctttttaatggtgcctgctttacccaaaaaagaaaagagaggcccatagtcaaatgtaaaaaaatgcttgaaaacataaaaaactgtaaccacagctgctttttaagaaaaggacaatcaaagctctttgaattaaatgacacttaaaaaacagcacaaagatccttttacatacttaggacaagcataagaagaaataaagtggaaataaaagatgtggaagataatgttagaaggaaggggaaacaggaatgagaaaggtagtcagcagctgggcgctgtggctcacacctgtaatcccagcactttgggaggccaaggcagacagatcaggaggtcaggagatcgagaccatcctggctaacacggtgaaaccctgtctctattaaaaatacaaaaaaattagctgggcatggtggcacgtgcctgtagtcccagctactcaggaggctgagtcaggagaaacacttgaacccgggaggtggatgttgcagtgagccgagatcgtgctactgcactccatccagcctgggggacagagtgagactctgtctcaaaacaaaacaaaaaaaaggtagtcagcagaagaggagaaagattcggatcaaaagggaagctggaggtttttcaaggaagtccagtgttgacatccctccttcccttgggaacccacctcagttaatctgtgtgtccaatttaaatgcttccatttgaagaaaagcctgacttgtttattttctattgcagaaataaatttttatcatcaagtaatattaactgaatatacattatatgtaacttgtgttccctcagaaaactgatcacatgtatacaaaagcatcatattttgtatctttatttttaggtcaagcaattctgtaccccttagccacttagtttcatcatcatcatcaaacattttttgggttcctaaatatgtttcttcatgtttaatacttctttattctgcttgttctttcaagtagggaaaggacaaacttaattatttacaaaatgtagacgatggttaaaaaacaggaaaaaaatttaatgaagtgtaattcattctctctttttccttcttttgtactcaggttgtttattctgttgatggatattggactggagtgatgagtgttctaggatgggtatttgatgatgccaggggactcaagtaatggctttgcatgaagattacacagtaaagctgcacattgattacctcatcttattagctgatggagatgtttgagaggacaagattgcagggctttcaagcctgtacagctaccaggatttgatcctaagagcttgatcattgtcattgcccatagggactgtgttaagaatagtggtggtttactacttaaacgcatgagagtgttataacagttccctatgtcttttgaattgtttagataaggttaggactttcagatcaacttgagttttaatttttagcatttatagaattctaaaattaatcctgtttgtttttgtcttcctccactaaaatttaagtttgctgaggtagacagttttgtttctggaaccactatccctccagcggctagaacagtggaacatgttcaataaatattcaataaatatttttgaataagtgaatgaatgaacaggttaaatgtaatctttattttttaatgaactatcctttccagagacatacaaattgccagttgatggcattttttatttctttttgtaaaaagagtattttaaaatttgaatgagttctatctaacagataacacagttgagtacattaaaagggaccttgaacacaaaatccatgttttcgtggattagtatttttgcagcttaaatggtgaacgataggattgttagatgcaaataactctggaaattaaagacctttagttgtaactctccctaaaatgtttgtgagagcttgtaaaatgttgttcactttattctattataaaagggcattataataaatatgaagttttgaaaccatgttcttttaaatgaggtgaattatagaactctgttattagccattatgctgtgccccttcttttaaagcatatccctccacataccctttctaaggacttgggggtaacaaaatgaggagtaagtgaagaaagaagaaggcacagcttgtcgagattgatggaccgccccccgcccccgggagagcagcgtaggaaattgcaggatgaaatttgtgtgccagtcttgtcagcacccattcctgttgaaggagagggcatatggatgaggtggggaggattccagcagaggggacccaggaaaggggagggggtggggacaacaggaagtgtaatgggaggcttggggaaagttgaagatctgataaaggtagttggtgaggtgaagaaaggagaatccactaaaacttgaccctaggagcattctccgccgaatggcatggggtagtgaccctgactctggacaaggagagaagcaaatgtactcctagccctacttgggaccttaaggaaagactcatccatggccatgatagtgtaaatgctgtttattggttttaagctctttaactcaccctttggagtgaaaaacaatagaaagttaagctggttacagaacagactgtaaatgttataaaccttgaaaatgtaaactatagatacagcagatggaaattaggcagtggaagggcatgaggagagatggggggaaaggatgaaaactgattgttccaaggagctagaagatgcactctaagactgattaaaaatagcagctcgatcgggtggcttaatgtcattctggttgagggactggaatatgtggtgccactatattgggataaagcaggaaagtgagatgtcaagacaggacttcagtagatctaaaagaggtaagtcatatataagcatattatttggaaatatggggtttctctttcagtgtcctgataagagactggattcagcccagatggttcaaatgcatactttaatgaatggactacttatggtattatgggctggtttacattcttggggttgagggacagaggaagaaataataaatactaattttaaaaactgtacacaggcttattgagcactgaggcagtggaagagtggccactcaagggtgcagtggtcagggatgtaaggagcccctgctggaagcacagggaataaatgctcccacttctgcccaaacacagagaaaggcagagagtgagtgggggttaggtaaagcagggaggggtaagagaagaataaccagcagggaaggtaggtagaacttgggttggggtgatcgtgttgcctgataaactgttctgtacagtttgataatctcttgcagggagatggaatattttaatgtaaatatttgcatttagcacctactatttcatctaatgtgacaggagcttggtggaccagtagtgacttgagcaagatctctgccgtcaagtagcttatagtctgattggaaagacaagatgctaccaaaactagcaaaaaacaaacaaaaaaatgattacacattgtgattaatgctataagtttaatttcagagcacacaaaaaggttaatcctgcttgtataaacttaattctttaataatgatactgcaggcatttttacaatatagttaattatttgggagtgggaacaattcttttgagtagcccattttgctctatttaactataaatacactacatgctacaaatcagatgtacagatgaaacagctgctgcttcgttgttttgttcctgttactcattttaatgaataatttgaacagactccaaaacattaaattatatgtataaacatactttaaggattatatcataatgttagtgtatttaaaacttagtggtgatgtcattacctaaatatagtaaattttaagaaaacaaattatttgagctattttaccctctataaatactttggcagtaaaacagacaagggctaaaaatcaacccaagcatccatatccaagtatagagagctgtgaaattcccccactttcttcctcctgacatatgaaccttgataattaaaatatatctttccaaggtccctgcatgaaatttgacttttcttgcctttctaatggagatatgagcaatggcagagacagggaaaaggacttagaagcagaagagttttattctgtcttccttgatacttcctgtggctgaagggttttgtccaaagggaaaagataaatgaacagaggaagatagatgtaggctcattcctcatgcctcccatcttccgtagcattcacagcagtctgagaacagacaaattcaagtcctgggttcctatatcctgagcatttgcttattaaaataaacctttgaatacttcatctactctgattcagactactctctttcctccatgaaaaagctggtgagggtgttataagctgatactatatacatgtaagatgtagtcatgaatcattggaagctcactgcttttagaacctgccaaaattaccatactaatgcacttctatgaagggtgttaaaatggtaattaagcaaataaactctgcttattttagtacctttattcatttcagaatattttttgtatggatctctcatttgatttttacacagtttttagaagcagaatttctgctgttgcagggggaagttttatatgttcaagtacttaaatatgagagaaaatctagaattgcctctacaaatcattttgtttgtaataatcatgagttacacattctgtttgctctagaaatcaagaaacagaatagtggatcatttaaggccagaaactatatccactacttgtatctcccttttgggatggttttctgatgtttttttcagtgtgtgtcatttgtataaccctggccggctgtcttgaaaatatatgtcactaatcatggtagggggtaggtgggtgagggggtcatctgattggttgtttacataaattagttgtagtgtctgttatcttcatatttaaataactgtatatgttagtataaaactccagtataaaatgggcagctggccaggtgctatggctcacatctgtaatcccagcactttgggaagctgaggcaggaggatcgtttgagctcaggagttcgagaccaacctaggcaacatgaggaaacctcatctttacaagaaaaaaaaagtaagtaagtaaaatgggcagttggtttagaagagagacagacaaaacccataccctttctagatagaaagatccccatctagatgagtgtgctttctgataggagtcacacagccatacctgccatcactgaaccattgtgtcttttactttacctgttctttgattttgaaatactgtggaaatgatttctcagattttcagagttgtctttatggaaatgattttgttttagttattcacgtctaggacatctgaaaaccaaaagtaaagtggccagaccatgtcagtctagaaactagcagccagtaaattgtcttcttaaatattaagaaagcaatatactacctagatgcaatcaaagatgtcagcttttccttaaaaggcaatgatcaaaagtccaaaggtgcacaaggaaatagttaaacctacctaagttgaaacaaaagttttggctttaggacaaaagggtttaataggaattcacaagtaacctttctatttttgagtgactgatttgcagttcaaactacaggtaacctctttgtgctttgtgttttatattgttgttgtgtttttgtttgttttcccacgtgttggcagtgcttgccttttttgaaattttccctgctcataaacactccactagggggcagacaaaagaatagagaagaaaagaaacccatatcaatacactgcatccagtatacatttacatgacatgtttgctgctccttctctatactgtggcggaagtctttctgttcattcatccttcttataagggcactcaaagtgatttttagcagtcttatttttacatttaaaatataaacatatttccacaagttaaatggtaattttaaaattcattgtcatagtaattttttatggtttttctggtatgtctaccagtgaaccacttaataacgaacacttagttgtgtattgatgactgtaatgatgatccctatagggtttatcttacgtggagcatttgtttacccatccacactaaattgagtcttgctcttttttttttttttttcgagatagggtctcacctgtcacccaggctggagtgcagtggcgcaatcttggctcactgcaacctccgtctcctgggtgttcaagtgattctcatgcctcagtctccccagtaacttggattacgggtgtgcaccaccatgcctggctcattgttttgtatttttagtagagacagggtttcaccatgttggccagactggtcttgatctcctgatctcaaatgatccatccttcatggcctcccaaagtgctgggactacaggcgtgagccactgtgcctggcctgagtctctactttttgtcaggcacatgtccaagttttgagaacagagcagcaaagagaaagagcctggatggtagagtgtgaaaaggggggtggttatggctgcctcctaagccatttggtgaaaagactaggctgtgaaaggaaacggaagaaattcttgatggctaatgctgggtggtttttatttctaattattccttataacagctcataatgattagaatgccatatggagctggagttggggcttcacttgtgagagaataagctccccttcttaatctatgccatgtctagggaggctagctgaagactttttattttttatttttaattcttcctttatctttgctccagcaagaatcaaatccagttaccaaaaatgtatttacttcagccaacctggggttacagaatctttaaatgaaaatgttattgcttggctgggcgcgatggctcacgtctgtaatcccagcactttgggaggctgaggcaggcagatcacctgaggtcgggagttcaagagcagcctggccaacataacgaaaccccatctctactaaaaatacagaaaattagctgggtgtggtggcatgcacctgtaatcccagctacttagaaggttgagacaggagaatcacttgaacctgggaggcagaggttgcagtgagctgagatcacaccactgtactccagcctggacaacagagcaagactccatcacaaaaaaaaaaaaaaaagtcattgctttgcctctttgtggtcagttattcaacaaaatacagaacggtgtttttgtttttatttcttttttatatcataaaatttattttaactacggatgttttgttttctcaactttctctctagtttggaacagttatctttgtagataactataagtagattgtctagtaaagttttaaagtataaacacttgaattgcctaggagttaagctaattttttttctgagactgtcttcaggttacaatgcttaacataaattgaaatatcaagagatctttttttggaataaattattcatctgttagatctaataaatcattctgcacactgtgagattgcaattgttggtaaacaaggtgataacatttctgttgagaggattatacagatttgttttagtcattatttgcttagagcatcaactgcattctgtaccagattgggcaaggcctaacagaacattcattgagtgataattaaatatcttaaatgctacaatgttttggggatgctgtgttaagttagaaagtaaataaatatctagtgtttttataatcatgaaatgcattttctttatgggtttcaggaagcatttcagttaggacttcacctttccctccgtaattctagcatggtaagcaagacttggaaaaagtcacaataggtggaaaattaaggaattaaaaatttaaacctgcctcagaaggttgtatggctcctgaaaccaaagatacattcatccttattttaaaaactagctacttaaaagtatgtatgatatgaataaagattagatgagaatatggagaaatagattttttgatgctggcgagattatgtataattttcgccttcacttttcagttgacgttgttgctagttatttattaaaaataaatttgttaaagtaaatgcccatatagcttacatgatttttttctggagaacactttccttggatattgggcaaccttcagaaataatagactccaccacagtactttaagaggcacagacatttaaaatttatgatatacaagtataagctaagtttatgtttgcagggtttttttttctctttaacagctgctagaattttaagatttcttagaattaaagacgagataaaatttaaaccaatgctatccaaaaattaatatctaagaataacttcgcataaattatagagaccaaataggcttttgtctacactaataaaatgttcctttgaatccttaataatcttagtataactgccctaggcgatccaggttgattgaagcattatggattttagttggaaaattttccctgtgtttgatttagaattatctagctttttcaggaacagaacaataaatagaattgttgtctttaacatgcctacccttctgtaccagctgggatatgaggacttttatctgtgttcatagcatatatatctgtgttccacttgacttctggtctccttttctctatttcaccagcatgtacagtcttaggaatgaggaatggggaagagatcactggattagagaggggatgtgttgagtggaaaaatacaggccaaataacttccttcagaatttcgtgaaggtcaggtcccatcacaaagggttggagatttgtggtattttgaagccctctaattaaataggggaataggtaccatcttttcctttcctgttcacctttccctgttctacccttcttcgttctagttaaataccagcaattggatatgtaaagtaaaatactgaaatgtgaaattctgtggtgaaatgtgggatgtccagatgacatctctgaaaacccaaagccaatccctgtgctccaaactgaaggtttatatttagaagacagtgcagatcctgtatttttaaattgctgtaaacatgtttatgtggttatttttagcttttacagactttagtgaacttccaagttggcaagtcagacacagtcggttgttgtctgttacctcagatgccagcactttctgaatgactctggttgtctcactgggtttctaacatgttgaaagcagatgagtgtgtaagttatcttgtgtcaactgcacatggtctatctaatctatctatatgggtgattgtattactatacatagtgtacttgttttcttttttcttttttttttgtttttaagcttttatgaactggtaacaattttgcttggagctcaagatgagttgggtcctgccagatggcactgttatttctctggcagaagtagctagttattttctcttttccttcaacacttctctccttgtcctcaagcattaaatcatgcatatacaatacaaatccttacagccgctgttattttcagtccattgtatctatttcctgttgaccgaaggttatgaggcttgggtagtgtagagggagatgaaaagttgacagaaaaaagaaagctgggctcattttaggggcaaaacaccataaaatgggcaagatggcacttggatttattgaaaacaaaaagaaataaataggcaatcgtctttcttgtatggtgagatcattatctgcatggtgcatgcatgaagaatcgttttcctccaagaatcgtgttttatgaaagggtgacacccgtagccctcatggggaaagaggaagatgtcattattggcacttgggctgagccttccacgtttgcatcagagatcttgatttcattatctgtgccataatttttatcttgcattcaaccttgtacttagtccttctctttagatgaagttattcattcttgcttattggacttaatgtagtttatagtcagtagctccagaaggcataatttatctctttggaaggatgtctttctaaagaaacttttcattgccatatatcttgttctggaagctttagactgagatttatgttaagaagaaaatgatatttaagcgttattttggctttttacatataaatctaattatggaaatttgaaatttgatttgtaacacttcagtgctttccctttagttcttaatgtgaaagtgttgtttttaaacagtgatccaaatcttaatatagcagtgttttattttgttgtaaattgtgaatgtttcataagaaactaagaaaagaaaatgggaatgttttgttttgctggaaattcaaaacagtagttctaacccagaaataattattttggattggatagctgaacaagaaatggaatttagaatcagtacattttttgaagataaattttcattgaaaaattctagattgtcattggcgtattttattaatgatcagttttatttaagcaaccatttcctttcctaatcatgacaataacaacatatgggacacatttttagggtagagtaagtttgtggaacacagtgaaactaggaaatagacccacatgcttgttaggatctcaggcacaactgcttacagtagcattacacaatttaaatatttgttgtggattttattattaaagctgtacctgcttcagcaattgatcttgcttgtctcttaagttgaagaaatatcctttaaaactgcactgtccagcctgggcaacccactgagacctcatctcttccaaaaaattgaaaagttagccaggcgtggtggcatgcacgtgtggtcccagctactggacaggctgaggtgggaggattgcttgagcccaggaggttgatgctgccatgagccatgactgctccattgcacacagcctgagcaacagagcgagacactgttgcaaaactgaaaacaaaacaactgcattgtccatatgatagcttctagccacatgtggctaaatttaaattaaataagttagaaaatcagttcctcagttgcatcagccacttttcaagttttgtagtcacatgttggctaatggatcctgtgatggtcagcacagccatttccattatcacagaaagttctgttggacagcactgctccaaaactgcaattagaatttgcctctgtgcaggaaaattttatgtctttaatttgagagataacatgaattttctactgcataaacaatatttattttttcatggtcttgttctttatttaaacaagacgttattaaacatcaaatggacattgacattatacttcatagcatatgccattttgttcttattctctgtgatgacgttacattctaccctctgagagactgggaagtcattacacacacacatacacacaaatgtatggatatatatagagagagagagactatgtaactatgtatatatacataaaaatgctaacataatattcaatgactgaaatgtgtgggccttctcatagtaggcactgtgaagttgtaggttcctaatattaacatattggcacggtttcagtcccagggttcataattgacttattccctgattaagttagtttcactttttgttcactgagccttgtgggctggagatttgagagtttatggctgaattcttacaacaataagaaaacccactattggtttgttgtatcatccattatacctgaaggccaagttagtgaagaacagagacagcatcattaccaaatgaattaagacattcattcatttgttcatttattcaggcaacagttatcacccatgccttttaaccaccaagtccttgcatgctgtacactatgctgaacacttaaagagaaataagacagaatcttgggggaggaaagcagttgtacaaagggttgattgaaatgccaaggtagagtgctatgatggaggtttgcacaaggtactgtggacatcttggagtagtcagcttgacctggccgaggtgacaggggagccagaatttgcagaaagaaaggtgttgccaatattccttcacaccaaattccatctactccaaatggaaaagatgagtttcttgccatgatctctcagtattttgggaattttgcaaaccatggggagaaaaaaaactctttaaaaaaaaaagccattcctaagcatcactttgatggctgtgtaagactcctgtatggtggtatatcatcgtttatttactcagtttcctactgtgactaatcatctgggtttgcccaggactgagccattttctaggatgtgggacttgcagagctaaaacgaggatagtcttgtgaaaactgggatagttgatcatcctaccttctactgaatatttagatcatttcaaatatttacttacagaaacaatactgtgctgaaaattttggtgcctaggtatttagccacattttttttttcattatttccttaggtgagagtcgtagaaatggaattaatggctcaatgactgtggacatgttttggagctcatggcagtgctcatggttctttattgcattttttgctgtattcagctagactggcaggagtctgcctggacatttgcaccacctctgcctccgcaagttcttagggagatgagccaaagacttgttcttcactagctgcaacttgtgttccaaatctttagctggccagattgcatgtaaactccaactaacagagccttggccagaagtaggccaaaagccagtctcaaaagatggagtgaactctgtgtcccgattttcctctgcccacatcctgacctgagctcactgactctgactgcacatggtggtaagaaaagggtgagatccagtggacccaaggccagtggcctttcttcccagtacacacagctgtgggtcaccccagggcaccatccgactcacatggaacattgcatgtttaactttgtttggctcccagccagtttctcactttttccgtctcctcttggttagggtaagaaagtttgcaaaaccaccagagttagagtgtgggcacagccccaacaattgggaatatgaggacagaagtgaaatggtactttcaagtaaaaatatacttagcttgccccacagtgctgtatttagaattaatacagccatgaggtgacatactttcctgtggaacctaataaataaatttacctaattggggtccaaggcagaccagcctcataccaaattgtctctgtagtaagatgtattaaagtcaagtcctattttcagggttcttaacgtgttaacaggggtcctgtgaaaccttgaaactatacaatattacctatataccttttttctaagaaaagttttcattgctttaatcagatgctcaaagccgtctatgacccagaaaaggtttaagaaccacctatgtatattaaatactaaggggtttttgtcattgctttttttttttggctttttgtttattttatgtagtgcttatgcctaggctttgaggtaggcattaatttagcagtaatttcaacaagtaaattatatgcactattactgagaattcaaaattcctgaactctttccctagctagtatagtatttctgagtcaaatttgatttttttcctcttatgaaattgttttatttccaactaatttgttgtatccaggcaatgtacgtaaactctaatatcttaagtttatggaacagttgaaagcttagatctaggcattgttctgcattattttcagtgtattcttttgtttatattactaagctaaagttagctcggatagcacaaggctagaaaatggtgacaacagtttgaaaacaggaaattttaggcttctgtgtgtttggaacagatgatcataatgatagagccagtggagtggaaacttccaccgagcctgttttttccttattttgctctatgagaaaagatggtgcttcctggaaaacaactcaagtattttaaagcaaatggttttcctttgtccctgcttcatggttaatttgtttttctttattttatttaccctagtaatagtattatggaaatatttttaataggcaaagtaattcctaaagtgcttattttagatttttaaatatttcaatgtattaccatttactgcatggtttttagagaaaattaaagcaatatattataatgactttaaggaaagaaaaataaatttattcctctattttaagtgttcccaacttttcttgtttgtttgtttaaccccctaagtgccagtctttaaaataaagtcgtgactctttatctgtctaggctgtttcctggctgagactccttccacatgtatcccggaattctatatttaaaagaaaggttaaatatccattcactaattgcagagtaataataaaatagcatttccatatacacataaactttttgttttgtgcacatcattcctaggttattttaaacatacaattttttaaaattataaaagcaataaatggaaacattttgaaaaaacaaagtatgtaaaatatgagactcatctggccctttcatctgacctattcttagttatcagagttaacaacttagtatgtgtccttccagacctgttctctaaacatagtgtgtgtttgtataaacacacagtttgtgctgtgtttgtacaaacacacagttatttcacacaaatggaagtatataccatgtgtacaattccgcaccttgttttttttacttaacagttatcttgtgggcattgctcatgtatatatatccatgtcactttttgaatgaattgcctagctttattgtgtagatgtcccataatttatttgaccattatcctgctgataaaatttagattacaacctatcttatcaaaaatagcattttcattttgtgaaacgcacatcttcaaccccgacattttacagatttctgagagtatattgaaattttgaattctactaaagaagtcacaataatggtctttccttaaatatcagttgtgaaataccttttaagagatttcaaaataaaaaattccgctctacttttttccccacactttctcaggaaaagagcgggttagtaaaattacagtggtggagcttcctggtagaagggaagttggctcaggaatgtagaaagtattgctcttcagctatctggacaaggtatactttgttagggcttaacaactaccaagagaccccaagatgcagtcagcagagttctttttcaagtgcttaagggaatgggcttgttaatggactacttgcgtgatgttgctgagagctcaaaggaacaggagctgatgccttatctcaggggaagttgaggaaagctttaaagaacaggtcttgagctaggtcttgaaggatgagtaggagctcatggtgagggaaataaggtatttcagactgaaaaagaaacaaggaccatgtgggtgctgtctgaggccatctgtggaggtgagagattggagagatgagacaggtaagtatggttttgaagaaccttgtatgctatcttactgaaggagtttggacttcaataacaactttgaactttccccccccccgctctgaaatcttttcatttagtctcagtggctgtctgtgatgattattctgatggacaacatctcaccaaggctttgagcacttacaatgcatgaagtgctgttgcagatagaaaaaaaaaaaggaattagctttcaaggagcttaatgtccagttgggaaaataattcataagtatttggagagtttggaaatgtaaaataatagactgttccaatctattctacagcaatgcaagagatattacagagcagtaattgattgtcagtggtaggaaggtagggtgtggggaggaaaggggaaggttgggaaaaaagaaccttgaagaatgaattgggtttgaaagatatttgctagtggtaaatattgtgaacaaaaataggaagatagagacagcattggcatgagcagaagatattaatataagaagatgaagaatgagacgtaagcttgaaaggacctgtgtttgttttgttttgttttgtttttgaaattttactttaaagagcaatataatcctattgattggatctatggttcttaatcatggtggcacattagaatcatctgttgagtgtttaaacctgcctattccaatcttcaccccacccccatacactacaatttagttggcttaaggtgaaaccccaagctttttttttttttaagcaaagctctccggatatttctaatgtgcattcagggcagagaacccatggactacccccgacctcttctctgatcttctctcttgcctgcccatatattggccacttcctcaataattagctcttccagtaaaggtacagggaaaagatgagggaattttggcaagcatcacaccaggcatgtgagctgtcatttataccacagagaactcacaaaacagggtgtacagcagttacaatgtttttctttaaagctgaagccatttgctagttaggttaattaggcaaaatttgtgaatttgttagtaacgttacagccatataggcaaaatttgtgaatttgttagtaatattacagccattaatggcttggggttaatccaggttaaaaaatgtttccttcccaccaaatagtgggactcccatctgtactttcttgccagtatgtacatacccatactctagggtgtgtgataagcctgccttaagacctagcttcagtgtgacagttctacaggtgagcatatccaatttgctaaatacaggaaatgtttaaaagaatagttcttttaaaatgatgtttaaaaacatctctcttatgtctgtagagttttaaaaacaaattaatttgtttacacacctctatgcttgcctgaccaattcttgaatgggctgggcagatcgcagttatatcactatccctgcaatgcataaatagtatgagaacttctgtatttttaatccttgcctcaaacattttgtattgcgtatttagcagacattgactgagcacctccttggcgctaggcaatgggaaaggaaagaagaaaggttaaaatggctccagccctcagtacattcaaatgcacagatgtcaaatgatttaggaaaaaggtggaaatggagagctcagagccaactcggatggtgccccgaagagggctgagctaaatctagggggtagattttgtgccaaggggtgagaggcaggacagagcagagtgtttgggaaactacaagtatttccaatgtggttggaaggcagaggggcaagaagtgacgctggagagatttaggggtggagatggggcgggagttgattggagggtcctgtgtaccctgccagagtttgggttttatcctgtaggcacagggggcagtcactgagcatagggaattggcttcagaatttggtacttttaagttaccccaaaatccagacttaactgttgacttcttgttaacaaattatttgttcaactcaaaattggagtgactattgcatataagaaatggctacaaaataagtttttacatagtccttctcaactatgcagacatcttgcaaatttcagcttcttcattacctgctcgtaatggaagtctagtcgttaaaatgattttttgtgtgaatttcttttaaaattactttgagtatttggttttgaaggtttctagaaagcctgtcctttttgtctgctcctgctctgcaggattggcaaggcagtgtacggctttctctggagctaccaaggcagcaaggataaaaataggacaaactttaagaatctcagatattttcagataacaaagactgatttatgtgggcccgttttgtgctctgacaaaacatagagacgcttttgtgctgtgattagcaagggtgctgatgtcagttctcttgtcgagcatcaagctttattctgtggctaaattgtgctttgtaccataatccagagaacctttgtatctgccttattaaagtgtgtagtttatgtaattgcttttgttttccagcttaatctgtgccagattcaatgagggtgactcattttgtgactgagacaaacattcacatttggaccatgttaaaaataaataaataaatggcaggtgctgcttggctaaattctgtgttttaatgctgtaatttcctgccgtaagggttcacgtcttgtataatgtctactcagcctctgtaatcactagcccaatatatctaatgcacctcaattcattgctactcatttcttgattatttattttagttcctaagggctttttgaattgtaacaatgtgatttcaacagggaagccaaggaatggatgggggggagccacagttagccggaaaacaaagagtgacacataagctgtagcaaaaggacatgttctgtgcttttctgtttttgccattttcccaagatgttttgtgcatgtgttttggtaaagttgtcttagttatgtttattttattatgtatatgttcagtattggagctctttttctcaagtggaagatgctttgaaagcactctcttcattgtggcccatgtatcaaatctaatctcaaaaattttacaagtctactctctcaggagaattctgtttatttattgtacagatatgctatgtactaggcactgtgctatggcaaataaagcaggcgtggtcactatcttcttgaacttttcagtctgtttggggagttacgtactacacaaataaatacaaagaaaaattgaattgcaaaattacacaaatcactacgtaggtaagtaataggatctctaaaactatgctattagtttacactggagttggttgcattgagggtggtcagggaagagaagccctgaaggttggagttggccaggcaaaaagtgagggaaagaatataatgtatttaggggaaaacatgtgcaaagtccctgaggcaggtaagagtttagcctcctataaaccctattattggagggggaaaagtgacagttgatggaaattgagagaaaaaagacaggaaactgtatttaaaagatgaactatacaagcatagcaatatggtactatttattaatagtataggggcaaatgacactctatacagtgcaacagcctctgagagtctcctgaagtgcagtatagaaatggatgcttacaatacttagtctgaatcattggggaatggattatgtttggtgaagtatgtagtaaagcattttagaaagatttgcgtgcaagacaataaagttttaaaaagtcatttctgtatttaaagatgaagcttcactatctggagaaatcacttactgaatgatatgatttcttgagggccctgcataaataacatcatattttatattcttttgctttacttctgcattactttttaaagcttactgcttgagagggaagtatccatagagggataattttactaagagatgatatttatttattttgcagtaagtagatgcatattcaatgaatggatttttatagtccagaaaacagtgctaaaatcatgtgaatccaacactttatgacttttcaatattatctaaaacatctataggactctaccctgccttccctggacacaaattatatacttattcctttgagctgcgtgaagaatgagaagttaatttaaaatgttgatgattaaagacctatataatgtttttaggcctttgtgatctctggtcatcctcttgttaaaggattgcctaaatttttctgtagaggaatgcttgttcatgtagcaatacctctgcagacattttgcctgggttgctgtagtctcaagtattttcatgtatgttaaatatttttttccacaattagtcaattctttgaaggtaggaataatgaattatatacttgtttttcttcccacaagtagcaaagggaatgttttattccactgggggttttcgagtccttccacttcccagagcatccccaccaccccgctgcccttttttttttttttttttttttttgaggaggagtcttcttctgtccaggctggagcgcagtgatctcagctcactgcaactgccaactccgggttcaagcgattctcctgcctcagcctcctaagtagctgggattacaggaacctgccaccacacccagctaatttttgtattttttagtagagacggggtttcaccatgttggccaggctggtctcgaactcctgacctcaggtgatctgcccacctcggcctcccaatgtgctgggattacaggcatgagccactgcacccaggcccagagtgtcctcttgaggtagtcttacctagaatgttgaatctggagcagagaatgtttcttagtaaatgactgagacttgctaaaataggcctcttttctgtctagctgcctccctgaggaagaatttcaaagaggagtaaggtgtaagtttgtttccaggcacacatgttggggttaaaggctgataaggaaggctgtttgtcatttggttctgcttttattatttggtgaccatagatttagggagggtgatagtaaaataattttttaggcttctctaggtatagtattaaactcaaaatttaccagaacttgtggagggggtatgtggtgagtgtattacagattgcccatgtatgtttgttgggaagaggaggggaaatattagaaagagttaaatcccatactcaagaatacaggtcttactcgtatagtctttgaacaacaggctgtgtggctaaaagagagacacaatcaattgcttcccagtcaagaagccagaaaagcttcaaaacctttccccctccctactccttgccaccgcacctaaaaaaaagagaaatcttttaagtgtttaaaatctgtaggagtcttatgaagaagcagctttatgtgtattctttatggcataatattaatgcatgaaaatctgttgcttttttaaaaattgtggcaaaatatacataacataaaatttatcattttagctatttttaatatacaattcactagcattaagtattaatacattcacagcaccattgcaaccatggccaccatcatctccagaacttgatcttcttcaactcaaactctaggcccattaaatactgtaataactctccatttcccacccctccccctccgcagggcctgacaaataccattctgctttctgtctgtatgaatttgactacttgaactacctcatataagtggaatcatacaatatttgtctttttatgactggcttatttcacttagcataatgtccagcttcattcttttgcgtatggatttctagttttcctaacaccatttgttgaaaccatgactttttcatatttagtaaaaactgaatcctccttgatgtattgcctcaatattatatagtaggagatttaatcgaacatactgaatatatatatacattattaagttaattgagttatgagtaaacgttgcttttcagagtggcagattatcctgtggtaaaaacacacacacaaacacacacatattgtgactttctctaaacaatgcatttgtaaaatcagtttgataaatgtgcatcttcttgaaaacattatctcaagttaatactgaatggatatttttgttttgtttctaggcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaaggtaagttcaagatattactattcaacttgaattcttcttttctgctacatttccagaaatgtcatacaattctttgttattttagttacacaatataatgttttatttttataataggaacttgacatttggaaaaagcactgaatcctttaattagtttggggagaagctgtttaccagttttagagcgacagacttagacatattggggcagtttttaaatatcctgaagtaaaaggtgacaagaagacattttaagaacatttattgaattccaatataaatattcagtttaaccatataacactgttgatattttactatttttcacctattaaaaaatagcacatttggccgggcgcggtggctcatgcctgcaatcccagcactctgggaggccgaggcgggtggatcacgaggtcaggagatcaagaccatcctggctaacacagtgaaaccctgtctctactaaaaatacaaaaaaaaattagccgggcttggtggcaggcacctgtggtcccagctactccagaggctgaggcaggagaatggtgtgaacccgagaggtggagcttacagtgagccgagatcgcgccactgcactccagccttggcgacagagcgagactccgtctcaaaaaaaaagcacttttatgtagctcaacccaattctttaggtgctatttaaaaatatattttaaaactatattagattatggccgggcacagtggctcacacctataatccctgcactttgggagactgaggcagatgggtcacttgaggtaaggagttcttcaagaccagcctggccaacatggtgaaattccatctctactaaaaatacaaaaattatccaggcatggtggcacacgcctgtagttccagctacccaggaggctgaggcaggagaatcgcttgaacccaggaggcggaggctacagtgagccacaattgcaccattccactccagcctgggcgacagagcaagatgccgtctcaaaaaactatattagattatcccatttatgcctagtgttccattattggaacgctaagcatgtgggagttatttatatcccactgctcaaggtcatcgccaaggtctgattgcaaacattcaaaaaattgcaacctcaagcataaataggttatgaagttaggaaatagccaaggtaattatcattacctatgaaatgcaagtgagaatcagtcacaaaacacaatgaacaagtaccaaacaaatgaattacttagcacaggtcctacaaggaacatggaagaagaaagaggggctcaaggtttgggtaagaggtagtgaaggaaagcttctgaaaggaaaataaattgcaaaatgtaggcttttgaaagaaacagtatttctgtgtaaatgaaaggagggacgcagaaccctccaggcttagggacttaggaaagaacagacccagagaaggaatcgaattttacttgactggggcagtaaggctctgagtgaaaaaggcccagggacagttgcttacaaatcttgaatgagggactgagatttggggtgcctatcctggaaagagctgagtgactagagggctcaagaattttacaagtggaattctacctcgggtacttttttattattattattattttcttttttttgagataggatctcactttgtcgtctaggctggagtacagtggcatgatctctgctcactgcaacctctgcctcccaggttcaagcgattctcgtgcctcagccttctgagtagctggaattacaggtgtgcaccaccacactgggctaatttttaatatttttaatagagatggggtttcaccacgttggccaggctggtctcaactcctggcgtcaagtgatccgcctgcctcagtctcccaaagtgctgggattacaggcatgagccaccacacctgacctcgggcactttttaatagctggctgaccacttcttctctctgctcttcctttttaaacaaacgctcaacatgtaggtaggggactccagtacaaagtagttttgtagagccaagaatcagaaataaaggtgaactgtggtctttgaccttcttgtctttgtggttatactcacatttagaagcgtgcatttccgaacatctacatttaggagtgctgtagataccataaggagtggaaaattgtgttaataatcaacaccaagattcggattgaagtggagctaatcatctctaatgagctcaggccagcgtgccgcttcctctctggccagtcagcagccctggggaaaggagcctgccagggctggggtttgcccagtggggtcggggaaaccccttaatgagggcgttcagaatctcacgggaacagcagtctaagagggaaggaagggtccagcttagctgggagggggctgatgaaatagagatcttcagcagagctctagtgattaaaaacctcaagaaattgtttcacaggaggaattaagggttcagttgttttcgtgaagttactaaacgtggtcacagtgtaagtgggcatgggggtgctacttctaacttcagttaaaaccctttcctgtttgcatttatagtttatatttgagtgcagcagagggtttcagagttaaaattacaaatgaggtagctctttttaatggttaacatctagtcagttgatgtcaatgacatcaatgataattattggatttagacagcacattagttttattatgtgatggattttcagttaaaataatttgtcattttattatcttcttcttgttcctttgcctattgccttttcaatgtagaatttgtttggggggacataagggcagacttttgtctctgttggttgtctgtatagattgagctgatccaaaaagctaaatcatagatgttcttccacctctcttacttttttttacaatgctcctaaatatatttacaaaggaaatgagatgttctcatagaggatgtgcattcttcagtcaaggaatatgagtctaattttttgaagcctattcaagggtgggtagggttgagaacccaaaataagaatttttaattctcaagtgtctgagattaactttgcaagttttaaggcacagcgtcttgtctatttggccaccttaggatgattcttatcatttgggagcctgacaaacacccactccgctctgggaaggaaagcttggtatgcttttagaaaattgattgattagttcaccaaattatttgagtttgctgacactctactaggctgtgggaattcattcagcaaatatatattaggtgattagttaaggagacaaaaggtaaacatcacagactgagcatctaatgggagaggagtcattaagagaaatatccaaaataattcattgtaataattgatgagtgcaagtttatatatacatatgtatatataaattatgcattaaaatatatatacagtgcatatatatatgtgtaaaagtataattctatggaagtttatgaatatagttcttgtgctcatagagcttacagtcagtctagtaggagggacaaataatccaggaattatactactgattcataagcgctctgctaaagaagaactagataagcatagttagcagcagcagtgatctttccagtgcagaactcccaattccttacaaaatagatgagaggtatatttaggttgagtgtaactcttgacttgtgaacttttcatctttacaatatccatggttgggaaagggttgtaagaaaattcacagtatgattaatcagatttcttatatatagtctgtgagttggctaccaagtacagctgtgttaatcacaagtcatttttatgtgttcattaatagataaaacaagtatctaaggactttaatctgccaatacgttctacattgaggtcatgagctatatctaaatgcaactgcatttattttttaaattctatgattgagatttttcacaacttcatcctggttatttccccaaatagccacatttagaagtgtcttaatatactgtgttgaagtatttgttgagtttcttggaataaatctgtaaagcatgaacagttcttcattatgtagtattaagcagccaaaatcatactttattctgtaattttggtttttgatccataatggcgaaactgcaaaaagactctcaaagtttttcagccatttaagttctaaatagcagaatactgctattatcctttgtaatcatattcatacagtttaatatgacaaggtaaacatcaaaatgcctttgttcttccactgacttgactacctgttttatattctcttgtgtccaaatagatgtcaccaccaatcactaaataatagttgtttttgtttttatctagatctgtcccaagccttctgctcttcctgtttgagagagctgactgtcctactgttggcttgaaaattagctaacagcacaagataatttttttactatgctaatttcagactagatgtgagaagaaatagaccatttctatagactggttatcacagtctaagaaaataactgtccccagtccctgtgagaataactaattttcccctgaaaacaaaaggaaaagggaaaaatctgacctgtgttttgattccaggaacctctcaaaatatcgttaccatgttatttccgctgccccaggtgaccactgctattattgaatactgaaagtgctggcaggctatatctgtttttaagtcctagctcattaaactgtgtgtggttcctatgaatgcttttctttagtagatttgagggtagaaactaattttgtttttcttggaaatgtacagatttatttttgtttctgcaacacaaggtggaagctgttagatctgctaaacaagtattgggaagcagctcactaacttcatataaaggtctctaatctaattagatgcaggattagaaagttgcctctgagttgcttttctcaaaatgcccagatcatagtggcttaataaaaaaaagtacaattctctgtttgatattctccccttgagtcaagtagatataaactaacatgtaagaatatacatacacttcctttcctgtaaagcaatctttctcaattagggactttttaaaatttctttttatttacttttttattgaggtataacttactactgtgaagggcacagatcttaagtatacagttcaatgtagttttatgtattgatctatatctacatgtagatacagatgtctgtgtaactgcccctcagattaagaatggtactcttcccctcccctagaaagttttctcatgcctctttccaataaagcctccacccaaattaacttttttaaaaattgcttttattactgtggattagtttggcctattcttgaacttaggaaccattgaaaccattattttttccagtattaagcctgtgagattcatccatgttgtagcatgtaacaagagttcttcattccttgtagcatttcattgtgtgaatatatcacaaattgtggatctattctagtgttgattgatgtttgggttgttttcaatttttagttaacacaaagctgtagtgaacatttctttatatgtcttttgatgaacataaacacttagttcttttgtgtatacacccatgagtataataactgtgttacagtacagacgtatatttagctttaataggtttaacagctttagttttccaaagttagtgtaccagttgcctacctaccagcagcgtgtgagagtttactttacattctcatcaatgtttgatgttgtcagtctttaattttagctattctattgggtgttagtggtatcttgtggtgttaatttgcattttcctgagaaccaattcaaccagagagtttttagtttttttttctttttctttttttcttttcttttcttttctttttttttttttttgcatatttccaagccactgctcctgagatcttgatttattgagtctcctgcggtggggccctgtcacctagatttctaaaattccccacaagtgattcttaggccttcaaacctctggataagaattatggcatttgtcagcattgcctaaaggtttaatttaaagtctccaagaatatttcacaatctactaaagagggagtcatgacaaataaaaagtttttctacttgaaacagattaaacagatcatgctatgtttaagggtcttcagtagttgagtgaataaattgaagaaactgcaatgcaggctgcttcacagaaaattgcaactactgctatgtcttatttgtatccacttgttagatttgcctttttgaaatgttcttccataaaaaacggtgtatttagagtaagaaaatggtatgttagtattaatgataatgcatactctttgtagacccttatttgctaagttagacagttctattcaaaatgcttctctttacagaaagaaaaattattaagcacaccagataaatcattaatcaatagaagcagagtaaccctgacctgtttacatttaattgtgaacataaaggtaaacttttacactagaaaccaaaaaaattattctatcagtagatatagcccatcttcagagaaaataaatgtatttggtctcctgaaaagaacatggggatcaccacagttttattattatatgctcagatacagtaatttagtggttacaaactcaaagagcctatcacatcaagtttgaaacgttctaccttaccaataagaaagagtagaattgtttcctagggcttcaactcttctaccatttggggtttctttaagtaattattttgaatgtttagaggcattgtcttggcaccccaacttttgtgagggatactaacacaagggtattatggtttcaaataggataaactgtgcattaggctaggggtcatgtgggccagtttattatttgtggatttcatcacatgataatctactcttcactggaagcttgttcactgaaaggctttccctagcagtacttaatagcttcctaagtaaatttcaattaggagtttgctccagcagcttattagcctttaatggatgttaattatactcttcatgccttctgatttaagaaatgggaaataattttacacacataagcaaaccctaaactaatgtttagttcttagaagcttgataccagcattacttagaaagagcagtaagtcagaaactcaaggcagaaagcaaaatggtctattctattactggtacagtagtatagaatagaggcaaatcacaagtctttataaagtagaacagaagtttattttttcagaccagttgcttagctttggtcagaaatgcaatgttcgagaatatttacacacagtgcaatgcttgtattaaaatatgcagagctgagtacatagtcaaattaacatgagtaaaataatcccaaagactacaactttgaagatagtgcattgtctgagccaaagtagtgaagtagttccctcttcccttttaaagtcctttgtatgttaatgtggtttggagtggttggggtttctttaatggctgtttaaaggtcttttcatgatcttgctagcaaacataatgaaagtttttctgtagttattgcctcttagaagtgtgtaagtcttcagctgggcacggtggctcacgccagtaatcccagcactttgggaggctgaggcatgtggatgatgaggtcaggagatcgagaccatcctggctaacacagtgaaaccccatctctactaaaaatacaaaaaaattagccaggcgttggtggtaggtgcctgtcatcctggctaacacagtgaaaccccatctctactaaaaatacaaaaaaattagccaggcgtggtggcaggtgcctgtagtccccagctactcgggaggctgaggcaggagaatggcgtgaacccgggaggcggagcttgcaatgagccagatcgcgccactgcactccagcctgggcaacaaagcgagactccatctcaaaaaaaaaaaaaagtgtatatatatatatatatatatatatatatatatatatatatatatgtcttcacgtgctatgaaaaggatattttttttttaaaaaaaaggaaactttgaatctctgtcctcttttcagaaaattgagaggatcttgcaggtataaagagggtaagacacttctgtcatttacaggggggagaagtggaaggttaaaaatgagatggtcctattgtgttaataaaacaaagtcagacaaacgtaattgcctggctaggtgattttcttttctactcagtgcatttagtgtatagccatgaagtttaaaaaaagtgttaaaagtgtatctgtaaaaacaaccacctgaaaaagttattttagtagttgcagtgaaaagctagaattcatactgtttcatatagggaagtatttccagtgagtagtgttttttggtcagaactaaaaattgagctggtttattccattttaccatgcctgtactgtagaggaaaggggaagtatatggaatacacttgtgaatacagtgtgtaggatacattaacagttttctgagtgggctgctcttttttcctcaatactgtatatatttttcttaagctcttctttaaaagataaatatttttcatacttctcttaaatcctcaaggattaactctgagtcaccatttgtggtattttaaatccttttaaataaatctctgtatttgcaactgaatcaaaacagtaaaacatttcacagggtaggatctgatgaccattttataatcaacatttttagataccacaagaggtacttatgagcatccactgaaattatggcattatgtcatataaatatccaaaaattcatttttttattcttatgtttatatataagaaagaaaaggctgggcacggtggctccctgtaatcccagcactttgagaggccgaggcagatggatcactaagtcaggagattgagatcatcctggccaacatggtgaaaccctgtctctactaaaaatacaaaagttagctgggcgtggtggcgtgtgcctgtagtcccagctactcgggaggctgaggcaggagaatcacttgaaccagggagttggaggttgcagtgagccaagattgtttcactgcactccagcctggtggcagagcgagactccgactttaaaaaaagaaaaaaaaaggcctttctgtgctacccacagaggggtccatacggcgttgttctggattcccgttgtaacttaaagggaaactttcacaatgtccagagcccttgatgtcctgcaaatgaaggaggatgtccttaagttccttgcagcaggaacccacttaggtggcaccagtcttgacttccagatggaatagtacatctctaaaaggaaaagtgatggcatctacattataaatctgaagaggacctgggagaagcttctgctggcagctcatgccattgttgccgttgaaaaccctgcagatgtcagtgttatatcctccaggaatactggccagagagccatgctgaagtttgctgctgccactggagccaatccaattgctggtcacttcactcctggaaccttcagatgcagacagccttctgggagccatggcttcttgtggttactgaccccagggctgaagaccagcctctcatagagagaggcatcttatgttaacctacctaccattgctctgtgtaacacagattctcctctgtgccatgtggacattgccatcccatgcaacaacaagggagctcactccgtgggtttgatgtggatgctggctcgggaagttctgcgcgtgcgtggcaccatttcccgtgaacatccatgggaggtcatgcctgaactctacttctacagagatcctgaagtgattaaaaaagaagagcaggctgctactgaaaaggcagtgaccaaggaggaatttcagtgtgaatggactgctccagctcctgagttcactgctactcagcctgaggttgcacactgatctgaaggcatgcaggtgccttctgtgcctcttcagcagttcccttctgaagactggagcactcagcctgccatagaagactggtctgcagctcccactgctcaggccactgaatgggtaggagcaaccactggaaggtcttaagctgttcttgcacgggttcttaagcaacatggaaaataaacatcagtatctaaataaaaaaaattttaaaaattacaaaaaaagaaaaaattaactccaggtataaggtgttagagtttgttagatgagctatgaagacttgacattacatggagtatagtaaagataaaaagttagaggttggttcaccttctatttactcaggccagattctctaacagaatatttttgaacttgattcatctaggagtgctcagagtttttgaggagcaaatcccaaaactgcacatgcaggtgaatgggtcttaacagatttggaagtgccccttgccttaatttcttctgacttgacacaaagtctgtaattccagcactttgggagactgaggctggaggatctcttgaacccaggagtttgagaccagcctgggcaacatggtgagacactgtctcaacaaaaagtttaaaaaattaaccagatgtggtagtgtgtgcctgtagccccagctacgtaggaggggaggattgcttgagcccaggagttccaggctgcagtaagctaagatggtgccactgcactccagcctgggcacagagggagaccttgtctcaaaaaataaaaataaataaataataaaacaaacagagcgctcagtgagtgtctgccctgtgaatgaaacattttttcagcatctgcaatgtgtaatgcacaatgcataggagttctgatcctttcttgtttgttattgggaaccacaattagagataaactgtcatatttagccatattaatacattattattcaggcttcattattaggatatgacttcttaggcccagaaggttgtaaaatgagctaaataaacatgcttgtggtacctttatgaatattatagttaaatacataaaggcattatcaaaagcatgtggatttattcttataatttattatctagagaaaatagagcagatatttcacctctctatggtaaattaacaagccaaatgacatgcattactgatgcagaactttgctctgtagttcagctaaactgggctcttgtcacaagaccaggaaggattaggaacacagacacattgaagggtgaggggaacagaatttattgggccaaagaggaaaagaagaaaaaagtactctcaggaaagtgagagggggtcctcctaataggctccccacctcacagactgaattccaggccatcacccaggatctgaaaaggccaggctcctccctatatctatcactccccactctaaagaagtgcatctaactgcctttataataaggataaggatgaagaccaatcttaactttttcttgctgacaagggtccctgttttgggaaaacagcagtcagatccccctcagaggcttatctaagggttcctggcaaaaggggccatcatttgaggctccggttgcatgactgtttggagtttgatggcctgaaggcgagaatagacaaaccgggttattaaaaacatgtatgaaaacagaacggggttgcgggtaaatacagctaaaaaatcccaaggtcttttatcggtttgcacagggagagggaggccaaagcctgactggtaaaaaaaaaaaacaacaacaacaacaaaaccttttaccctttttccggcatgtcaggcttctgtgttcccttcccccaagcacaatcctaagtcaaccagtttaaggtttgggaaattaacttttcccagtttggaggctacatcagaggggcgtgtcccatagtacagagacaaaattacctatcagcaaagggaggacagaggaggaaaaagaagattttttttcaaaggagtcctacggattcagaatgcatttgaaaggggtacagactaaaggtgaatggctactcatctagaaagaggggagcaaagcatcccaggttcccttctcttcctagtgaatacccagagtatgtgagggagagaaagtgaagcatctctttctttcttccatcattatatccccaattcccagcaacctctacagggttccacccatgggtatcaaagtggccttcacctatgttaataggggggcctatgggggtgggaatatgtgctcttacccacatatgccctatctcccctgctgtcagtagcctttgaattccctagactgcatttatgccatggatattggtataacctttatccgtgaaaggagaagcctggcttaatcggtagggataagtcacactcacctgagctgtgccttttaacttccattattgtctgcctctggacctgtcagatctagttttatttcctagggcttttacccaaagcttagaattgagtttgagacaaaaatgtgtcttggggggttgtatggactctatatcataagctgaatgctaaggtgaagctgtggaattgagtcctcctccaacaagggagagaaaaggatgtcttgtgacacacccagataactggtggctatagttatgcttgctaagatttgggtgcatgggacctggctttggttagctcccttggtcttacttttccaaaaaggaaacctctgggtgatgggcatcctgtttattcccatcacttgacaagaattgcaggatatttgcttagaactagaatattgatccagatttatccatccccttagcttcttctgagctgcagccagagattgctggttggttcacaggaataagcagggtaagtttaaaatgtaggcaagaacttaaaaacaactaatgggtctagaatataatgacaaatgtatgagaagttttgaaacatttctctctctctccagtcctcatttttgttaaaaacaaatcactcataagtaggaattgaacaatgagaacacttgaacacaggaaaggagacatcactcaccagggcctgttgtggggtggggggaggggggagggatagcattaggagatatacctaatgtaaatgatgagttaatggtgcagcacaccaacatggcacatgtatacatatgtagtaaacctgcacgttgtgcacatgtaccctagaacttaaagtataataaataaaaataaataaaaaaaatcatgataggatggagttgtttgcaaaatagactttagtcttatacttggcccattatttgcataaagtgcagcaagaatttttatttatttatttatttttgagatggagtcttactctattgcccaggtgagagtgcagtggcacaatctcggctcactacaacctccgcctcctggattcaagtgattctcccacctcagcctcctgaacagctggtactacaggcacgtgccaccacacctggctaatttttgtatttttagtagagatggggtttcaaccatgttggccaggttggtcttgaactcctgaccacaagtgatctgccctcctcagcctcccaaagtgctgggattacaggtgtgagccactgtgcccagcctgaataattaatttaacataggccttttagatcgactttgttccacaaggagtctcagataggactttctaaagccaagtccatccatgagtttgtaccctcaaatacttgtgagttgggtaaacgcctctcttcctgagatcccaagaacatgtgggtcctgggcctgttggaaagtggcattctctactcaccacaggttaggaaccctgtacggggactgtgtagatgagctatgaggccaattttcccaaggggctgaataaagattcagctctgcaagtagagcttgactccttaaagggaagcatacctttctagtcaaagccttggtgaaacaaccagtttctccaattgcatcctgttgcaaaagaaaatggattcttactgcattgatgcaaacaaccatattgctataagttaagaatactcacaactagtttccaaattctggagaagagaggcagagagacaactatgctccaaattttgttcacaggattataccttactcaattattaaaggccatgaatagctcaaaataagtttccttggactctgataaacaaagatcagcagtgttccaagcaaaagtcaaaaaggttacttcagttttctgtgagttcagtccatttagttaactcgttttgcttgatgttcgtgaacatttcagccctccatgaatcctgtacatttttcctttattccaatgtcacaatctcccaagttatcagaaacctacatttgaaagcacctgtcaaagttctgtagctgattataaacatcttttgaagaggatcaaaacaagacaattgtcagtgagtaatgaaatgtctacagtagttacagtcagaaacacaattgaaaaagaaatttggttatctctgtggtttacaataacataacaaccttaattgtgattgatagcatatactcagacattagaattttagaaatcccatacaattttggaacatatattaatattattccctaagatataacctgaagaagattaaacatcattttggcaatcccatgtacctaaacatgtcaaatagtcctgtttatctgtcttctgggtgctccaggagccctctgtagcatccagaaagccaggtgtcagcaaagacaattttgaaactgaagtttgattttgggaagcctgttaattatgttagagggttaaagcacttgatattatgaaatagaatttcagattaccataagttatttattttgccaaaatgatgactcaaattcttgaaaaagcagaaaccttttataaccccttaaaacttttgccatagagattagtgccttaagagtaccttattgtgcttttatttcagtgctcaatttacagaaaaaccatattatatgcttttgaatttagttaatatgttcacacttggaatttcttttgcaagattaatttttacaatcctttcacaacttgtttgaacttctagctttatcttatctaattcaaaacaatcctttaaccccaggcaaaaatttacattttgacatctgcattttaccaataatctttaggctttttctatgtctcaaagattaaagtcacgtgaactaaaaggtaccacacagcttttatctaccctttcaatatttgatccaagcacctatccttctttaattaattagagctctttttatagacatcacccagacaacacatatataactacacagacaggcagaagaaaatccagtaaccacaagatttttcatttgccaacctccgggttgagcccataaagagacaggattaggaaaacatgaagcttctaaggcctaataaacagttataactgggaggcaaaaacagattttgagagggatctattcacttttaatttctggggtttcatgaggaaaacagaggtctctcccctctcatgcaagaattaagggtggcaaggcaaaatggagaaaaataattcagttgactagaaaaagcccttttccagcaaaacaagacccaggaagagaaaaacataaaggccttttaaatatacctataatttggatatccacttttaattaagctgagtgctctttaagaaaattcttttaaattctttgttatccgactttagctgcgcgaagtggtcagtgtttctggctttcaaactttactaaaggctcagagaaaggaaaacccaaggcagttggtggggaggaagagaataaacaaatagcaaaagtcacatagatatcaaaccagaaaggactctgcctgagctaggattgagcctgggccaccattgtaaaatggcggaggctaaacaaagcattgccacatggttacaggtcacacttccaaggacgtaaaacaagatggaggcctgcagcaaagtttgctactgaccatacagaaagacatgcaaagcacaccagattggctaaagcttaagcccaacctcacaaatcctttttcataactaaaactttacagagaaagaagaagcagttttccttatcattcttggtctagcaaaactctgaaaaaagaaaaaaaaaaggcctcgctttaaagctaactcctgacctggtggagaataggaaaagacagcttaaatgcaaggctgtgttaactgctgacagcgtggagaaaagaaaaagatgcctggggaagaacctgtcatatgcaaataggtttcttctaccgggagagagacatggtggggaatgctggccagcccactgcgcagggccttttggccttagccactgctgtctaactcgaaaaaagaaggaaaaggccaacattcctgatccctgggagtgacgggagttgtggggaggcataattccctctaacctcagaagaaatctgaagacaaaaaggcttagaaatgaaaggtaaaaagattttttggtttgcatcttaccctttctcatgccccacattcgggcaccaaaaatgatgcagaattttgttccttagttcagctaaaactgggttttgtcacgtgaccaggaaggattaggaacacattgaaggacactttgagggaaacagaatttattgggcaaaaagggaaaagaagaaaaataaacttccagcaaagcgagatggggtctttctaacagattgaatacaaggccaccacgtgggaactgaagagacttcagtttcaacccagctttttctgttctataataacaaattttaagaacaaatttattcatgtatgagcatttgcctttttctgcattatttatggccttctattcctaaacagactaacagcattttttctgagcctttaatatacttggttatgtcagtgactacagcgggattttattctagaatttcacatggttttcaaattgcttcattctgcacaatttagctcttttcatatttctctcagaacatagttaagggaataataaattacttatttacttgctggacctctttccatgaaaatactacaaaaatccactaaatggcaaataaagttatgagctgagggaagaggtgatgccttaaagaagctgtttccttgaacatgaatagactttattttcaccagtcccagaattagaagtatttctctgtagtctgctaagaggtagaaagaaaagaacgatcatcgaaataaacagggtaaagagctggccctggtactcacaggaccacaggcctggtaaatactatgtaattaaatgggtctccttggaaggttgggttggcttaggaagcacttcattatcatggagttttaaagtatctttctcttctgctaaggttgtagaacagcttccttctcatagcctcaaaactgaagactgttcaagcaaaggttagccatggcttttttagaggatctggaatatatatagagtcctactctttagatctctttgacaagaataaaaaaatacttcctgtataaaggtcgccatttagatagtgtttgttttagctgacattgtcatgatttattctgtttttgtgtgttgaaacaatttgtctccaaagtagctttgtttttccaaaaattgtttaactgtgatagacgtgatagttaaactttggtgttgcagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccaggtaaattatatatgcccatgtgagagagagacagaggcgtgtgtatgtgtgtacacactgagattcttacctttaaactttttaaatttcgatttgcaggcttgaaagagaccatctgtataggcatatgtttcaggctttatatttcaggtttacattcccctattgatttccgatattcaggagattgtatcgaagagacacaatctctgccatctttggcaaagagcagttttccctacaaggctcttttggaaatctgtctcctattttgtagtctttgttacagactcacagtattacttgcttaacagatttcactgatttataaatggtgatcttgctccatttcttatgtgattgtaaaccagccaagggtcatcttttgtttctgaagaaggagaggaataccttctactagaagattttgaaagcaaaacgattccattgcagtgagtgtgttgtggtggttttggatctgtgtgagaaattaatcataaggtaaaatcccaatatagcaaattccatggaatatacaaattggatgttagtgaaatttgatcaaataaatatattcctaaaaattacgaaacttttagtcttcatatctagcaatgaagcagagcttaccctaagcctttttatttatctttttttttttttttttaggagacaagggcttgctctgttgcccatggctcactcatagctcactgtaaccccaaactcctgggctcaagtattccttctgcctcagcccccaggtagctaggacttcaggtgcatgccatctgtatgctggctggctaattttttctttgtagtgacgaggtctcactatgttgcctaggctgatctcaaactcctggcctcaaacagttctctcacctcagcctcctaaagcactgggattgcaggtgtgagccactgcgcttggcctccctttacaaatttttaagtagaagtatatggagtgcagcacttgactgaaggaatgaatcatcaagcctgtcccaaattcttggtttctctaccatctccttccctgcccccacacccctttcctcttctaagctataaggcattttaattggatcctccttgttacttgatgttgaatagttagaagagttaaggcaataaagagtcaagaagcagttgttttactatttttaaaaggagcagaaaaatgatgattgagaggccaatctctgccattagtagctatgtgacaattagtgataccagtcaactgagtacattttatttatgtattaatcagctagggtctggatagagagtatatttctttatagacatgaaaaatgtttttttaaacaagattataattaagcattattttatgacagatttttttttaatgtggaaaatgattattactgggctaggatcagacaaagcacttgttcaaaaattttaatgtagaatatgttaagattcacgaaatagtttctgtgaaccatgccctgagatgatggaaatagctcatattcattccaaagctggatttctatgtatttgttgtaatgggattttacctgtaagagcagaaaaaaatttataaatcaacatttgttaatatcaaattctaacttgattttgcttgtttgctgtgagtatctaaaattatacactggcaactttgttacctatgctactaactaatattttattttacaaaagtttacaattatttttcattagcaactttttagaagccaacagccaagcgacagttctcagtatattttatttttatatagtgtatttcattgatttcactggtatcacagctttcctcttgcagtacaacttatgctcaaaatcatcacccagatgtattttgctatctatattttgcaaaagtgacagttaaatagcaaatatttatgaggtaaccactatgtgcccaatattatgctaggtgctatgaaggtacaaactatataagatatagtctactcagatatagtcacctttggagtttacaagtaagagttgctaagaagtgaaaacatgcaagcattaaatatttagagatgaagataatataccagagttgccttgcaaactcttgtttgttctgcaagactttagttagaatgtgctcctctaggaagcattcctctcaaactcccaagttagcttaaatatctttctgggtttttatagcatcctggttatgccttcatatcttgttttatcgcagtgttagaaacgatgtttttacttactcttcactaactgtaagctagtcagagcaaggagctttacttattactcataattcctctagcttctcttaactctgcatttgaattaaatgaagtacaaattttagaatatgcataggtgcattagaaattccacaaagggacagtgcaagtgtttttaagatggagaaaacaaaagcttcataggaagaatggaatgtgaactacacctagttggtgagagaagaaaatcattagtaatttgtgcaaaaatagcttgagggaaaggagagatgtgagcaagcatggtgggaggaagataatgaggaggagagcctcttgaagaataggatggagaaggtggagccaggttattagtaacctcaatgtcaagtggattagtgtgaggccttatagttcccacaccctgtaggggcccttactaggtttttctcttgaatacatgagtggtataacaactgtgttttgaaaatattgatcttatagaagtctggtcccatgaatagattgaaagaggcagacagtagaggaaattccactaaggagagttcagtcatgtagatctcagcagggatggggacctgaacttgggatggtggcaatgggaatagagcaagggaataagtacgcggctaagaagaagggctcggtgcctgcgtgactggaaatcaaagagaaggaatcaagctgattgagttttaagcctggagaatctggataaagtcatttctttcaatgcaagccaggaaaagcagtcaacttaaaaagtaaatggatttctatttgaggcccacaagcaaggtaatactggagtaaccaagtagaaatattagtttgagaatatgggacttggaatttggtaagatgatggaagttgtcagcattcagagaagaaaatgaagttctgaaaaaggaggatgatctctaatagcgtgtatggtaaaaggttagaggactgaactctgttggccattcccagggagagagacgggaggaaggagccagtaagtgaaacaaggaaataatcagcaagggagaagggttttaagatctttttaagatggagaaaacaaaagcacaatgtggcacaatgtgggttttctgatagtaaagggggagactttacagagcgtagtgccacatgttactaagaagtcagggaaggtaagccctttaaaaaaaaatcatagttatttaaagaaatattgtttaaattcctacaggactttggacaacatgcagaagtagttcaggtatcttgtttagcattaaggaagtgagagtgtgcttgtgttgttagcttcatcttgtcgtatacccaaattttgtgatacctcaaaatgcagagaccgaaaatgttcataaatgtactttaatgagatttctcaaagtgagttattgtttggagttggttaactctgtatcacgtatttcgatcctctttataatgttggctaaatgtttgttaaagaaaagtagtggaaaggaagatatatgaaaacaattagatgttaccttcttgtaagtcacattgaccttattcaataccaagtaatcattagacttttaattttacggaacaacaaatttgccgtggggaggtttaagaccaatggatcaactatataaactgtactagcactaggtttttgcatgctcttcagaggaaatgcttttccttgtgtctatgcattaatcatttacctttcccagagttttgtaatgtttaattccagtgcttcagggattgtgtttttatgtgcagatttaataggtggagttgggggtgtgggcagatataggacagaattagagagaatgcttttcttggttttgtggtggcggttttgttgtctgatgtataatcataaaggctaaagaacatttgtgctttaaatcctatggatcacacaaaaaatctaatgagaaaagccctatcttttgattgcttagcgataaacatgtttataaaaaatgtattcttagtctccaccttgtttattctgtcattaacaatttttatttagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaaggtcagctctagttgacttcttctctattagaggttaatgatagaaaatcgatttttctgaatatttgttcttttaagcgtagttaaatatactatgctacaaaatacagtccatttttttccagctctacagctacctggaagggtatattgcattcatgctctgctggaagggaaaaagagttggagtttctcacccctgaagaagtatggccttagtaatgccttcctgcctcaggaagtgtgcccttctctctcccactttctataatcctgggtggataggccctctgttgggacagaagggcaggaaatggaccagccacaaagcctctccgagtcataccctttcctgtatttgtgtgccattatggccgcttctaagtcacatctgttgggctctatttccttccttcctatataagcagtttttatgttgtgtctaacaggtgatattctgttccagtcaagccattatgctgtttgatttttacttgtgtttaaagagctgaatcttctttccccttatcactacccacttcactcattgctagtgagtatactttcctatactgtctcctagagtctgtatccaaaagttacagaccttgagaggagaagaaaaaaatgagtctgggtgattctctgagattctcaaagtcctacaaatagaaagctaaagtttttaatgcacatatcctaaacagtatgtgctaaaatttctgtattttgtggtagagttttcctcagctatctccaagattttaatgtatctgtgattattacttaaatcagtacttatttcaccattcaataacagtatctaactcctttcttgaagtgactgtataacctggttatcagttagtgagatgtaagttatgcccaaggtggtgcaaacgatgagaaaatagaggtgtttctcttcatctttagataacctatcttatcccagacttagacattcactcacactcaaaattagatattggtattggttagcatatgagtgagtgtctgcattttctagtggtttaatatgccaattcaagacacagttctatgagcatcctttttaaaattctgtgtgtgtgcatgtgtgtatgcatatgtataatgagagaaagataataggtcatcccaatgaccctgagagctggcaaagatgggaataaatgttgatagtttgttctttattttagatgctagttctcaagactgctatgatattccacgagcatttccaagtgatagatctagttcacttgaaggcttccataaccactttgtaagtataattgaccttggcatcatcaagtgtatttcattgtctaaatcttcataattagtgccatgagactaagtgatatcatgaaataaaagtacgctgagatccatatgaatgagtgtgacttacaattgtgttttcatgtgtgacaagagtttttgtttattaaaagaaatatatatgtgttttagaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaaggtaaggagagcatggcaaagtaaaaggcttggggagtgccaagttagatctatctttaactgccattaaatccaaaatagaatttggactagaaattctgaaatatttcatagttccatagccatcaagttatttaagcaaagcagtactgccatttataaattaacaattatgatatcacatgttgatgtgaggtgatatttataagtctcctatctctagagcagaggttacaagctgaaatactcacggggtgagcggacaactggggagaattagaagaaactggactgccgtagccccatctaatgggagtaactaacctacactgctacaatcctttgttgacttgtgaaatgatgcacccatgcaggcaaatcttctggtatatcaggaaaagccagagatttcagattttatatgtattatctctcaatttttaaagttctatcaactaatttaattattaagaaaacattgcaggccaacccaaacacttctgcaagctagataatggccttcagctgctatttagtaacctcttctccagagtatataatatcaaatcagacttaagattattaatgtatttgacataattatttaagaacagtgagactgtataatctttccattctgttcatataacaacttcttaaaaattactttgcctttgctggggtaatacatgcttctagtctgtcatttttttttccatgctggccttcataagtaacattaagttctaaggtaacatagtttgttaagaagtctgtaaaagaaactgttcagccaaattgggtaatgcctacccaggttttttaaattggggtttaagttgttaaaacacagacaatttgatttgttgcaccatgctgttagtgtggcttaatcttgacaaccaagtaaattagcataaatgtaaatgtgatgaatgatacaatatctggcttacattagggtgtttcagcacatttgaaaagtctcatgtgctatatgtagctttttaagaccacataatgttggcatcaatttctccttaacctgggcttagatcattaatattagttctaattaagtcctagttgtgaggaaaagagactgaggctcagactatcttaagaaaaaagatttggttttgtttgtaagtaaggataacctcctcgtttcaacaggaggttaacctccttcaacaaggaggttatcaggaactgaagcaattctaggggactgttgctgtgtcctgctctctctgtgcatttctgttttatgggaaatctttgcatctggtttgttctctttcacattcttcccttcttttctgttttcttttctgattcttttttgttttcttactctgtatcctctacttaaatggattctgctttccaagagctttggcctccaatgctccccttctatggcctcagttctgcctcctagctgctttttatgtgcccttgcagcttctgcatcagcttctcattgccttacttattatttactcactttagattgcttagagatgatgtgattggtctatgtgtgtcacacccacgacgacccagtctgccctggcagcagggctgtgattgcggtgtggatctcagaaaggatgtgagcatcagaggctttctatcggataatgcttccttttgtttcctttttctttgtctctaaatctattttagacaactactagtcattttctttgcatataatatgcaaaaatatgtttggacatgtatagctttataattggttcatacagatcactgaaggattgagatataagtgtcatgaactctttgaaatattgaaatatcttttttaatgttaaactggtgctttccttattttccagtaacgagtgcatgttagtggcagatctctactttttaactccaaacctaacagttttatattttgaggtctcgcataaatgtggagggagtaagatttgggtgaggttacaaagcttttaagtcctacctcccttgctcctctgctgctcttttctccccttgagctctgtagagcacagtttgaaaactccagtatatttcaacagttgtgattccatgtggtaagcataatatgaaatcaggaaacaccactgtttataagttagaaaagacctaagatcaattaatgattagcttttagtatcctctaggtctgatatcactcatgtatcccacattattatgatatatattttatgtatatatcagaatatatactatgtatcatgtatactacatattttataattatacatccctatgtatttagtgaaagtactattattctagtacactagagactaatcacactagttctttaacgtaaaagaacttaatagaacagaataaagtaggttcttatttctggagattgtgttcattcttttaaaatttaactgaactgttcagagacaattgtgagttcgttggccacattatttatttggcatatttgcttagatacaaaatgaacttaaaaagagcacccagattgaaatacccatatagtttttgccagaatcaagaatagacttagcaaaacagtaaagaggttcctgaagtcatagtattcaaaaaaaatttacttttctttagtactattttacttttttttttttttttttttgagacagagtctcgctctgttgcccaggctggagtgcagtggcgcgatctcggctcactgcaagctccgcctctggggttcacgccattctcctgcctcagcttcccgagtagctgggactacaggcacctgccaccacgcccagctaattttttgtatttttagtagagacggggtttcaccgtgttagccaggatggtctcgacctcctgacctcgggatctacctgcctcggccttccaaagtgctgggattacaggcgtgagccactgtgcccggcctgtactattctactttttaaatagttatgatacaggagaggaggcttgagaatgtatttaacattacaaggcagactttgtaaactcactttacaaagttatgacttcataaactcactttacaaagttataacttcaagaaaaacacattttaaaatccaaattcagatctcaaagcaaagtttatccacaaacacttaaacaaaaataatgtctcgtttggtcctataatttttctcagtattcatagcatcagatgaatctattttaatttcaaatttcatgacatcagataaatgacttaatctattattcagtatctcttatataaaactcattataagcaaatctaattctataaaatatggcttgattagtttcagagctccatataactagttcattgccctatatgtctggtttttgagattgtctttggaaggatctataagaaaccagtaacattctagtcttgtttatagccccaattatagatgtcagctgctgtagtttgcatacagatgagcttttcaaatacttatgagtaattgaaactgcagaaatacatagatgttctgaacacttaaacataattatcttagaccctttgcctgtcactcaattcatgatagtgatattttcatcatactatttctgtcactgtagtgtttgttttgagccaagttttgtgtgtattaagagaaacgtattttaagcatactgtattaaatattgggaaagcagatgagtcactggaaatacaggacaaattatattttgacctcttcaattgaaaattttatatttctgatggaaagggagttttgtaaagtttgggaaatttatctgttatagcttctctttatgtcatgacataaatctagtatattaaatcgctaaacttatctaaggcccccatctctgtctagtctctgtctagcatgatgcagcagctgtgtgagccccacatgctgtctttatgttgttatgtttggccttgtccattcacgcctttctgcaacagtctgaacattagttactatactgacttttttttgttaagccagtgcaaggttttgtatggtgtttttatacaccactttggttaaagtaccttcaagcttagatccttaatattgtgtggggagcatacagaagactaatcctgagagtttccctgggtgactcttttggcacagtgatggatttgctctaaacattttttcaagagatcttttaaagtttctgaatgtgattaaaaattaacatgcactttttaaaatttttattcttttgtatttcaatttttattttagttttaggggggtgcatgtgcaggtttgttacctgtgtatattgtgcgatgctgagatttagggtatgaatgatcctgtcactcaggaactgaacatagcacccaatcgttagtttttcaaccctttccacctgcctccttcccctctctggtagtacccagtgtctgttgttgccatctttatgtccatgtttagctctcacttgtaagtgagaacatgtgatatttggttttctgttcctgcgtttatttccttaggataatggcctccacctgcatctgtgttgctgcaaaggaaatgatttcattctttttatggctgtgtagtatatgtaccacattttcttgatccagtccactgttgatgggcacctaggttgattccatgtctttgctattgtaaacactgctgcagtgaacatgcgagttcgtgtgtctttttggtagaaagatttgttttcttttggatatatacccagtaatggaattgctaggtttaatggtagttctgttttaagttctttgagaagtctccaaactgctttccacagtggctgaactaattttacattcccaccagcagtatataagcattcccttttcttcacagcctcaccagcatctgttgttttttgactttttagtaatagctgttttgactagtgtgagatgatatctcattgtagttttgatttgcatttctctgatgattagtgatggagtattttttcatacatttgttggccacttgtatgtctcatttctagaagtatcagttcatgtcttttacccattttttaatggggttacttgttttttgcttgttgatttgagtttcttgtggattctggatattacctctttctcagatgcatagtttgtgcatattttctcccattctgtaggttgactgtttactctgttgatagtttcttttgctgtgcaaaacctgtttagtttaattaggtcccacttctcaatttccggtttgttgcaattgcttttgaagacttggtcataatgcctagtttcttgagggttattatcaggaggagacattggattttatcgaaagctttttccaggtctattgagatgatcatatgttttttgtttttaattgtttacatggtgaatcacatttattgatttgtttttttgtttgtttgtttttaattatactttaagttttagggtacatgtgcacaatgtgcaggttagttacatatgtatacatgtgccatgctggtgtgctgcacccattaactcgtcatttaacattaggtatatctcctaatgctatccttctaccttccccccaccccacaacagtccccagagtgtgatgttccccttcctgtgtccatctgttctcattgttcaattcccatctatgagtgagaacatgcagtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttaggttggttccaagtctttgctattgtgaatagtgctgcaataaacatacgtgtgcatgtgtctttatagcagcatgatttatagtcctttgggtatatacccagtaatgggatggctgggtcaaatggtattgctagttccagatccctgaggaatcgccacactgatttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttctggctgcataaatgtcttcttttgagaagtgtctgttcatatcctttgcccactttttgatggggttgtttgcttctttcttgtaaatttgtttgagttcattgtagattctggatattagccctttgccagatgagtaggttgcgaaaattttctcccattttgtaagttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatgtggctagccagttttcccagcaccatttattaaatggggaatcctttccccatttcttgtttttctcaggtttgtcaaagatcagatagttgtagatatgcggcgttatttctgagggctctgttctgttccattgatctatatctctgttttggtaccagtaccatgctgttttggttactgtagccttgtagtatagttagaagtcaggtagtgtgatgcctccagctttgttcttttggcttaggattgacttggcgatgcgggctcttttttggttctatatgaactttaaagtagttttttccaattctgtgaagaaagtcattggtagattgatggggatggcattgaatctataaattaccttgggcagtatggctgttttcacgatattgattcttcctaccgatgagcatggaatgttcttccatttgtttgtatcctcttttatttctttgagcagtggtttgtagttctccttgaagaggtccttcacatcccttgtaagttggattcctaagtattttattgtctttgaagcaattgtgaatgggagttcactcatgatttggctctctgttattggtgtataagaatgcttgtgatttttgtagattgattttgtgtcctgagactttgctgaagttgcttatcagcttaaggagattttgagctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccaatttttgcccattcagtatgatattggctgtgggtttgtcatagatagctgttactattttgagatacatcccatcaatacctaatttattgagagtttttagcatgaagcattattgaattttgtcaaaggccttttctgcatctattgagataatcatgtagtttttgtctttggttctgtctttatatgctggattacatttattgatttgcatatattgaaccagccttgcatcccagggatgaagcccacttgatcatggtggataagctttttgatgtgctgctgaattctgtttgccagtattttattgaggatttttgcatcaatgttcatcaaggatattgatctaaaattctctttttttggttgtgtctctgcccggctttggtatcaggatgatgctggccttataaaatgagttagggaggattccctctttttctattgattggaatagtttcagaaggaatggtaccagttcttccttgtacctctggtagaattcagctgtgaatccatctggtcctggactctttttggttggtaagctattgattattgccacaatttcagattctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcatttttattgcatctatttgattcttctctctttttttctttattagtctttctagcagtctatcaattttgttgatcctttcaaaaaaccagctcctggattcattaatttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgctgtgtctttgttctcattggtttcaaacaacatctttatttctgccttcatttcgttatgtacccagtagtcattcaggagcaggttgttcagtttccatgtagttgagcagttttgagtgagtttcttaatcctgagtagtagtttgattgcactgtggtctgagagacagtttgttataatttctgttcttttacatttgctgaggagagctttacttccaactatgtggtcaattttggaataggtgtggtgtggtgctgaaaaaaaagtatattctgttgatttggggtggagagttctgtagatgtctattaggtccgcttggtgcagagctgagttcaattcctgggtatccttgttaactttctgtctcgttgatctgtctaatgttgacagtggagtgttaaagtctcccattattattgtgtgggagtctaagtctctttgtaggtcactcaggacttgctttatgaatctgggtgctcctgtattgggtgcatatatatttaggatagttagctcttcttgttgaattgatctctttaccattatgtaatggccttctttgtctcttttgatctttgttggtttaaagtctgttttatctgagactaggattgcaacccctgcctttttttgttttccatttgcttggtagatcttcctccatccttttattttgagcctgtgtgtgtctctgcatgtgagatgggtttcctgaatacagcacactgatgggtcttgactctttatccaatttgccagtctgtgtctttcaattggagcatttagtccatttacatttaaagttaatattgttatgtgtgaaaatgatcctgtcattatgatgttagctggttattttgctcattagttgatgcagtttcttcctagtctcggtggtgtttacattttggcatgaaccactttgcaccttaggagtaaagcctacttgatcattaacatgctttttaaaaactacatgtatacactaataagtgtttggagaatgtatgagtaataccagtacatgaaactagattttgataaacaggtattaaagtttaaatcttaagtcaagctttgcgttagatttgttaccgtttaaaggaaataagtatggagtgcatttttacagcagagccttaatgtggggttttttcctctcaatattctcttgacttcaaagtataattatcattattacatttctctttataccatgagaccattaaaacttataaaaatttttcagttttctgccttcattactttctggaattaacaaatgataatgtgaattacttttactctttcttgattttggggatgcctactggaagtagtagcataatctgcaaaactttgggaagagtaaaaaatttaggcttaaaaaaaatttaggctttgtaaagcctgtaataatacagaaaataaaatgtccactttgtgtggaatttatgtaagtagttacctattagaataatgcattaatagatcacatctatttaattgaaatgtgacctcacatgactgccttgactgtatttgagatgaccgacttgaaatacccttagaatttagttcttccctttttccatttaaatgacaagcaaaaatggctgggcacagtggctcagcctgtaatcccagcatctggggagaccgaggtgggcagatcacctgaggtcaggagtttgagaccagcctgaccaacatggtgaaacctgtctctagtaaaaatacaaaaaaattagccaggcgtggtggcgcatgcctgtaatcccagctacttgggaggctaagacaggagaattgcttgaacctaggatttggaggttgcagtgagctgagatcatgctactgcactccagcctgggcaacagagcaagactgcatctcaaaaaaaaaaaacaaaaaatgtgtgagattgatcaggttaaacaccactagctttaagagaaaggcagttcattaacattcatacaacacagatttaagcacctatcagttacaggatataaattctccaaacaaggaaaaggttgctcccctgaagaagctcaccgtccaggacccctgaagaagctcaccgtctaggaggggatgtggagaagtaaacacattatcataattaccgtggaaggggctgtggttgaagtaaactcttggcactattagggaagctcccctgaggaaagtctgagagtgtgagtggcaattaaatgatggtaggggagggcagcctggcaaaggatcttctcgttagaataaacaacatgcccaggtcctttaaaaagaggggagatgagacaggcccagagtcgtggggaggtaggtgggcgggcaaaaaggagggaggaaagtaccaaaggagggacgaatgccagatgccttgcaggttcctggtcctgaaggagttataatttatgataatgagtttggactttattctgagtgtaccattaaagaattttatgcaggcacataaactttaagatttatatatttaaatcttaagtcaagctttgggttagatttgttaccatttaaaggaaataagtatggagtgcataatcagaatggctctagaaagctcattctgatttaagaatacaatagagaaaataattgtattctttaatgtaaaatgttataaaaatcacttttctttctcagagagtgctttgcccagttttccaaatccagggttcttgaagtctttgttgagacaggatcaaacagggaaggcatagcaaaagtccccctgtctggctccctcaacttggggaacttaacagtgatttttggaagttttgaggcacttggagtataagcggaactcatacagccatacagtgcgagttcatcactttcagagaaacaaaacaggtaaatgaagtgctcatttaaaaaaaaaaaatcagacaaacaattttttattttctggtgtgaatgtctgaagcacgtcagggccttcattttaaaagagcaccccgctctttgctgctctgtttcttagggttgtgtgaaatcgtggtgctacattaagactagctttacgttttgccttgacatcagtgtttgcacaggaagtttttatgcagtttgcaaggctattttctttctttttcttttagagacggtttctcactatgttgcccaggatggtctcaaactcctgggctcaagtgatcctcctgcctcggcctcccacagtgttgggattacaggcgtagccactgtgcgtggcctgcaatgctgttttgtttggcatacttggggacgattccttataattaaaattgtctcattttttttgaagggctttagcttttaagagtttagaagtgtcctcctctgtaagagagcaaagcaaagggagggtatgaatcatatgctgcacgctcttctagatggcatatattttctagttagcgtgttttcatttttttcttttaaaaaccattaaaataagttacagtgatgaggttacagtatacagcagtatattagaaaaatattagaccaagaatccaaaaagccagaattcatttctggtaatactattaacaaccactccctcccattaaatgacattgggcaaatccgttgacttttcttcacataaattttcttattttaaaatgtaaaattagatcatctctaatcgtactccaaattagggagcagatcacatgatcaagagattgatattaacaaccctcctaaggattaaagcacagatagaaatttccccagtagtcagtgctcttcactaaattatgctgcactctttgttcaaaccaagtctagcaaaagccaagttgtaactaactgccttggacttaaacattcaggctcacatgagttctctatttattctcagaatttaagagtcaccaaaattggtttatttttgcctttgctttagtattcttatgtcttattatctattttcacacttttcttcagcaatcagtaaaacattggcctattatatacaggcagtaaaggaggagaaaaggctaagacaggcctccttacaccttggactttttttctcgtttctttccgcttaagtaatatagggctattctttgggcatgattttcatttctgtctggaacattaatgtcaaattgagtttggaagcatagagaaatccagctaacaaaatgcctaagtaacatagtacaatttagtgcaacatttccacattttagcttctgccctaaaattaaccttaagctttgcacagagtagaaaatacacgtaaattttataaatgtatttttaaaaatttcaatatgattatatcatatttttctaatacgaaaaccaaggaataccctagaaaaggagtacccttttagtacccaccccagaaaaaaaggtaatgaagatgaagaagaactcgagtgaaaggcttactgatttcatgcatctgcttttggctcatacgagtctccttggaacatgtgacatctttaaaaattacttaatccacattgtcttcatcattacaatcacttacattttatatatgttttcactgtaaccaacaagaaattactggtcacgaaggtaaacccttcagagaaatgtaacgattttacatctctgatgttggaagcacttaaaatttagttgagagaacttactgtatacaaaagcaacgcaatacaaatactcttctaagagtaactatagtaaagattgtaggtttgaaataaggatatgggactaagaacatgaaccctctctctagattcacagaatttaaattctagctctaccagtcatcatctgtgtgactctgggcaagttacttaagttctataagcccccaaccagcttggtaataaaattattaaaatttcttttaaattgtaccttccttacatggttgttgggaggttttagagtgtctagtacctaagaactcctcaataaatgttcatgattaagtgtaatggcatttctctgggcagtcttagagaatgtattctaacttgagctttgtgtagaaattaaagtcactgattgataaagcagtgatggatattgatagtgaaagaatgtagaaaagggctgaaattttaaagatgtacatgagaaatagagaacagaatggtctagccagagcagagcacaattcaagagaagaatgtgttgtaaacacatccgtattcttatggcatttccatattctccatgacttccccaaataagtcatatgtattctgtgttcttgtctgtaaaatcattgctatcttgaaatgtaattcattgaatagaagtagctggattgaattgaagtagctggatactatgttgtacttgttgaactcagaataaaaatatacagatgaatccttagcattttatttgggaagcaagaattgcaatttgagatacacagaccaagtggtctttgttatgtctgaataacaaagaggaggttgggagttttattagaaagagaaatcttaagtattgttttgaaagaaagctcactggcactagagaatttctttggagctggcaagatctgattggtgaatgatggtggtaggtaaaaccagttttagagtcatggcaagtcatttcagcagctgctaggtaaaaccggtcttagggttgcagcaggttgtttcagcaccagggtttgtggaaatgttaattcttggatcagttgctctgtgcggtgagtgctttttcccccagccctcaaccctaatttagttggctacaacaagaatgacccaatttgtataatcaactttcacacacctttctcacataatgggcctttaatggctgttgtctgtcttctgtccttttcagtttgaaaatcattctcctagctagagaagactaaagcaagataggagctgagtttctctctcttttttttttaatctattatgattagtttttcttcccaaacaggtttgttcttgccttgtttcttttcctctaggaataggttttaaaagaccctccatgtaatttttcataggccgtgatcattctggattatagtcatcacaccagcattcacacaggctcgggtaactttctcattgaccttgactccctgctccttccgtttcagtccttcccattttaaaagctctttttgttgtcatatagggaaatcattagcattttgagaccaaatgcagatgcttaaaggggatggactacataactctgaaaatttgtacctaaagatccaggatacggtgtcattactaagggctttggaggtggaaaatggcattggtttagaggagaaacaatcagtttcagcttcagaaggataattggagataacctgtcaggcagttggaaggtggaactagagaaaaagtgagaaaccataactcggtaagatttagcagtcatgtgaccttgattatttaaccacaaacttagataagatactggggtagcaaagctgagaaatgcaaagagtgaccactgggagataactatggtgaaaaaaatcaggagggagctggagagctaatgaaaacggatctttcagacaaggaggagtgcatctcacatactaggtcaagagcagcaaaccaaaagaagttctaagagcattttgtaattaaacctggtatcactggtgtgtcagctctctgtggcattcacgtagatgtccccccaagccacatctgtaaattcagagtagtatcaactatagacataagtgtaggaatgagcacatttcttcctttctctacttggtttccttagtttgtgactgtgtggcacagagtgctgcaagatctccagccgcaatggagagttcaaaactgaactccaagcagctccaacatagtatccagctaaatttcctaagattctctatatccctaaaggtctggaaaggtaagacagtgtggtatagaacaggagtgccacaccagcaagtggcaggctagaggaagtctcaactctgcctccggttaaagtgtaacctgaacaaatcacttaaccccttctttctttggatgaatctcattcataaaatgaagaaactagatttgtaagggcctttcactccaaaataatcatattattttaatactaagacttaccttctgcctcttattttttttgaagggtagcacactatttgggggagtttaaaaagttgtcatcgtagccgggcgcggtggcttacgcctgtaatcccagcactttgggaggccaaggcgggtggatcacaaggtcaggagatcgagaccatcctggctaacacggtgaaaccccacctctactaaaaatacaaaaaattagccaggcgtggtggcgggcacctgtagtcccagctacttgggaggctgaggcaggagaatggcatgagcctgggaggcagagcttgcggtgagccaagattgtgccattgcactctagcctgggcgactgagagagactccgtctcaaaaaaaaaaaaaaaagttgtcatcttcctttgctttagaaaagggtcctgcgggtatgggccctggattagggaattttaggggtagggagtggatcttgcccaaaattttagtatttaccttttaaactcaggctgcctcatttctgaataaactcaatgtattgtgtaacttagaaaattggttaggaaattttattttttataacttctacagaattatattttaagaaacttagatttcgataggtaaggtgctagatatcagcacttaaccagcaaattctgattctgccacctaatagatgtaaactcaactttgtaaattccaagaaaaaagaaaatttagtgccactaataatggagtagcttaaatcactggttcaaatgatattgcagctctggcatccaggcttctaatgggaaggatgccctttcataggcttttcagcagtgcttttatgtggcagacattaagtgaaaggaagatgatggtaactgaatttatgctttcagaaatatacttaattaaactgaagctaggcaatcagtagaaccagaatctaaacatgtaattcttgcaagatgaagccattgggcaaccagtgagtatccagaggaaagaaatgctggtcttgttttggttttagattagtaaatatagtagtggcaacttgcttctctagaagagtcttgttcaggaggtgcaggaatagattaaggttttaaaaacatctctaccaaattagaaaagtaatattacaaggacgtaggccttcgggctttcatatgagacaccagatttcaaagaaaagaaagatgtaattgagatctgactagggtattctacaaattttttatttgatccagttttctaagacatgttagaagaaaaactaacatggcacatattttccctctgttcccccaaatgaagataacaactaaccaggctggttatcgcactaaaatcctgccatcttttatacctccttgctgcttacattgttgcatgtaaattcctcttttccattgtgctgagcatgagcatgaattttatgtaacaagactgaaatattctccacaacaaacttttgttcatgcttttagatgtaacatttttgcacagggctctgttgcttttttttttttttttttttacagaatccattttccaattaataaataacattatattaagagagtcttctttttaccaattaggtcaaagtcctaaaattttaagactcaaaccccatggtttagagcgaactgattcacaaaccataggtgactttgctacaagaagaaagggtatgtactttagcaccgcatgctgtatggggcattgggaatttattttgtaatgttttttgttttttttctaaaaataaagaagaaccttaaatactactgctgttgtaaataaaactttcctgcacattatttctaaagtgaatgcttcccataatacacaatgagtctacttactctgccattaacaacagcatgttaaatatttgataatatgtgatattcagacttgtccttttgcattattcttttaactttgtagacaacattttatcctttcagtttgtgaactgtttgtgattttctgttgtcttctgtctttatgtatatgtgttctgttctgagacagaataaagaatcatttccatggattaattgtgccattatttaaaaactgacagctaaactgctattagcctttgggtgtcaaaaagtaaaacattaacagttaaagaaatactttcactcagcggaatattctgtatgtttctattttaagaatatagacaagcaaaatggtttcagctcaaattagtaagttaatttggtcttcattatatgtgagttgacaaaatacttatgagcctcaatgcgtatggtcctttaaaatgaccattcattttatagtgtaatggtaactatgccataacatacatggacaaagactataaataaatctcaaagatgaaattttttgttaagagtggcagaatgaaacataactgaaatatttacctaacatgtttaggtagtctcctaaaatatctagtattaaatagtattgtttcagttcttttgctcactctgtaaatttctgaaaaaatctcagtcttgactttaagaaaatggctaagaactctgtggtatatattggtttaattgtctactgcaatatgaggtaaataaagatcacttataaatgaaaattattattagcatttacttaattgtatataatttagcaagagatttgttgcttaaattacactaacaatttgaagtaaaataattatggccttttttcagagcggagtttggatctaaagatacaaatattgtttcgttttgtttgtttccagactgtgcatgaattattttaaaagattcgaacattttttcagtttggggttttaacaaagttgtgtttttaatagtttctatgcatcattttatatatatagttatatactccaatattgaagaaaaggaatgattttacatagatgattaaattttcttattgagtatgaaattggtgaaataatttatgaaataatgaaacatataaagcaaccatagaggaactgggtcacattactctttatctcatttagtttatattcataaaatatgcacttaggcaacatgttgtaatagaggtttaggctttgaggtaacaatcatgaaacatctgatttagcttttaccactaattacttagctatgtaaccttgggcaaatcatgtaacattcatggacctcatttcacatgtgaaactaggtggtcttaggtttactctggctatcaaatataaatagagttacagagagagaatcttgtttgttttccaaagttctgtatactaaaaatctctttttctctttttcttttcagtcaagccagcgcctttagaaataaaacctttgccagaatgggaagaattacaagccccagttagatctcccatcactaggagttttgctcgagagtaagtcctttgtctaaaatatgtagtttgtatgaataatgtgactatctagaattgttcattatcatggaaaatatctggaatagtggttctcaatggatgatctgaagagccccctttttgggggttctgtgaagtcaaaaccattttcattaatatattaagatgttattttctgtattttttctccttctgagtgtacagtggagttttccagaggctacatgataagtgatgagatcattgtgacacccaatagaaatgtgtatttgtgtattacttacgttttaaaaatatgtctattttcatctctaatatggcaaaattaatagatacaactcatgtaaacaaaaatttcttgggattctcaataatttttaagagtgtaaaaggtttatgaaaccaaaaagtactgaggactactaatcttgaaaatatggtagtctcttgtggagattatttaaccgagacttatttaaatgtatatagggaattgagaggaatttatgaagttacaaacctatgttgaacatatgttcatgtttcgtgtgtgtgtgtgtgtgtatatagtttttaaaaaaatagaaattcttaagtcttccattttatatctgtaactttctacttatcaccaagtcactggcagtggtttttttgttttacacaaaatattttgctgtccaaaatacacttttataatacaattataaatattagttatgtgtttgtacacaaaaattacatcattataaatgtgtacaatgaatgattataaacataagggaatatttctgaaagaatgcagactgtctctcatttttatttggggaataattttagatatttttgtcaaggcttatgtttgtgatgataatttctgtaattagctcttccaggtttcccatgtccccccgaccagattcagtgcatagcacaacttcaagcagtgactcacacgacagtgaagagaattatgttcccatgaacccaaacctgtccagtgaagacccagtatgtaaagttttaacttttccctttctgagcagcccttttcagtcattcaagctagaactgttctgtctataaattttatcctcgtatctttatatacttaagaaaaagcagtaaaagacaacttttaaaaagcttattaaaaataatgtcataaactctaaaaccaataaaaggtgaaagtaaactgtaaatgagttaaaaaaaaaaagttgcctggcacagcagcacaaccctgtagtttcagctatttgggaggctgaggtgggaggatcacttgagtccttgagtccagcagtttgaggctagcctgcacaacatgtcaccctgtctctaattagaaaaaaattaagttttcagttatatgtcatttaagagatacttgattttttatactcttcaagaaaatatacgggcagcattttatgatgcaattctctaaggccatgtcacagcactctaatggtgaaatggtcttataagtaagtaatatacctttagataggtgtaaagattaaagaagacctcttataaacataacatgtttgaggttggctatactaccataaagcatgagaattttctaatggtagtgagcattttgttcctcataaatcaggtagttgccagaaaatacttcaaatgtttaagaatacaaaccaattttaatttttaaaaatattttgctttagcttttccttaagtcagatttaatgtttgctttgttatttgtattttagttgataagtatatccattaggattaagttcccctctgagtaaaagaaaataaatatttgtgactcaagagagaagtttctttctttctcatggaaaagtctagagagagtcaatccaaggctgttgtggcagctctgttccatagagtcttcagggattcagaccttttccagctctccagtctgctttccttgggtgtggcacatatgctcattggacaagatgatgctccagccagcagagtgacattccaactccaggtggaggaaagagagaaaaagaagggtacagcccaactgcctcataaggacagtacctcgaaactgctttatagaaaccattaaccagaacttagcctgtgtggccacacttagacacaaaggagctagaaaacatagacttagatccgaggaacagtgggcccacctaaaaatcccatgcatatgggagaggggagagcaggtattgagggacaatcagaccatatcttccaggataagcaaatacctgatgtcaaaatttagaatgagtaacactttagtggccctatattatttaaaacagccctatttagaggtataaaatataaagcccaattctgtcaatgaattggtttttcatccttaatagactttaggcagaaccagctttcttaaaactatatattgtcaggaaacataattcagtgatatgaaaaacttgattttgtgcttaaattaattaactttaaaatattaccaaatttagccaggcacagtggcatgtgcctgtagtcccagctactcaggaggctgaagcaggaggatctcttgagcctagttcacacctagcctgggcaacatagcgagacctcatctataaaaatttttaaatatcaaatttataaagtattcaaaaataatataatcaatatatcaataatgttttcactgatttttcaaggcagggcaatttttagacacttttgcttttgtattcactatttttcaatttgagtggagttctattattattatttaagttaattagttttcctcagtatagtaagttgactctagtaaaactctaaatcctaaattctcggtcagagtagatattgtcacctattttcaactttgggtagttgagtgaactgttttcttatcgtaaagtaattagagtattttctgaggtactaaagagtgtgtctttttgcccaaaatagtaaatagccataaaaattttggaaagtcccatataataggaaagtttaaaaatgtgatttgtcatgggtgttagatgaagggaaaagatgaaaaagaagagcattacaatcagaaatcaaaggaaatcaaaatacaatttttttttttacacctaatgacagtaagccagaaaggtgcttttacttgccaccaatagaggtgtctaaataaacacaatgtggtgaatttctttttttttttatttggagacagattctctttctgtcacctaggctggaatgcagtagcgcgatctcaactcactgcagcctccacctcctgggtttcaaatgattctcctgactcagcctctcgagtagctgggattacaggtttgcgccaccacacacgactaatttttgtgtttttggtagagacagggtttcatcatgttgcgcaggatggtctcaaactcccgacctcaaatgatctgcctgccttggcttcccagagtgctgggattacaggcgtgagccactgcacctggcctgtgatgaatttatgaagtacttaggtcctatgtattagaaaaaagcaaaaatgacccaggaggacatacctatctaccaagtacaatagaaaagtcaacaatgccaattccatatcctcatgctgccaaatacaaggactcatcatagtccattcaactctcccttagaaaagaatatgagaattatagcaatatttaacaaacttctttaattttggatcaaaaatcatgcattatcaagtgaattctgaatgtgacacctgaaattcaaatgatggtaaaccataactaaaggcatacatactgttatgtgataataacaacaaaaatatgttaaatgattttacataatttttaaagaattttttaaaaatctaggccgggcatagtggctcacacctgtaatcccagcactttaaggaggccgaggcaggcagatcacctgaggtcagtagtgcgagaccagcctggccaacatggataaaccccgtctctattaaaaatacaaaaattagccgggcgtggtggcaggcgcctgtaatcccagttactcgggaggctgaggcaggagaattgcttgagcccaggagacagagattgcagtgagccgagatcaagccactgccctgcagcccaggcaacaaagcaagactccatctcaaaaaaaaaaaaaaaaaaaatctcacactactggtttgttatttaattcaaagaacacttataataccttatagaatcttagagtttctctaaactgttttgggaaaatactgggtgaaaggctagaatacagacaggctgttccagtggagattaaatcaagagcaaatagacttccttgtagacacacaaatgttaaccatacttaaagatggaaaaacattcagttctagtaataacagacataaaataggttaactagccaccctgagaaattctgtttaggagcaacttattggtattatgcatgcaggtcttacaaatttatgcatttcttttatagccttgtaatactgtgaacaattctagatatttctaatcagagaaatggagggtatgggtctttcattgatcacatttgaatatagaacttttcacacactcatggctgattttatgtgacaatgatatatagagtcattcagataaaaaatttcatgatgattccagtttctccatgaattagaaagaagagagggattgctatttatattgaggaccaaaacttgcttatattttttgtgctctacatgttatttttgattttttgattttttaattttttcagacagagtttccctctgttgcccaggctggagtgcagtggtgcgatcttggctcactgcaacctccgcctccgggttcaagcgattatcctgcctcagcctcccaagtagctgggattacaggtgcccaccaccacacctggctagtttttgtagtttttagtagagacggggtttcaccatgttggccaggctggtctcaaactcctgacctcaggtggtccgcccgcctcagcctcccaaagtgctgggattacaggcctgagccaccgcgcctagccattttatatatttttttaatgttttatttgtagtaattgataaatttggtttaaaaaatctgtttcttcaagtaggaatattacatttagttgtacaggttgtttactgaataaacatactgcatacctgattatatgaaattcaggctatgtgctgctcaccaagctgcagtcgcccacagcacagagctgtctcaccccagtgcaagaagcaccttttaataatttgcaaaaaggttccataccagctattagcagccctgctacgaaatgagagaatagtctcaatattttcctagaagtatcctttccctaaggcacagttttttctgtttaacctaagcaaaaagaaatgaagtagcaatataaaaagaatcaacagaaccaccagatgtatgcagttttcaaattgttttattcatcataacatgtataaatttttaactttgttaaatcattatgattttctttaaaagtatgagataatatatgaacattaatatcaacagtgcacaaggatgaaattccctaatgagaaatacacagtcttgcgtatgagaagccaagaacatttctagatggggttaaaaggagtaaggcatggaaacaagtcacttgtttgagcacatgtataatagaaccctgttgtaattagagtggagggaatatatagggacttaggttcatgccagcttttcctttctatttagcattgatcttcaagtgcctatttttcatttttctgcctcaagttttttgttcctgctgtttatcgctgtcatctatcttcctaccttctttccctttttttagagagtagtcctactgtacaaatcatctgaaatggttatttacaaattccagagttgtcttcactctgctctctttaaaatcttagcactatttttgtccaaaattttaattctttttaaacccagaagttagtagtattattgctcttattatataaactatgcttatttacgtttttctgcatgtttagcagcttctttatcatttcttgtatttcaggccttccttaggtagtaattttccttctctcttaaatacgttctttagaatgtatgcctttcaggaaggaaaagatcaggctaaggaaattaggtggtaaaaaatccagatgattgaaacaaaatacacttagccaatggagtcaaacaaattttagtgtgaaagcctttagataaaacgtagaaagtttttttaaaatttaacttgaaagcaaggaatataaagatcctgtaaagcataattgagtacagacataattttaataatgttcaagttgggctatcatagctaagtatctcctgatgtctcaatcttagtgtgaaccaagtttaacttttgaaactacgtttagcttgctctaagctaggctttaatcagttttttaaatattacttattttctttctatcctaaaaggttgtttaactttttaagctatgtcctcttgaaagcaaatatttaggcttccgtagatgttcaacagtacgagtggtatgtctggtgaatgtctgaccgttgattttgttgtctaatactttcagaatctctttggcagtaacagtcttgatggaggaagcagccctatgatcaagcccaaaggagacaaacaggtggaatacttagatctcgacttagattctgggaaatccacaccaccacgtaaggtgagtgacatgtgacatgtctcttctttgtatacagttagttcacacttcaaacctgaagaattatttcctttgggataattttattaagttatgtttaatataaatttagtctggtctgctacttgatgctatctcataaaacaaaaataacatagttatggagactgattattttttcctttctgatggttagaaattttatactttctacttttttagtggttaccattgaaatagttatttaacaaattctttttttttttttttttttttttttttgagacagagtcttgctctgttgcccaggctggagtgcagtagtgtgatcttggctcactgcaacctccgcttcccaggtccaaatgattctcctgcctcagcctcccaaatagctgggattacagatgcgcgccaccactcctggctaatttttgtatttttagtagagacacggtttcaccatgttggccagaatggtcttgaactcctgacctcaagtgatccacccacctcagccctccaaaagtgctgggattacaggcaggagccactgcatctggctgttatttaatgaattctaaagttaaccagtctagtgtctttactctccttaaaatgctcaaattctgtgctatctttgtccaaaattttaatgttgtctttttgttaagcccactaattagacagtattattactgctcttattatataacaatgtttatttacattttcctacatgttgaccagcttctttgtcattccttcctatttctcagaccttccttctgcaataattttccctccacctgaaatataccctttagaagtgcctttagtggaggtcattggtagtaatttttttcagtttttgtataacttaaatgtctttattttgccttcactcttggaaacacagttttcttgagtttacagttcttgatcaacaataattttctctcagcccatggaagatactatcccactactgtcttgcttctattcctatggaaaaattgctgtcagtctaattgtaattcccttgtagataatgtcttttctgactggatgagtttaaggtcatttctgtatctttggtattctacaggttcactacaatacgtctagacatagattcctttttatttatcttgcttagaagtgctgccttctttttggattcatattttttatcaattctgggaaagtctcagtcactattcaaatattgcttttccatttctaaaatgaaattctgtttgggtctttatcaaatatgtctggccaatttactggctcctttttcaatatctgaagtccttggaggtctgaatctgtgtatattgtttctcctatctcacactctctacagtttgtttctttgtgtgttttatatatttttattgcaacctcattttgttgaacatatcttctgaggacctaaatttcttctataaactatttgtatttgcttctgctaggaaccaggaggtgctaccatcctaggaccacatcagttcccttcaggggtccctagcttgatgagatattctcagtttcagcatcacctccaatgcagggcctcctgattgcatttttgagattgacattcatcctaaagccaacaccacgtttaccatttagaagctcaccactccctctacttctcttataccttagacatttcactttctagtgagcgcagcagtgcattgataattttatttaaatatctatatcttgttgaattttaggaatgaaaaggcatcagcttatgtagtttgtcattcttgaagtataacttttccaaaaacatttcttgttagctctcaaagtaaacattgattcatgttctcagaggttgagagacagtcaagcttaagttgacaggagaatcaggttgtctatgttaagatgaaacaggcatctgctgtccctattttttatgaatttcatctgtcatggaagcattagttnnnnnnnnnnnnnnnnnnnnnnnnn

SEQ ID NO: 16294 - DNA, 43981 bp, Human
  misc_feature (1)...(43981): n = A,T,C or G
caaaggatacaaagttttggttatacaagatgaataatttctggagatgtaatgcacagcatggtaactattgttaataatactgtttgcatagttgaaatttgttgagagtaaatcttaaatgttctcaccatgctggcaggcagtaaatataagaggtgatgtatatgcttattagcttgattgcggtaatcatttcacaacgtgtttatatatcaaaacatcacattgtatgccttaaatatatacaattttgtgaattatacctcagtaaagctgaaatttttttaaaaaaagttttcttaatacaataataggcaaattcggcagcctggcacagtggctgtcacctgtaatcccatcactttaagagactgaggcaggtagatggcttgagccctaattgttgttcaggaccagtatgggcaacatggcgatccctgtctacacccaaaaaatacaaaaattagctgggcttggtggcatgcacctgtagtcccagctacttgggaggctgaggtgggagaattgctggaccccaggaggctgaggctgcagtgagtcacgactgtgacactgcactgcagcctaggagacagggcaagccactgtcaaaaaacaaacaaacaaacaaacaaaaacaaaaaaccagcaacgatcagtttcaatacttttgtaaatatgcttccaacttttatctacatttttgaactgttaaaccaaatttttcagttaacactttataaattaacattctttggctaggtgcggtggctcacgcctgtaaccccagcactttaggaggcctaggcgagcagatcacttgagaccaggagtttgagactagcctggccaaaacagcaaaaccctgtctctactgaaaatacaaaaattagccaggcgtggtggtgcacgcctgtaattccagctactccggaggctaagtcatgagaatcctttgaacctgggagttggagattgcagtgagctgagatcatgccaccgcactgcagcctgggcgacagaaactgtctgaaaacaaaacaacacaaaacaaccattattctacattaatggttgttaaaggttaatagttcattttctgggtgtatgacagttttaaacacctaacttttaatactggattcagcctactgttgttagctttttgcagtcatatatgaagactatgatgaacatcattgtaggtattcatctttgcatatatccttagacatttccttatagtctaagaactagcatttctagtggagtggggacatttttccagatgtccatttaagaattatcattccattagttaaaaaatttgcaggctatatattcaaaggggatcccttctgtttggaattcaacataaccagttagctcaaacctcaactctcgaaaaatgtgtctcctttactcaacaaacatttagagaatactgaatatgaggaataaaaaaagataaaaaagaccctgtactgggcaggtaatctactgtagtatgcagattcgttatcaaacagactacaatgtatttaaattttgtaggcgatgaatgcacaaggcccttaagctgcattgaaggctgcctaaggcagtatacaaaatcagtgctgaatatttgttaacacttaaggagaatgtacgttttaattttcatgtttgatgcttggggaaaagattacatcgcaccacctatcttccccatatattgattattcgtgtttctcacttccatggtagtgtgcacgttatttgcttaactttggcatataaattcagaagaaatatcatttaactctgtgcctaaggagggtatttagaaataaccgacgcagctaacatgagaaggcaaaaaaaaaaaaaaaaaaaaagaaaaaagaaaaaaatcacactaacggactttttttttttttctaacaacaaaaaaccgtgagacttcacttggggtaaccataacgtcgtcaaggctgtggcgtcacgcctctaagcggatacggcagaagttttggggccagacacaagacttccaagtttgaatgggcagcgcaaaacccagacaagttttccggtagtgccgccaacccctgtcaggcacagaagacacagcgagaaccgtgagccgttacgaaagcctaaaacactgagctcgcgtcctgccaagcagcaggcgcacaaacctacacctccgagcgctccctggaggtcccgcccactcttctctcccgagccggctagagatctggaagagggcgggccaagggtgaggagggcagtatgcgcatgcgcgctcaggacccagtcagtgagccaataaggaatctcgcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttgggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgccggactcgggcctctggcagcagcgggtgacgcagacggaacatcatgtcgtccgcggccgagcctccgccacccccgcctcccgagagcgcgccttccaagcccgcagcctcgatcgccagcggcgggagcaacagcagcaacaaaggcggccccgaaggcgtcgcggcgcaggcggttgcgtctgcggccagcgctggtcccgcagacgccgagatggaggtgagggcgacttgcggcatggggagcgggtgcagcggggaggaggagctggctccctcgccggatcgtggcgatcggacgcagagccgggtttctctctctgcaccagactcagcttcacaccctgtggatacgaaatgatgctctcactcttgctcccttgttcttaccctattcgagctaagcaaaatggatttctggctcctcacatttaaattatttgtctctttcgtgaatcctgacaaatatttgaacgctctcagtgaacagatgttcttggttaccgtggcccgggggacccatcgtttttttcccactagactcccataattccctctcctacctctgaatgtggtttttagtttccaccaaacttcggggaagggcgaggagatgaccccttaggagcgggatgcacgggcggggtgaaggaggcatttaaaagcagcgcgtccgaggacttgggcctccttttcttcttcccggtccttgcaggggcggtatctgttgtgggcagaaacaatggcgagagctggatggccgagtgcgcagtggggataagcggggcgcagctgcttctgtgaagggagagaaggcccctcccaggcactattccactggaagggaagcaaccaaggcagcagcagctgtctcggatcccccgtctaatttaggggggatgaataagtgtaggaatgaattagagaaccaggcgcagttggttggctctcagtccggcacttttctctttttggcctctggccttaagaaaaaaaaaaattagtaccactcgctgccgagacttatgggtttgggttgggcaggggatgctgacagtactgagggggctggaaagatgggggaagctgccaggcgggtaaattggatatgcttccaggctttgcatctgggaacaaagtaattgctccttccaatttttattttcttggccttcgacctgttttgagatattttgtgagtcggagcccaaagatttctgggattttcctatccttagacagaatgaaagtaatactgctccgaagatgagtcttgatgcagaatcattatacagtaagaaaatggtagcgtaatttaccattgaggcttttggcacagtagttatatttgggtagctggggttaagtaacattaatgttagtaatcatttaaagaacttttagtggtgagggtaggtttagtgacataggaactcctgatagttcctgtagttttgagtgattaagataagattacttccaaattaaaatatattcagtgttgcttttttttccttaaggaaatggttcttttgggttactagggctctttaacttggatttctgttccaaggcttaaggggtttgacacaaagcaattatgtgtaaatgtgcagttctctacaaaaattgtttatagtttttcctcagcttctcaaaggggtctgccatccaaactttggaaaaatgaatgtttcaccagaggtcttattaatatctgaatgcagagtaattttaagcctaaagcaagtcaacatttttgacttgaagttgctattttaaatgaaaattgattttaagttcaaacgtgagtatagatgttatcactaccgtattaaattagtgatattttcatttgccagatggggaaattgagttctactaggtagaacctgtaataaaactcggatctgcctttaaaagtgagccgtttcccacccatcttgctctgccatgttcttaccaaaaaaaacatatttggcggttcaatttattgaataacattgttatttttaccttcctagtatagaaatattaggaattttatttttttatccatcttatcactgacacattttttttttggttgacattatagtgtgatttttttttttgtcttttaaaatgtcagtttcctgtttaacaaaattcagaattactgcaattcatgatataaactaagtttgagcacacatgcttaatatatatgtcacaacttaatctgttttgcacttggaaaatgaatattttataaatgactttttcttgtttggaagtatgatctaaggtgtttttctaaacagagtaaacccagcattcatgaattttttttttttttttttttggtgacaaagctgattttcccagaaatagccttcctatgtattcagttactttttttctttttgcttgatactaataggtcaatggagcacttgttttttagttatccttttggcagtgtggaactcttctgtgttcatcctcatctctattgactagattgattaaatagtcacctgtataccaataatgtgatgtcaagatgcctgaagcacattttatttttgtaggttgcatttcatggcattttggaattttgtaaactggactgggtaggtggctttgtcacttacatatgtagaccagagatttatgatgaacatagggtcacacaagtgccaagggtcttaacaatgaagttagacttgacttaaggtcattttaccttctattccagtaccgtaccagatctcctccccacaactttttggtcacagatagttttattatagcatatattgcctagcatagatttgtgcatcattaatgaagattacttctgccaattttttttaatggatgaatagaactttgcagtgtagaagttgttttttgttgcttgtgacatatgaatgtcaggataaatatatttgcaagaataacatttattactagtttaggaatcagactgtagttagagtattcaatttaggctgcgagataaagtttttgtaatattccagaaggtggaaatcagggtgactaattctgatttctttgtagacatttgtgtggtagcacagtagatactgtagttttatgacaaaaggggaacttttccccacattttatactatttagtttggtttcatggttattacagaaaaagagaaacagattggcttgtattaaatgtagttttcttttaggatgatgaagataatcttgtgttctaatcttggcaacaaccatacagtttatatatatgggttaaatacgttgttatccccatagtatctaatatcattttatcagtttttctgttagcttagatgacagctgtttaagtttctaggaagtttggggtgagaatgtattatttaagatgtgttttggtcagaaattggtctataatggtatgtttactattttcgaagaccaattctatttaattatttctttctaccaggaaatatttgatgatgcgtcacctggaaagcaaaaggaaatccaagaaccagatcctacctatgaagaaaaaatggtatgttctaggcttgtgaatagagtctataaggaaaactttttatcaggtgattaaatgtactaaacatctatcttagtccattttgtgttacaacaataccacagactgggtaatttataaagaaacgaaatttatttcttagagttctggaggctggcaagtccaaggtcaaggccagcatttgttgagggccttcttgcagtgtcattatatggaggaaggccaagagaagagagcaagacaggactgaactttcttttataacaagctcactggtgataacctcctcctgagatactgacagtaatcttttcctaatcacctcttattaggccctacctcccaacactgttgcgttggggattaaattacaacatgggagatttggagggggacacagtcaaaccatagcaatgtctgtttaatttttgtaattatggcacagatatccatttgaaatatgtgtaatatggaatactataacttccatatcttacgtgtctatgtaagccaaatggaagtattatatgaattaacataatatgatgtcattatctagttatgttaacaacacctttaaaaatttaaccttggaagcgaggtgaagaccagaatagttactcagtgtatgtttattctgcacttgactagcattgtactctgctagttaccaaaaaaagaaatatgctccttgttcacagcatttttatattatagatggggtctttacaaaaagaacatgacattatattggagtcattcaagtcccagttcacgttccgtatcttctaagaaacttctcaaaactatgacttgacttaaacagtacctacacagagctttaaatttaaattcagttttagtaatagtagtagtggctaacagtgaatgtttactccgtatctgaccctgttaggaatgctttatatggattaaactcatttaattgtattgaaatctcaaaaagttaaaataacaatgtattaaataagaataccactacacagtgtgctcctgtagggtaaaaacagtgtcttaatctttctttctgtcttcagtacccagaacagtatctggcacatagcagatcttacatattttttaaaacatacttttttcttgtcctttgactttctcttccaaatcagtaaatatttttgaatgtcttaaatagcttcaaaatcttaaaattatggtatgtattttatgtgcatgtataatatgcacaatacatataacactatgtaaattataaatgatatatctttaggtttgatttgttatatattttacatatgtatatatgtaactgtcaccttttttgctatcaaacttagagaaaaaatagatttgccgctctgtttttttaaagtgaatactactttgaatacagtctacatattttaatactgctttaaccctttatagtttagattctgacacactctgctggtgaatctaattgccaattctgaggcttagttttagtttcttgatttgtgcttgacattgttgaccattcctcaaaaatcttgacttgccttgaaagacattttttcccgtgataatatcctctttgcttttttattcctttgtccttccttattaaaatttgaacatttcttcctagacagtttgattcttactggtttttacctggtatctttaaactgaatattttcaaatacttaacctctagcccagaagcctgtaatccgtattttcatttactttaaaatcctattcatacctcttacttgagaatatccaaaactgaattcataatttttacttagcataccttagtgttacctcaatgaatgaaagttcctcttcaggtatactcaagatgttcatgacagtactgcatacttgtaaacaataagtttacttacgagtttattctcttttccatatcaccctagtttagtatttttctattattgcatggattattttgtgcttctgtatttgcctcctttcttatgatctggccccttccaagtttcttaacatttttgcaaagtgttatttataacacaaatttgactgtgaaatggaggtttttcagtggctctctacaatgcttttcattttcttagtggcctttattggaactcttttcgtttcttccaggtttttcagtctcccagcattatttccttttttgacatcatgatcttcacctgcacagttttcttctaagcaagaagctcccttgtcatctgctagttctaaccatagataagttcactatccactcctcgttcttgaacccagaatgctgagtactacttcagaaaactaaatactagtgctgattggtgccagtataagtttatggtttttattttcttggaccttgagtatttattgcctatcagtctcatttagccattctaaaatgtccccactctgatcagtctttcttctccatttctaccatgccctcatttccaatcttcctccacaaagaattgcaggcctgtctttattttctttctcttttcaaacatatgtatagcctctattatcctacctcatttcttcctgtttcagagaaagaagctagtccaaagctattcactttaatttccgtttgattttataattgatttctttcaggttcctaatcatactctcttgtttctgctttttaggttctgttggtttttctccctcaagacatttcagttttaaccttttcattctttcaagcagtttatcttgattccaaacataattacaataattattttttcagtccaaacatcttgtagatgcgtgctcttggcttttgtttcattatctataaattaagaaatgtaattatgtaaaatatgcattcacatatgtatcttgttcagcactttaaaaacagtctgtaatcttggaaaacataaataacagaggcttgtcatctgtaggacattactggggttctagcatgttcacagtcttgttactgtgcagattcatttgctgctatgactgccatttgtgacccaatgaaacactataaccatgtgccttcctaatagcaaattgggcttcagtttttacattggtgtgaccttaaaaaatgattatgttccttttaaaaatacgtagttgttacaacattatggcatttggatacttcttgtgtttgctaggtaaaatgtctttttgtaatttattcccaaactgacattttaaacatttatagacagagatgttgagtagttggtttccctgtttattgagcttttcttgtcttgcttctcctttgtttcatcaaactattattgtttttgtataaaggctgcctaatggctcccaatttcattatttttatgaaaatttgtcttcgaggctcttaaggttttttttgcccaagtaaattttttccattctctcggtattataatagggaacattcaaaggggcagatggcagatacgaaaggaaggaatagtatcaatcccaataccgttttaaaatttgtcacagcctaactaatgaatgagcactgcattttttccagcttctgagtaaattcacttgtattgcacagtgtttaatattttaaaaattgttccgatcaactgtattgaagtataattgacataaaataattttaagtttgtaattcaatgagttttagcaaatatttctttaaataccatcacaatcatgatgcagagtagttccatcatccccaaagtttgctcctgctcctttctaatcagttcttgctcccacctccttgccacttctgatctgctttctatcactagttagcatttcatttaagtggaatcatacagcatgtagtcttttgtgtttggcttctttcactttgcatagtgcttttgaaactcatccatgttgcatttatctgtagttctctttttttttttgctgagttcattgtatggaggcatgctgaaactttgatttctgaagttttaattgatactctgataaaatgtatcttaaatttttttttttcagcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttattatccgttggcgagtgagtaatagtttaaacttcatagttcaaccaaacttattttcgatagtcttcagtggaagcataaaatcactatgataaataacttaaaattattttagtgccattatttatttggccctgtttggcttggcatgatttagccataaatgtataagtatataaaaatacgcataatggttagagcacagtggctcttgcctgtaatcgcagcattttgggacgccaaggtgggaggattgcttgagtccgggagtatgagagcagcctgggcaacgtagggagatcccatctctccaaaaaaaaaaaaaaaaaaaaaaaagaataaaactgcataacgccttattttttgtagcattatatagtttatgaattgtaacaatcatgttgagtatggaatttagatgtcacgtcattcctcagagaggaaacaaatgcagaggttaagtggcttgtttaacatcacattgaagaatgatccagacttgaatttgaatctgacttgggtgtgctctaggctcctccatcacatacagatgttgacagtattttatctaaagtgtggtgtgtgggatattgtgatgacttacatcacggcagcctgtttaaaatttttattgcatacttagttgtttttatataaattgaagtgtcacgttgtatgccgtcctttggtggtggttgaaaataattcttacatgttgaatttggaaattctctagaattttcattctggttggataaataagatgtttaattagtaatagtagatttagggcagtcttggctccctgaaatggctttgtgtaattcccaaagtgaaaactgtgattagtaattaaaatacaaaagattgtttaaaagaagaagtatcaacaaggttaaattcactacacagtttgttgaaagagggaagtatgatcttcatcttgaaggggttatcgttgtaagcataataccttttatttggggtattccactcattcattatatcttatttctcatccattgtgaccaaagcactattttaatacttacgaaactttgaagggacaattttgcccttcagctgtatttaaaatatttcagacttcagaagtttgcattagtgtcatggcatgaaactggaaactactgtactgaatattgttatgggatagtcagtatgatgtctcgaaaagaaacacttcttttattcttttctattttattattatcctaatttatcttttttataagataaaaaagattctattggaaatagtaataataaattgttaggcttaatgtattaaatagtgttattagggaaaaaagtcctagttaacagatttctttactcctcaaaccatcttaaatgggaagctaatttacctaaagtaatgagggtcatagtattgtctttgggtatcaggaatacatttttttaaatctttttttgtttgtttgtttttattgagacagagtcttgctctgtggcccaggctggagtgcgtgcagtggtgtgatctcggttcactgcaagttgtgcctctggggttcaagcgattcttggacctcagctgggattacaggctcacgccaccacgcccagctcatttttgtatttttggtagagatggggtttcaccatgttggccaggctagtctcgaacttctgacctcaagtgatccacccacctctgcctcctaaagtgttgggattacaggcgtgagccactgtgcctggccaggaatacgttttttttttaagtcattcacgattatattcaatttttaacaataaatgacatctcagcttttaagttttacaactgtaataatcaaacattttgagagtaactataaaggatattttataaaaagaatttaaaattatctcccagtttatggagaataaataggggatggaagtagatctttgtactcaatttcataggctcagaatgcagagaagtacaaggaataacagactaggatgtactgattatgattagaagcatatataacaaacaagaaggcccttgaatttctgaggaatgcttctatcttggaaggccgcttatccttttagcaagcatgtggttttggtagaaatgaagttacaaattagattcagcggtctcaacagaggcataacgtgcctttttctaaataagatgaaaatatttgttgaaagtgtcagaattggggagtaagtattaatagttttactgaaccaagccctttagagattaattggcagtattaaaactttagaaaatcagtttttaagggggtagtatatctgattctcttaggatgtagaatttagatgtgtatttaaaaatttttttgatgaatccgtggtcactgcttaaatttctgagtccttatgctgcagcttttgctcgaagttacaattttaaacatgtggtttctggaacttttttttccttggcaaaaagatttttaaaaaggtacactttaaaattcaaataatgagattttctgactacatagttcttgaaatttgactatcatatttgagtttattgggttctggttaatgtatcgtactggtgtattttaataactaatgtatattttaaataattatttaaaacattgcagatttaaatgtactcatattttctactgtccactggttgatgcctgttaaaaatttaattttgtggaatcttggtcagccacttgactatgatgtttaaacagtagctgataattaaagccaaaactcaaatcaggttattttattttcatcttaacagttaccgacaccgtagaacagagcaagaggaggatgaagagctattaacagaaagctccaaagcaaccaatgtttgcactcgatttgaagactctccatcgtgtatgttaaacacacttgatttttttaaaaaattgccctttgagatctcctttggttaatgttttggatttgtgttggctactatttgtgaagcaaatttttagtagtcttagatgtttattggttatgaaataaacttcagattttgatggagatgagagcatattataggatagtagtgctgtatttcaaagttatataaaatgtcattgtgtttgttattgccctgaagtatatgtaaatctaaggatcgttttgctttatatttgtcccacataagaaaactaatttattttaaaaaaggtacttcatgaacacatttgcttacttctgatgtttttatattaatttaattttttgtgaaatgtatttgtttattggttagctttttatcctcaagtgtttttcaaaaggagatggagggctacactgtgtacatattaaaaaagaaaaatcaggtgaccgttatgtatatttggtaattattctggggagcaaaataagtagtataccctgaaagagagtgcattggaatgtataagatatattggacaagtaacttaggaatttcctatttcttttttttttttttttactagaaagaaaataaaatccccagataacctgtatctggtctttatgaaagctgaaaatacttggttaggaacacttggtttttcattaaaaagacgagaggccaaagagtctctcagaccagtatatgggtaacgtaagaactgagttgttggagtgggtactctgatgcccgcagtcatgtttcccgcacttgattatcttccatgtccagcttttccacttcagaccatggcagctacctctagtattttggaacttgcagagttcctattcaagaatccgttagtaatgaaaataaagtcagtagatatgtgtaggcttagatgaagagattgccttgtatttcttgtcttaaaatgcctattgtgcttttcttttgttcttagatgtaaaatggggtaaactgagagattatcaggtccgaggattaaactggctcatttctttgtatgagaatggcatcaatggtatccttgcagatgaaatggtatgtgttggtagttttttttgaagggtatgttttgtattgaaaatatcttatacgttgataaaagtttcttacagtctacaactgttagcaaatggatcctctcagaaactagtataagcagcttgccttagttgcataagtgtgatctgtattttaattgtgagaaatttccatcgctgaaaatatgataaatttaaaaagaatacatttgagaaacatgtttttggatgacttttatagtacaatgatttatttgcttccagttttgtaaaacaaaagtgaggtcattaattgtttataattgataaatgttttttccaggtggtagcttgtacaattcttagaaaacatttatcttttgttaactactagttatgtaatgaatgtttaaaaaagtttccttattgctataatgctaaaacgtttaattggttggagaaagtatgaagtcaaaagaaatgtgtttcaatgctagctctgctagatgactttgggaatgtcacttaaacggggccttatgcgggtgataataatacctcctttagagacttgtgaaaattatatgacataacacttacaaactttgatatatgttaagtttttgccatttattaactgttataaatatgtagcatttcttttgaacatttctatatgttgggaggtataattgtgaaataatattttcatttttcactgcttcatggttattttgaaatctttcagggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagtaagtttctagtattccattacatttttgaggctaaaataatttgaattcaggcttgggtatgggtatagctggaagaaggataaatgagacgggatcttcgcaaatattagtatttacaaatgtagcattgtcttggtggataaaaaacagcactttgggaggccgaggcgggtggatcatgaggtcaggagatcgagaccatcctggctaacacagtgaaaccccgtttctactaaaaactcaaaaaattagctgggtgtggtggcacgcatggcctgtagtcccagctacttggtaggctgaggcaggagaatcgctggaatctgggaggtggaggttgcagtgagccgagatggcgccactgcactccagcctgggcaacaaagcaagaccatcttaaaaaaaaaaaatcatactgggaagaagacattagaaatggtagaaagctgtaagactgtagtttgtttctctcccttttgggagtggttgtataaaatcattggttgtgctctcattagaagttattttcttgtttttaaaagatattttgaaatgtgagttggttggaaatttaaggagccacatttttagatgaatgtgtgtagtggtaatagtcacagaattagagtttttaaagacgggttgagtcatatatagtaatttggtgatttattatgatatttaacaaaataagttaaaatttcgatcagttgacaacatccttgtgggaagaagagatggaaataatgacattagtatataaagctcagatttggaaatttattcagactctactgaatagctgtgtacttgttttttatttcctcttcatttacctgtgagtgataagtctatatttttctctccctttctagttatgttggatattttaagttatcaatttttgtttgtttgtttgggagcccaaagagtggtaattacttaaccagtctttgcttcagtttccttacctttaaaataatactattaggaatgtgttaatacatttataaacctgaaaggaatgcagatgcctactactgctaactatctttccaccctcttcctttctttatgttaaaacctccctcttttttgtctaaacctgcctcctaagaatttcccgatctagtggaattgcagaaagacattttaagtgtctattgaatttttcactggttaactttgtcagttttttaaaacttaatggttctgacatttaaatgattaatgacgttactttagtcttaggaaagctggttctaaacgtttgcataatatagctagctactctactcctttttagtattcccacctctttttatatactagattacttgtcatcagtaaatgtaatgcgtagtttatttctacgtgatgtaatttttttctcttgttacacaggctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaaggtaatttgatacttagatgtgaaaagccttcatgtaagaatttgattaaagtacagatttttttttcttttaactttaagttatgagatacatgtgcagaacgtgcaggtttgttaacataggtatgcatgtgccatggtggtttgctgcaccccatcatctaggttttaagccccgcatgcattaggtatttgtcctaatgctctccctctgctttctccccactccccgacaggtcctggcatgtggtgttcccctccctgtgtccatgtgttctcattgttcaactcccacttatgagtgagaacatgtagtgtttggttttctgttcctgtgttagtttactgagaatgatggcttccagcttcatccatgtccttgcagaggatataaactcattctcttttatggctgcgtactattcgctgatgtatatgtgccatattttctttaaccggtctatcattgttgggcatttgtgttggttccaggtctttgctgttgtagataatgcaatatgcagaatattctaatggtgtatttggttcttttctttcagttgtcagaaatagtgagggaattcaagactacaaatagactattattaactggaacacctcttcagaacaacttgcatgagctgtggtcacttcttaactttctgttgccagatgtgtttaattcagcagatgtaagtatttcctggtgctttctggttaataataatattttgcttaatgctatatatttttgtaataaaagtggcctgccttttagcatggcttgaggttattattaattttttatgcttttatttacatagttagcctggtgttatctcctaggttgtctctgtataatgggaatttacttttgtgcctttggtttcaatcttatttcattattattattattattttattttttttgagacgtagtctcactctgtcacctatgctgaagtgcagtggtgtgatcttggctcactgcaacctccacctccggaattcaggtgattcttgtgcctcagccttccgaatagctgagatcacaggtgtgtgccaccatgcccggctagtttctgtgttttttgtagagatgaggttttgccatgttgtccaggctggtctcaagctcctggcctcaagcgatctgcctgcctcagcctcccaaagtgctgggattacaggcacgagccaccacaccaggcctcagtcttctttaaatcattgttttctctatctgaaatggcataaattgtcactcctatttggtaagtcaggttggcctgactttgtttcagtggctctaggttgactggttatgtttttaaggtgctgctcaaggtattcctgaagtgatttgtatacctcacattgcttatgttttaagtcccaaggatgactgtcaaatttagtgaaatctgtctggcttttcttatattatagtctaacaaacaaatagaacctaatctttatggattatttatagtcatagaaaggatagtaatggttaattagctatttgaactgttaatagtaatataataactatgtcaagagtttgtgctattagaaattgcagttttttttgcctggaccagtgtttatttttgaagctttgtttgcatagctggcgtcttatgtgtattggagggatttgaagagctccatgttagtannnnnnnnnnnnnnnnnnnntgaagagctcccatgttagtatatttttgtacaattaagttataaaaaggtattaattaattttgttttttttctgttgaagattgttttgaaagaatagattgtgttgtaaaaagatatttaatcagactccaaaagcaattttagcttcgattttatgtattttgatgtttttgagataattcctgtttctcactacattgacactttcatttactttaaagcagtgaattctaagattatgtttactcaaaaacaaagcacatatataatacatatgttcaagagatgaggttagggaaactgcccttgttgaaatcgtaaccaaatattaatgaaatgctggtaatttcaatttcatttagtaagtttgattaaaattgacattgttcgtaaacttgtatttgagtagtgcgaatggtctcagagaacaaactataaaatgttttaattttcaagcttttatgaaacttgaaagatactttacaagaatattaattttctaatcctatagaacttgctctccaactttttactgtgaaacttgttattttgatgtttttgagaagaatgtttagaaggtagtgtgatttctgaactacttgttttaaaattagtaacaatgacacatgaaaaccaggattggactaagtgatttttttttgtgggttacaattcaaattactaattctagaaatcatttctatatctggtattatagggtatttgttaatattatctctgatctgagtatattttttgtttgtttatctaggactttgattcctggtttgatacaaacaactgccttggggatcaaaaactagttgagaggcttcatatggtaagtattttggagtagtgttaaagcatatttatgatgggaaaaaggataaaggtttaaattagtagattattttcctgttaataaaaaacacaatggcttaagaatcagatctgcttgaattctgacacttaactcttacatcttacaatcagtgtagggggtgatgtgtggttgtttcagtgttagaacctagaatggaatcctgacttaagggagaaagtattctcttgcagttatacaaaatacagtggggggaagaagaattgcataataattaatatagacaagtttttgttgttgtttttgagacagtctcactttgtcgtccaggctggagtgcagtggcatgatcttggctcactgaaacctctgcctcccaggctcaagcagtctctccccattcagcgtctagagtagctggggctacaggctctggccaccatgcccagctaatttttgtattttttgtagagatagtgtttcaccatgttgcccaggctaatctcgaacttctgaactcaagttatcaacctgcctgccttggcctcccagagtgttgggattacaggcatgagccaccacgcccggccttaatagacaagtttttaaagcttagttcaatttacattccatggaagaatctaacaggttcacttttgaaagggctaaagatccatctgttttttcttaaatctagctacattgtgtataaacaactgctaatattgcattatgagcacagttggtatgtttttgcttgctgtatagctttgtttctacatacagcttcctgtgacggttcacaagtaaaagttggtaggtagagaaacttctctaacagacaccagattaaaataccctgctaagcaggttaaagcaggagcttgtaagaatgttatataaagcccttaatgacctaactcaggaattctcagcctcttttgacattttggtctgggtatatctgagaggggtaaggagagaggggagaacgtgattgtcctgtgtattgtagcatgtttaatagcatccctgatacttttactcactagatggcagtagtaacattcctccagttgtgacaaccaaaaatttctctagacattgcagatgtcccctggggaacaaaattgtgcccctccatgacctaacctttttaacattctttggcatctgttttacttcttcatatattgagctttaatttgatagattgctgaccccactgtcagttttctgtaaacattgtggtaattctaatctatttttgcttatcatttttgctacacctagaatcctttttcctggtctctttactaatacctagtccaagactcagcgacatcacctccactgaaccagccaggctgaggctggcctaggtgcccttctgtgtattccatctttaacaatctgagcatcctaatattataggactttgcagaggatattgagatgattcacaagtgttttccatactggattgtaagcacaaaggcaggaagcacagatttatttgtctttgtatacctggcacaatgcctagttagagtggatatttgaacagggaaaaaaatttaagttcatgattgttcaaatatttcattataaagtactttaaaattcttaaatattgagagttttgttaaatatttgaaggtagtaatttcctagctacctttgtttcaattcagatggcattcatgcatctaagcactctctttgtatttacttagaccaagggattgtggagtgtatatgtaatcttgggggtagaaaaggaggcagaagaacatgattttttttcatgcatttttttccccttattcctctgctcttggctttcctttagtaaatacgtaggtacatctaggtaaagcaaatgaacaacccattcagcagtatcaaccagatttggtaactctgttttgttcacagggtattttgaaaatgcttatgaagtcagggagaagaggtcttgtagctacctctctactttctcctgctctttactttgaagtttctacagtagcacctgtggtcttataatgaaaggagggtttagaagtcggtatggatgcgcttaggaatgagataactcttatttgatgtattagttatctaatgctgcaaaagaaccccttattccctccaccccccaaaaacaccttaacccccctttaggggttactaagacccccttatttcccccacctccaaaacacttcatagtttatattttattaacaaccccagaatttatgggttgactggatggtttctttgtggattacacttggggttatccagttacatttatttagctggacaatgctagaagagaaccggtggggctaaaggtcttcacttacacatctggcagttgctgccgcctgttgactagggctgaactagcttttctacgtggtgatgttagagaggtgttgctggtatttttcccactaatgtctaatttggtttgtgatatagtcactatttttaaaaaccagtgtaaatagaacagaggtacaaaaaagggtatctttagttgtgtagttaattttaaaacttactgttctatgaaaatgagtgaactactactacatataacatggaaatgtctcattgtttaataaaagaaaccagatataaatgggtgcatattgagtgagtccatgtatataaagttaaaaatgataggcaaaattaatttatggtgtctaaaaataagaatattgcttacccttgggaaggaaaagaggggatagtgattggaagggacacaaaaatgatttctagagtgttctatttgggtaataacatgggtacttttacagtacttgaataaaatttctagaactgtacactcatgatttattgaagtgtgtacttttatattctttccctaagttagtacattaagtttaaagactaaccataaggagatcttaatgagacccttgtccattctttttttttttttttttgagatggagtctagctctgtcgcccaggatggagtgcagtggcgccatcttggctcactgcaagctccgcctcccgggttcacgccattctcctgtctcagcctcccaagtagctgggactacaggtacctgccacctcgcctggctaattttttgtatttttaatagagacggggtttcaccatgttagccaggatggtctcgatttcctgaccttgtgatctgcctgcctcggcctcccgacccttgcccattcttaggcactgttagacagtctgcatgcaagtaactagttttagacctgaaaggcagcaaattgttgaaaacattttaaaaatttactattgtttttagtattttatggtagtataacaagtatatactcaaacatatacaggcacatctcattaccctttgcagtgcttcacagatactgcatttttaagaaacatttattttgcgaaacaaatagatggtttgtggcaaccctgtgtcaaggaagtctatcaataaacaccgttttcccaacggcatgtgtttactctgtttttaaagcagtaatgtattgctttaaataatgtatcacatttttaaagcaataatgtacttttaaaataaggtgtgtacgttgttttttttttagacataatgctattgcacacttaatagtgtaaatgtaactcttagatgcactgggaaatgtgacttgctttattgaggtagtctggaactgagcctacaatatctctgaggtatgcctttattgaataagtaatggtcttgtattactacccttcaggaacccagtagtaataaattatatacagttagcccttcatatccataggttccacatccatagattcaatcaactatggattggaaatatttgtccccaaaaaagataaaaataaaatagatggttccatctgtgttaaatataccgaccttttccttgtcattattccctaaacggtatagtgtaacaactattaacatagcatttacattccattaactattattataagtaatctagagatgatttaaagtatatgggaggatgtttgtaggttatatgcaaatactacattttttataatggactcgagcatttgtggattttggtattcaaagggaaggggacaggaactagtctcccacagatactgagatatgactgtatttgcagggagaagtcctaagaaatcacttgatactcacgcagagaaatttctttttcatgtattttatatacaattctaagatgctgaaatatgaccttatgtgtaatattggtattacctgtttatttttgtcctttttaaggttttgcgtccattcctccttcgtcgaattaaggctgatgttgaaaagagtttgcctccaaagaaggaagtaaaaatctatgtgggcctcagcaaaatgcaaagggaatggtatgtgttctcagatgtacttgatagcactattgattcttccctaaatttcatgtgtattttgttttcctaatttgtgtcttcatggaattccaatttgctggattgaactcaacctgaaaagagttttcttgtcacgtagtataggacttgctcattaagttcgttatagaaagttttgaacctgttagatgacagaatcaggatggaaggcttatgaatccaaaattaaaattgggatttaataaacggggttcatatgaaaccatctacttgggatttttaaaaaggaaactgtgatagcacagtgtgggagatatacggttcacttatagttcataaatactgggtcagtgtaaagtagctgcagaaaaagatactgttagccttaatgtaaatgtagtgttcaaaggagaggaaataaatatagctacccttttctttactggtctcatcatatttcatgtatatttaactgcatacttaaattttgataagtatttgcaagaggccagagttgtttggttaaaggacttaatatcatatagagaactgggcatgttatctgggtaagaggttatctgtagaaggtggttggtcctaaatgtcctcaaaaacttctgaaagggtagcagatattaggcttaccttggatggctctaaaacagaactaagatgagtcaatgctaaggaaagacaaatcttttttagttaaacatttgagtgaactttatatcagaattgagatggaaaggtctgccttgttgtttaagcatagattgcctaggctacttactttgttcaaaggatccaaggctctaaaactttgatgcttagacaaattactcattctttcataacaatgtctacatccttagtatatgttcaaggctttttataatctggccttagcttatggctgtagcttcacagtcctgcctcacagacatacctccctcccccatgtatttatacgtatgtttaagtcacgttgtattcatattattctcatcatcatgccttaccatttcattattcttcctgtcttctcagatgttagggttcttacctaaatgctacactagctatggggtatatagtaatcgaatagtggcactttctgttgcaaaaaaactgcaaactaaaattatgtttaaaacttacattttttaagttttgctttattacttaaaaatattatgtcttactgctgtaattctacccaagggaactgtttttgtactttaaaaataatatcctcaaggcccaaggcgtaagtatgaacattataatgctatggacagtaaagaaaaatggaagcaaaaagaggttacagatgttaaattcctaaccatacctagaagttgatgagtagtttcttacagatatttgggggttcatgtggggaaggggattaagtatgtaaagtggcagggattgatcaaggaacatttgagctctaaaaatgtttttcttctttgaataggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggtatcggttacccgtatcaaattatcaaaactgttttaaaatgctcatgttaaaacaaaggagcactgtactttgaaatgactgctctgatgctttccaaggttgacgtgtagaacattaaaaaaacctgttcattatctgagctctaacccccactcctgattttaggccttaagtctcttagaaggtaagcaatagttagagcaaccatactcccttgattttgggaagagttcatactttatatatactttcctagaaattatagctttctgtcataaaatgtgaagaatgcatctccctcccacacatggttaccagatccattgttagacagtggtggtgtgttcatgatattgttttttagttatttatgtggagttttaatttaataaggtaccatgtacatggacctgaaacatttttatttgtagtatgctgactttttttatgaaaatgggtatgtctgtgttgtgtgtttgggtatatttaaattacacgaatgnnnnnnnnnnnnnnnnnnnnatatctcttaaagatacgaaatatcactgctatagtattaagtgtgcagattcaagtttgtgtttctctctatattttaataagaatgacatttggaccagtaggtgaatctcctctatgatactatcaaaagcatgttgtaagagttgtcagtgaatgggtttactttttccttttcatacctttttgtagagatagatttttaaaaaatgctttccttgaaagcaaagtaattaaaggagttaaattggtggggaggagtggcaggaacgtggtgggaatactcagatattaatgaaaggtatattaaactctgcagggaaaatggagactattaagtagtctcatgtcccagcactttttggaaggctgaggtgggcagatcacgtaaggtcaagagtttgagaccagcctggccaacatggtgaaaccctgtctctatcaaaaatacaaaaaaagttagctgggcatggtggcatgcacctgtagtcccagttatttggaaggctgaggcagaagaatcacttgaacctgggaggcagaggttgcagtgaactgagatggcgctgctgcactccagcctgggtgtcagagcaagactccatctcaaaaaaaaaaaaaaaaaaaattcttatgcatttgaggtgcaggaacgtgtgacaacagcagattgtcagcctctgcttctaggacaggatcatttcataatcattacttttcaaaatgatcctttgtcttgatatattctactgaaggtattatgtagctgcctaaagaagtggaaggcagtcggatagtttgaatcatggcagataagtgataagtgaaggatagtcattgtagatatatgaggcacatattatggtcctttgatctagaatggatcttcagaaccaggctgagaccaggattattaggtgtgtgttggaggtttggggagtcatatgcattgaagagttgttgtgaagtagtggaaagttatttttaaatgtatatggggtaacaagataatgattatcttaccctttgggatggcaaagccttccagaccagaggcaaatatgcttttctgtacaaatgttacccttttttatttgtgccatggtgagaaaaaagtgggaaatgactgacttggataataatgtgtagatttttttcccccttgtaaccaagcaggtagctttggaattaaggataattgattagtcttagttttggttacccttaaatttttctacttttgaagccactgataatagattgttatattccccaacaggttcacgagtactaatcttcagtcaaatgacaagggtattggacattttggaagattattgcatgtggagaaattatgagtactgcaggttggatggtcagacaccccatgatgagagacaagtgagtaaaatttggggagggagataaaaaagaatcagataaattttttgacaaccattttgttttatccataggactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggtaagagataacgaataaatatattctgtgcttagtagatggcgttagttaggacaggctaattctacaaatatcagtgacttaacccaatagaattttatttttctctaatctaatggttcagtgagagtatattgaggtgatcttccatctaaataagggtatttccatctcagggatctgccatatcttaggaccctggagtcctctgctatactgcatcctattggcagaagggggaaacgatagagttggggatttcccaggaaattctttatgggtcagaccttgaaagagcctccttgtctctccacccccttgatcaaagaattagacagaactcaaatcatgtagcataactgactgcaagggaattggtaaattatagtatagttatatcacaggaccaaagagaattgggtttgatgagcaactagcctgtcttccactttagttatttaaaagaacacctgtgtgagagtacctggtcagatcaggaagattatttttagattgagagaattgatactgcagattggcctgacccatgatattggtgaccacaaacccaactttaatctctgtcattagtcactttctttttttttttttttgagatggagtttcgctcttactgctcaggctggggtgcaatggtgcagtcttggctcactgtgacctttgcctcccaggttgaagtgattctcctgcctcagcctcccgagtagctgggattacaggtgtgcgccaccacgcctgactaattttgtatttttagtagagatggggtttcaccatgttggtcaggctggtctcgaactcctcaccttcaggtgatccacccaccttggcctctgaaagtgctgggattacaggagtgagctactacacccagcccattagtcactttcatcttgtactcttactaagggtgacaggggaaaatggaccaattattagaaataagggagttttttaggaatgtagttagcaaaagtaaaacaaattcatattcagattagtttgactacttgtatatagttaattgggtaatatttaaaggttagaatttttgtgttgtttgctaagttgtttcatgtcacttctttgcctgatagcagtgacaatttgggtttgatttagatagaaaaacattttgaatttaaacctaggaaaaaagacttaaaatctttcctcatcagacttaaaaattataatgttgtatattgtttggagacattatgtgttttatctcagtgtaacctagcagaattcatctgattccttacagatgcagtgttattacaaatttttaaaagttttatatttcagaatattttaattttttttctcagtgtacccatttcagtgttatttatgtgacttttaaactaaattcaaaataacatggtaatttatttaggaccgagcacatagaattgggcagactaagacagtcagagtgttccgctttataactgataacactgtagaagaaagaatagtagaacgtgctgagatgaaactcagactggattcaatagtcattcaacaaggtaagccatggaactttaaaactttaccaagttggattgacacaacctgtttttgtttgaaaatcgtcttagaagattcttgttactaagcatccattgagtcaagcttgcagccagtagagatgacttgtattgcaaatacagtaaactttagttttgtcattaaaaagatggatttgggctcaggacagttgaggtttgaataatgagtctgccagttagcagttctctctggttacatgaacccatttcctcatctgttaagtggggataaaaataactacacttaaggattttaaaggattaaaggggataatgtatataaaatatctgacattcagtgtggtggttaatgatttatatgtactaactactcttgattactgtggggaaaactgaagaaataaaaatcaaagagcctgattttattcttttttcttgtctgcaatttactgagtacccaccagatgctaggcaccgttcttggtgctgagaattcagtggtaaatggaacaaacaagtattcttactttcaaagagtttacaatttagttgggagggagagatgaagtaaacaagggtataagtaggagtagggggtgagagtgggattttattttggatcaattgaaggaaacttaagttctcattccagatcagcttttaaggatgacataatttatgttttcatgaagcctactataaagttgatgatgggaaatataaaattcaagaaaaggggtgggaaacttaataatttcaagtgtgcattggtttcctttgtaactgcatttgtgagcatgtatttactatctgtctataaagctgaaaggcatactgttacattgtttactgattatgtaggtatcttgattttgtcagtctctgatgtccatgtaagagagtattgtacatgtctttggtatccctaatgctattcatagtgttagccatatgtctgcatacctgaagacaataaattattgcttatttttacaaatcgtttccgttaataaagtgtttactttgtgccaggcagtgtgctatatacttaacatttcattttctcctttagtcttcatgccaacttgagatgttagcatcagagataaaggcttttgagaggttaaattacttgttcattgtacatacagctgggaagtgactcaagggggatcaagaactttgttaactcttaagtgtttaattagaaaagtctctggggacttctcgaggctgccaccccgtgatgttatctcatgggtgatataatggctaatgttttatttttcttcacacatccatgtgttttgaaatacacctgccgtgtgtttcttgttctcagttattttcatccatgaaacactttttttttttttgagatggagttttgttcttgttactcaggctggagtgcaatggcacgatctcggctcactgcaacctccgcttcctgggttcaagcaattctgctgcctcagcctcctgagtagctggatttacagatgcccgccaccacacctggctaatttttttgtatttttagtagagacagggtttcactttgttggccaggctggtctcgaactcctgacctcaggcgatccacccacctcagcctcccaaagtgctggattacaggtatgagccaccacgcctgtccaaaacactttttttaaagataaaaaagaccttaattgattcataattaatttagaaatcttgaggtttttttacttcatatttactgtggcaatttttggagcaaaccttcaggctaatagctttcttgtgccgtttgtagacatgttagtcaaacagcaagccttaagtgcatacctttgtgttactgttttttatttgagggacataattaaaaacgagagtacacaagcactttacatctgaaggttccggaaccttcctgcccaacttggaagtagtttgtataagcataagaacattttggtagcaatggtagcatccaatccaaggaaacataccttgtggatatctcctcacttacaaagtcatggatgtttggctgtatatcctattatgggtcccaaaccatgatacaagtatttaaagaagttgttgaaaacttggatctttttccacttacttacaagttggttggcatataaaaatcaaagctttgtttaggtgtatgtgagtgacccttgaggagggtgaaaacaagtctttctgggtttttgtttgtttttttatacctgtatttttgaaaaattacaaggttgtccaaactcctgccaactgaaaatatttattaatttattaatggtgagtttcttcgatgatccagatacattttctcaccaggtgtggtagtgcatgcctttagtcctagctacttgggaagctgagacaggagaatggcttgagcagggagttgaaggctgcagtgactatggtcctgtcattgcactccagcctaagcaacagagcaagactccatctcaaaaaaataaacgaataaaataagtttttaggagtttcagttcttctggaagttttctttaaaaagaaactgatgttacatatttcagttctgtgtaaagtttggcctaggtgaaggattttttactttacttttctaaggagaaaagctgatttggggagtattagttaataacacctttctgctcatcagaaacttgtgtgtataatgcttccatctgttgaaacttgtaggtttttgaaaatttttcatatgcagctttcacaaaagattatatttcgttggcacagtatacagcaggtttcattatataatacataaggtttaggaatgttttgtagcttaccaactgaaaatttggcattaaatttagtgcaaaaatcaaaattattagatgtgaataaacagtaaacagaaatgattgacatttgagataaaattataaagcattaaaccttacatttaaagtttcaagtttccagtaaaataaagtctgttcagttaacattatacaacacaatcttttttcagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaaggtgagatgtagattaaataatgcttttaatatagaatgttttagaccagaaacaggaaatatttgttacattgatgataaataattttatttccttaaagagaagcttttgtgtacgtgaagttaatttattttgactgcagttttcatgctttctttgctgtgaatctaagaagctgattgttttgttctctagactgcagagatgaatgaaaagctctccaagatgggcgaaagttcacttagaaactttacaatggatacagagtcaagtgtttataacttcgaaggagaagactatagagaaaaacaaaaggtaatttagaaataggtttgggttacatgaaagctttattttactggaaacttggaattttaagtgttactgtaatgtcttataattttgcttaaaacagtagtcatttttgcttattcacatctgaatattttcatcattatgtaaaatttaatgccagtttttcagttggtaagctctgaaatatttttaaagtttttgtaatgaagtttgtggtatatgtttacagtgaaatatattcttgtatgggatgaatagtaatttgggatggtaacctgattcattttattttaaacagcagaattggctggtaataaagggaaaaatttcttaacttcataagtaatacttggtaatatagagataaattgaaaaatacccagagattagaagaaaaaaataattctacccagtgtttttcttgttaatatttaggtctatatcttcagaattttttgtaggctaattatgtgtctacatttttctcctagtttagatttataccaaacattctgtagcatttctccctcatttaacagttgttcctttaagcaagaaatactgaatgcttactctgttgactagacactgtctcgtgttaattatatacataatattgagcaaagtatcatagtctccaccctcatagagcttatagcccaggattttgtgaatatctttacatttacaaacatccttcttgatgatgatttgttactgtgtataataaaagttggtgatttgagttgtttcccatgtgctagattgcattcacagagtggattgaaccacctaaacgagaaagaaaagccaactatgccgttgatgcatatttcagggaagctcttcgtgttagtgaacctaaagcacccaaggtgagttgactgacacagcataaaaatatctaaaaattttgaaaatgtaatttttttcatatattcttgcaaaaagattgataattagattttgtgtttcttttttttttttttttttgagacagagtctcactctgttaccaggagttcagtggtgcgatctcagctcactgcaacctccgcctcccgggttcaagcaattctcctgcctcacccttccgagtagctgggactacaggcacccaccaccacccctggctaatttttgtaattttagtagtgatggggtttcaccatgttggccaggatggtcttgatctcttgacctcatgatccgcccaccttggtctcccaaagtattgggattacaggcgtgagccactgcctctttcctacattttgcatttctttagagtgtactctcttctgtttttagttaacatttttcaaaaattaattttgaatctgtgcatttaaaattaagatataaattcagttttattgaaagatgcattcagttgcttgcagaattggctgttgtggtttatgaagtgaggactaaggatacatttaaaatgaaatttcttttttatggataacacttatttttgtttttctttaggctcctcgacctccaaaacaacccaatgttcaggatttccagttctttcctccacgtttatttgaattactggaaaaagaaattctgttttacagaaaaactattgggtacaaggtaattgaaattatctgcctttctgttcattcctatccagaaattatggaaggtataaacattagttataaatatttatctaatttggacctagtgtgaaacaatactgctttagcctagtctagttgtatgtatgaaatacataaacttgggtctgtttttctttaacaagaaaaaataagacttcatgaccaatctggtttgtttttaacataatacatgcaatgtatcagtatattttctttcctggttgaattgaaacttgtgaaatgtcagttagttggttcatcacatgctctttaaaatttactgatttgatggcatagaaaaatatcttttaggtacctcgaaatcctgagctgcctaacgcagcacaggcacaaaaagaagaacagcttaaaattgatgaagctgaatcccttaatgatgaagagttagaggaaaaagagaagcttctaacacaggtatagcctttaatcagtacaaactttagtaacagtttgttgtaaaggactgtgttaggttatgttggggcataaaaataaatacaagtttctgcttttaaagatggaataattggagacaataaagtatgggcatgtggataaatgctccatctgattgtcactagttgaggtagttgagaagactacagattttattactctggctcggtagagtgggtatcttttttatcaccttactttgaatgttcccgtctttcctatgaattttccacattgctacccagtcaccattttcaactataaatcttggcttggttattttttaaacatcctttggtgttcatcaaggtctttcagaatctggcctttgacttacctttaaagcttcattttccttccatttttctacttgctcatatttttgccctttatgttattcactctttctggccaactgctagtaatccttcaaagctcagtgaaactgtcaccttttcatacagtattccttactctcagccactcatatttaattgcttgggtatttgagcaatatataatgtgttgtcaaaagtgtatatttatgtacacgaaaagttaccactctaaaagaacttaataaactagtgaaaatttgtttttgtaatatttagaaggtttgctaatagcatgttttccaagtttaatgtgctgtgattaaatattttgtttctgttcctgtgaagggatttaccaattggaataagagagattttaaccagtttatcaaagctaatgagaagtggggtcgtgatgatattgaaaatatagcaagagaagtagaaggcaaaactccagaagaagtcattgaatattcaggtaattcttttaagcaggctgttggagtttagtaagagctgttggaaggttcttgttttcttattctgaattatgttgtgattagctaattttgtcacagtgtagttagtaccttcttcattattttttacaaattagaaaatgttctgtttccagaaatggcgtaatggtttcctttttaaaaattttttaaccctagctaactctagcgacagcaaagaaaatcagaataagtcactggataattgcccttgcatttttatcttaatttctctgcataacttcaagtattatgtgttgtgtttcctgaagtcagttgtattattaggttaacatgtgagggtatgctgtggtgagtctgcttagaatagcagaaatttaagaattagaagataaataatccagttgatcccattttttttacattaaagaaataaaaatataaatgatttgtttactttgtccaacttttacagctgtgttttgggaaaggtgcaacgagctccaggacatagagaagattatggctcagattgaaaggggagaggcgagaattcaaagaagaataagcatcaagaaagcacttgacacaaaggtaatttgcttgttaataagttaggtagttaataaaataactcctagctgtgagtatgagagagtgactttttataaaggaaaagaagtaagggtttacaatttaaaatttcttcagagtagcattcaaacatggtattgtcagcagaatttacctatacactagactgatagatctgagtcaaagacactaagattagctttttactaagtagaatcaggaagtcttagtctgtatttctctttataataataaagactataaaggtcttttgggacaaagattatataaagcaattgaagtgctctagatagaaaattctgatttgaaatgcaacattttagctaattatactaaagctgagtttgaaatacagattatataggatttgtattttatataatataaaatctgactttcatagattggacggtacaaagcaccttttcatcagctgagaatatcatatggtactaacaaaggaaaaaactatactgaagaagaagatcgttttctgatttgtatgcttcacaaacttggatttgacaaagaaaatgtttatgatgaattgcgacagtgtattcgcaactctcctcagttcagatttgactggtttcttaagtccagaactgcaatggtgagtgctcagggcttttttgtgtaatgtagcagagttcagagtaagtgtcatctttggtattctttaaggtgactttaaaaaaatctgtgaagtagacttttgttacaatattgttagtatcataaaacctaataccagggatagcttacaagtttattggtcctatcctttagtatcttacgtctttaaatatcactatatgataagactagcttttcaagttctaagtgggaggaagtatcagtttcaacttctgagtgttacgactttttggtttttcaaatgaacatatttctataaagaaaaatggtccttgcattcaagcatctgcacatcagaatcagcattctgatttatttaatataaatcatccagagtctggattattttaagatggcttattatagtgaaacactacttttgcactgatttagtgctaggttttgtttttattcccaatatctgactaacagtttctgaccaaatagccccatttctaataacctaaaatttgaattcagaaaagtttaactttgatggattgctccttttcttccttatttcaccaccattgaactttgagcttcaacttgttttctgccagatgaggataatgctaataagttctttagtcttaagtttgggatattctgggataagcaaagtttaaacatctttgtgtttgtttatagtaagatttctctgtatatttaaagtaaaatgtcactttgtaagacagtggatagtaagcagtattttcatgtttgaccactgaaaattttttttcactagacatcactgtttgtgatacccaagtttgggaaatgtactaaacttaaatacatgaagatactttgaagataaaacactgtataaatatataattagagaaaagatccagttgctgaaagcttatttcttcttaagtgggaacaatttatagagttaataaagaataattttatagtgattgtaacaagacagtgccatgttaatttaactagtacagtaccgtaatttaaaactgtgttacttcttaacatgttccatgttaagatgcacaaaaaatgataatgtattcttctatctctatatactatttctaagtcttgtgtggtgtattctatacagtagtattttaaaattattttactgtagttgtgtgtgtagtagtatcacttactataagaaaaaaataattttgctctataagaaagggggctgctacccagcagccgtccgtgcagatggacttctgtttctttcagggttaactgctacttctatgttatactttaaatcttttctggaggctgtatgtccagtttgccagagagagatgaggtagaactcatcgtagacttccatggctggttttccaaaattgggaaaggtgccatgtgattgattgactaccataattctagtgatactttgaagggaaagattatacacacctgttaaagttcttgttgtttttgaccctcacatatgtgcactattaatctttttaagttttggatataagtagcacagtagttctcagacatacacactaagtagcagtattgcatatgttcatttttattgctttaattcctaagtgaaggaagaatttttgaagaatacacagtagtttggctttaaagattggagtaaaaacattatttacaaatatcttgcctttaatcttcatagcatgaattgtatatgaaaatcagttgttttttttttaaatcaggggtgtattagtggttttatatattatcctattaaaacataccttgttttaaaattgaaatcatgaaacttgtggatggaaagtgcgtgtaccatgtttgtttataatttaggagctccagaggagatgtaataccttaattactttgattgaaagagaaaacatggaactagaagaaaaggagaaggcagagaaaaagaaacgaggaccaaagccttcagtaagtattcatgaatatgtaaatatgtggattatgtaaatttcccctttctaagtatttaacactgcttggctgtcattgatgtgttagtccctgttgtgcacccctccattgcctttactttttttttttttttttttttccttaagggagaacccaagctcataatttgagattcttccactttcaaatttaggtagtggtataatttttaatttttagttgttatgagtaagtatgtatttataggttacatgagatactttgatacaggcatgcaataagtaataaggacatcagggtaaatggggtatttatcacctccagcatttatccctgttacaaacagtttaactcttagttattttaaaatgtataattaaattatttattgcggtagtcactgtgttgggctatcaaatactgggtcttagtctctctttgtatttatttgtatccattagccagccccactttcccccacccccactgcctttctcagcctctggtatccatccttctctctgtctccatgagtttaattgtagtttttagctcccacaaataagtgagaacatgccaagtttgtctttctgtgtctggcttatttcacttaataaactccagttccatccatgttgctgcaaattacagggtctcattgcttatggttgaatagtattctattgtgtatacataccatgttttctttatccatttatctgttgatggacacttaggttgcttccaaatcatggctactgtgaatagtgctgcagtaaacatgggagtgcacatatctctttgatatactgactttcttttgggtgtaaacctaggagtagggtaactcttatctgtagttttttgaggaaccttcaaactgcttccacagtgattgtactaatttgcgttcccaccaaaagtgtatgagggtttccttttctccacattcttgtcaggatttgttattgcctgacttttggataaaagccattttatctgggatgagatgttatctcattgtagttttgatttgcatttctctgatgatcagtgatactgaacagcttttaatatgcttgtttgccatttgtatgtcttcctttgagaatcatctgttcagatcttttgcctatttttaaatcggactgttaggatttttttcagtagagttgtttgagctcttacatattctggttatttattaatcctttgacaaatgggtagtttgcaaatattttcttccattctgtgggatgtctcttcactttgctgtttcctctgctgtgcagaagctttttaacttaatgtgatcccatttgtccatttttgctttggttgcctgtggggtattattcaagaaatctttgcccagtccagtgttctggagagttttcccaatgttttcttgtagtttcacagtttgaggacttaaagtctttaatacattttgatttgatttttttatatagttagggatacaggtcaagtttcattcttctgtgtatggatatccaattttcccattaccatttattgaagagactgtcctttctccagtgtatgttcttggtagctttgtcaaaaatgagttccatgtagatgtatggacttcacggacttatctctgggttctctgttcttttccactgttgcactgatctatgtatctgtttctataccagcaccatgctgttttggttactatagctcggtactataagttaagtcaggtaatgtgattcttccagttttattctttttgcttagggtggctttggctatttctgggtgttctgtgggtccatataaattttagtatttttttttctatttcagtgaagaatgtcatgggtattttgataaggattgcattgaatctgtggattgctttgggtagtatggacattttaacaatattgaatttgctaatccatgaacatggaatatctatttttttgtgtcttcagtttcttacatcagtgttttatagtttatcttagagatctttcgcttctttgattaattcctgggtattttatttcacgtgtaattactgtaaatgggattactttttatttttcacattcttcactgttggcatagaaatgctactgtttgttgtatgttgattttgtatcctgcagtgtcactgaatttgtttatgagttctaatagttttttgatggagtctttaggtttttccaaatgtaagattatgtcatttacaaatagggcaatttgacttctttgtttccgatttagatgtcctttctttctttctctcgtctgattgctgtagctaggacttccttgaaatacttaaaaagtacaaatttagcttgactgggttgtgtgggaaaaatcacttcttgatgatatggtagtccttaatatggggcttcgtgaaaatcaggaaagtatgtctcgtaaatgtcaagtgtgtacacatctcattgagaatacaagttataattttagaataatttaagaaacattggaaaagcagtggtattatgacttttactgttagtctctaagctttgattatttcagtgatgttttagcaatgtgaaggcaaacacttaaagggaaaaaatgttatttaataatagttaatttaataaaaaatggttaatttataaagtcatgaataaatgagtatctctggataatatttggtacttatgtaactgccttttaaaaactcaagtgtttcttactattttgggaagcttgcatttatttgatattgatctactactgttaattgtgcattagttttataacgtcattattaacattaacattttttattctgtaagtaaaataagtaggtaagattatttggaggctttatagtttgctttgaaagatttatatagcctgggggaaaagtctcatacctattactttgtagtagttgttattactaaagtgttataatgtgtctgcaactatatttcatgtttatattagtcttgtgaaaagtaatccttctgtctgtttgtagacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttattactaagtgtttcatttgatttatttttctattgtagttccatttgtgaagattgggactttttgtttattagctataatttctacacttgtaaggcttaaaaacaagttaaaaagaaaattgcaaataacatttgtccctttcagtcttcacctagttgtgtaattattttaattcactttgcctttgcagaaatttgggtattttctttgtagtgctattgagtctcatctggaaagattatataaattgcattctccttgcttatgtgggtagaatgggaaaagaaggcaagacaaagtatacttaaattctatgcatatttctgttatgctttctgttttttttagttgattctgaaatgaatatgccctattcttttgaaagaatggccttttagttgtatagccaaagacatttagtattttccggttccttaaggtattactgtaccattttgtaaaaggaatattattattattatttttaattatttggtaaatattttgtcatatgaccttctgaagcagccacaacttagataatgtcagaactaaggtgattttttttttttaattttgaaagcccagccaaaatgaggtgtgaatttgtcatactgttacattgaaattggtaacaaaatatatcccctcccatttggacttttagggtaaatgaaaattttattgtattttaaagtagtttctaagtgttagcaagactgactataattccagtttctgttttctatggacagacctgataaactggagaccctaaagcaggaatacccaaattatagtgtcaggattttagctgtaccagaggcctttatgtgctacacataatttgtataaaattttatatgtgcagattgggtacataaacagttctccatttttctaagggaatgcaataaatgtagcatcgtgaataaatataacttttataatccgtaaagtggtcttttctttccatttctttaattgttttctcaatttttattcactttttcctttaggacacatttcccttaattggatatctttcccttaaatttctattagtagttgttttcatctgcccacatgtaattgaagatttaaaaaaaaaattctgatacctgcagtattactaatactgcttaatttcttgaaatgtggaattgctgctgttaatgtcaagcaaaacgcagtatttatggcaaattgtaaagtaatttgaatttagtgctacctcaaaattaactttttaaatactatgttagattcttaacagttaaaggtctaatacatgcatgaggaatggttacttatgaaaggaaaaagaatttgtaagagttatcacctcagtttggaagaaattgaaaaaatgtaaggctgaagaaaacttacggaggtcacaaaagtgatgttttcaagaggaagagaaactgggagggagatacacagtggaaatgcaaaatgaatcaagtatagtggtagccctgagagcttagggactcaaatggaaactgtgtgaagggaaactcacttgaaaaaaaagcatgaaccagctaggccctgccaccactgtgtttggccaagttcacaaatctgttttaacctgtcgcttccctgtcacttctctggctttcctctcctgctaagcttttgtttcctggcagtaattaaaatcttctgtcagtgccacagctactactgctactggaactgccttaaccactactgctactggaactgccttagccaccttggtatcgtggtttggcaa

SEQ ID NO: 16295 - DNA, 140982 bp, Human
tttagactgggtcaagatcgtccaagtctggtggtggcttcagaaggccctttgaatgaggctcgtccaggcaataattaccatgttatctaattttgcccacttaacgtttccacttggatgtctaagagccatctcaaagccccacgtggccaaggctgaatctctaatcttcccccaacagacctgcttcactcacagcttccccttctcagctgacagcaaccccattaatctgcttgttcaagccaaaaaacctggaagtcatccttaactcctctctttctcccacatctcacaactcagcagtcagaaaatcctgtgggctctaccttcaaaatatatccaccacccatccaccactccgcagttgccctttaccatgctgggccacgccaccatcacctctcactgggccactgtaatagccttctaacagatctccccactgcaccctggctcacttgcaaaccagagtgatattttaaaactataatacaaatcatatcacccttctgctcagagtcgccccccatgtgtcaatgcataaaagtcaaagtccttacaatgtctccccattcattggcctccttgctattcctggagcacaccaggcatactcctacctcagggcctttgcacagactgcccgaagctctcctccccaagacgtccacaggggcaactccttcacttccttcaaacctttgctgaaagtttaacttcccaatgcaattcactctaaccactctgcttaaaatccctaccttctccccaaccccctgcttttcttgtagtggttcccattacattctaccagtctacctaatttttttttttttttttttgagacggagtctctctgtgtcgcccaggctggagtacaatggcgcgatctcagttcactgcaacctccgcctcccaggttcaagcgattctcctgcctcagcttcctgagtagctgggattacaggcactcacctccacgcccagctaacttttgtatttttagtacagatggggtttcaccatgttggtcaggctggtctcgaactcctgacctcgtgatccgccctcctcgcctcccaaagtgctgtgattacaggagtgagccaccgctcctggccagaaatctcttctttattatgtctactgtccgttatccaactccagaaggtaagaacctccactgatacataaggacttgtataccccacgtgcctgcaacagtgcttggcacctagtaggcataccaaaatatataaatgttgaacaaatgaagaaagttaaagtaaaactagaggtccaaaaatatcacaaaagccatctatggtcgccttttccctacctgattttgctgagtggccttacttttcagtcctctacacagctggaacattaatgaacacagagggggaagaagtgtgtttactctaggatcacctctcaatgggtcacttggcaagggcatctttgcttcttcgtcagctccttttgacacgggggtgaagggttttctgcaccacactttgaccacaagcatcaccaatttcactgaacccaacagaaatttggaccctctgggggctctctgcgtggcagggcccttttctttttctttgggcttaggctgcaatttgaaacaccactttcctgagccagcatcccccttgcagcgctgtcacagggaggcttaggcagccacgtggaagccacctaccccgacctttggcagaatttccaaacacaacacagtagctttaagttgattaatttggaactctgaccttggccccaaaaggtaagaatacataacaaggtattttattctcaaaatgtgtcaggataagaagcacttctgtaaatcgacctttttaaaatagatataattagatttgcagttgggggcagtaaagaaagggtctgaacagtggataacatgttgagaggttaattattaatgggcagtcttccctaacaaagtatctaataggcattgtggtctctttggcttcagaaattaccaagaaagcctggaccccgggtgaaacggagaaatggacacaagtcccctgtgtttctccattctgttggttttatgcatctttatccaatcaagtgcccttggacaaagcctgaaaccaggtaagagcctgacttttctccagagatgggcatgaacttttctttttaaaacgtgtgtcacaaagaatccaggggtttctgactgtatgggacagagcttgcttcagagcgtgccaggtggttctatacacgacctcacaggttcacagggacacgtagccgtttgtaaacagaaatgaaattttagaaaatcatcctcggattaaaagtcttctaagagtgcctgcagctagcagtgaagtctcttgcgtatctgatatggaaacagtcatgctaaaagttattcagcggcaaatgatatgaaagcgattcagatcttcctgagagttaatgtggcatctaatttgcaaccggggagccaggcttgcaatgaaatgctctgtcgggttggggttgtctaattgcctgcctctctcagaagagaggggaatttatgagagttctatttccagtcaggtctaaagtagagatatcattgcacaatttctagactttgttttgctgccaaaattttagtctgaggctgaagaatccaacagccgtcctgcctgttttgtttgtaaattcacaaactagattgatggcgaaagacagatcaaatgccttatcaggaaggtagtagagtggagcccagcttccaggctaagcagtggaccaataaatgacggatcagttaattgaacaatttggccagactagacaggtgtttgggaatttgttttggtactggttactggtcaggagctagtaacgctaaggtagagtctgagatttttcttttctctaagactagccttggagagagctccgacaactttgagaattagaaattccctaacgggatgtacctaaaaatttcagaagcttttttcccctttaagaaaaaggctgttcctttgtatttgactattttacttcataggccagttaataactgagtagcagtattaattattgccattcactaagtattttctgtgccaagcactatactaattatttttgacacatcatctcatttataaagccacatccaaaaatgacccttacataataatttagagccatacaggtaaaattgctggtaatctttattcccttggttcatagtgattttgctaaagggcctttcctgccctttgccccggaatgttgtatttgtttgtttactttttaatgaagtttataacacacttctagaaaagggcctctatcataaatcctcaatgagttctcacaaactgaaccagtaccccaaagccttccttgtgtgccccttgagccttaacatatatgattttttcctttggggagatttttcattaatagaaacacatcagttgctcttttgcgtctggcttctttcgttcgacattatgtttgtgaaagtcaaccatgcagtttcgtggagttgaggctcattcattctcactgctgtagcattccactgcgggaccatgccacacttcctttatccattctactgtggattggccaggactgtttttgcaatggagccatgggaattggaagctgtcagtgctgagatagaggttgaagggagggatggcctcccccaggcttctgggtattgtccagattttccttgagcaatctcattgtcctgatcagcctgcttctttccccggggcctagtttgtgcaaatgctgagagaagtggccactattagcaagagggttcctcagaaaagaggatccaagtcaggaggcctcttgttctcttggaagcagaatctcttggcagaattctttctgcaatgagtgagcccaatctgtgtgcatgtggctggtatgatgtctttctggggaaaccgcagggaagccggtgtcctgtggtggagcccttgtcaggaaagtttctacaccaatggttctcaacaggggcaattttgccctccaggggacacttggcaatgtctggagacatttttggtttttggttgttaagaccagggagagagtgcttcccttccagcatctagtgggtagaggccagggaagctgcttcacatcctacaatgcacaggacagccctcacaacaatgaattgtctggcccaaaacattattagtgcagaggctgagaaaccatgatctatgccaagcttcaactgtcactcatcgagcaccaggaagtactccctcaaggacccttcctctttagcccctcctcccagcctacttcttttgagtatttattattaatgacatcttactaatggagtcactaatgtgctgcacacccagcatgtgccaggcactccacggacattttatctcatcctcaccatatggttgagtaagctggcagttaagtgccttgccggcggtcgcatagctggtcagggcagagcagggagaggtacctgcagcctcaatctgtctactgaggccgcagtgctctctgtcgagcccacacccagtgatttgacagccagaggtttctagaaaaacattctgctcagttcctctcacagagagggagatttagacagttgttcctgcccttcagcactaagggggactggatagcgtgagctgcttgaagcccacatggcacatcacacttatgcccagccccaatgcctgagacccaggttccccagtcggtgttgccatgagagccaacgctgctccaaagagcagctgctgctcctagaccctggcaagtcccaccttcccggtactgggcccactatcaacaggcaccttctccctcccctccaccccagcctcagcttgcaaatcctaggagcagctgaaagctacctattcagtcagtccctcatgagtgtcacaagcatacatgagcacctgccatacgtaacgcagtgcctgagtacaactcacacactctgttcacacgtttcctctcttaaaaatcactgaggaccccaaacagtgtttattatgtgagatatcaatatttccttcattagaaattaaaactgagaaatccttaaaatctgctaacactttttaaaatgataataaacccttgcatgttaacacatataatgtaattttatgaaaaataacttgtattttccaaataagttttaaatggagaagagtgacattgttttacaaagaaatgttgcaaatctctctaatatctggcttcccaagacagctggattatcttacctgtttctgtactcagtctgttgtgatgtattgctttgtttgaaatgtaggaagaaaatctggcctcccatagaggaaaagggaggacatcctaaggcgatctccctggggccttggcctgcaaaccactgcgcttgtgcagtgggcactgtacaacagggggctgcacagccgtccccaccttgcaggaatttacagtcaaatggggtgggagtggggtggggagggaatagggggccatgggactgggtggaggggggatgtgccatcaataaaagagcaaccgtctgtggagaatttaaatacaaatataaccaaaagctgatctgcctgtcattatcacaattataaagaatgtcagccgggcgccgtggctcacgcctgtaatcccagcactttgggaggccgaggtgggtggatcacctgaggttaggagttcaaaaccagcctggccaacatggtaaaatgccatctctactaaaaatacaaaacattagccaggcttggtcatgggcacctgtaatcccagctacttggtacgctgaggcaggagaattgcttgaacccgggaggcagaggttgcaatgagccgagatggcgccgtcgcactccatcctgggcaacaaagtgaaactccatcccaaaagaaagagtatcagcgataaaggcaaagctctttccagaaaaaaatggttttatggcctaagttctaaacaatctccgtggttactgttggattttatgtagtaagtatatgtaagcttcaaattcatcacatctttattatttatcctttcataaatattgtgttctacattgacattaatctggagaactcccggttatgcacttggccccaacatgcacagactcaggggcgtgttcttgttgcaagagtaagtgtgcgatggttcagatcctttgacgtccttatgtctccaacctcagtggcacttattacctgcttctgcatgtaaacagtagatttgaaacaaaaaatgatagcgtagtggttgtacaaacaaaaaaccagaacttgaattatttcaattctctcatcctaggtgacccctgtaagcttctcatatgtgtttaaaatttaaagcaacaaaacagattgtgaacaatgagttgtaacatcttgtttgataggtaaaaatttggactcatacgaaaaatatttttactgcatttgaatatcttaaagttaaaatgtatttgtctttttaaaaattgttcactgctttataactaaagaagaaatcgagaaagtagtgatgattgctgatttttacataaatatgactgaaaatacttttgtcttatagagcagagggtcattaaaatgatccgttctgtgtgtcaaatacatgaggtataccactgagtcacatatgtaaatgttatcagctagaacagaacatggcatgagatgaggaccatgagagaggaatgagtagagaagcagattttacttccaagtggagggaagaaggcttcttggaggaggcggcatttgagtagggtgttgaaggatggtatccggacagaagagaatgaggctttccttgtacaatagcagaggtacacagctgataaagtacatgtgcttttcaagcccaaatacctttcaaaaaagaccatctaggaagaaaaagaaaaaatatcccatagaacggtgttgatagcaacacttgttaaactgcaacaaactggaaacaatgtgaatgcccaagtgcaaaccactgaagttggggactccagctactgctaagtccaacttcgaacaggcatggttttgaatacctactactagaagtcacagaaacttttgggggcaataatgatgaagttcagaaacaaaagcctattgctggcccctaagcactcacagtttaacaccagggatcttagcacagaggatgggtttccaagagtcgttgagcctcctgagatggtgcccaaggctgtgtgtgtgtgcattttgagtggggagcaggtgtcataactttcagcaaattatcaaagggacctgtgacctctgaaaaagctcagtaacaactggtcttgcagctttgtaaaacaagtataagaaaattgtatatgcaataatgtagggaaaaaaaaacaggactaaataatctacatgttgaatcataattatgaaaacactgtagacacatgctgtatattgctagagattctaagtatatttaaagatatataaagggttttaaggtttggaggatttaagtacttaaatgtacaagaaaaataaaataaaaaggccctgatcagctacagttagattggtcatcccaagacgacccccgggaaagggattttccactgtccttccgacctgccaccagcacccaactttgcaggttcagccacactcaaaatcactaccccagcagggtctgtcagatttctgagaggcctccacagttacatggaatgtcacccatgactaatatttgagatagagtccggagatgaaactcattcttccaagagtgcgtactattctggaatcagcagagggccagcccccagcattccagggaaattctatctttcccatgcaagagaccctcccatccatggccatccttcctagccctacagctgagcaggtctgtggtcctgctgaaaggtccaccctggagagacgggggacagcagcctgtcctccactctgcttgcctctcacagagacccaggactggaacccatattctttcattctgagctggagagagaaactgcagggctgacggttgaaggcatggggtctgtaagctgacccgaaaacatgaatcgccaaatgagtgcgcagccaaaagccaagagaatctggtacctggctacccacgatggccctctccctgccctcctctccacatcagctgccacagtgctgcgggcatgctgggtcatcacagttggcacagcagggagagaggcagaaagaggctgggccccgagacagggcagaacagtccccatttcatcatgaggggaatgtaaccacccaggcctcagcctgggtgtccctgacagccacgggctccacgtagaacagaggtcacagcgattctcacagccaggaaggtactgtgcgctggcccccaggacagtgaccagtttcgagtggggcgctctcagctgggaaatggggtccaacccaccagggaaaagggctgactaggggccaataggaccctccagatccctgcccagcaggctggacttcagtcccaaggtgataactagaacaagggggccgagcctagtctgtccagcagcgggtggaggagccgcggtaagaaaggcagtcgggtcttacattcaggtacctacttggggcgagaagaccaaatccagtcactccagccctggaggagtcagggcgcccacccggctgccccacagaaggtgcaattcctaaacatggtcacaaagtagcgcagtgacatctcagctgcttcggagttccaggagagggtttctggctcaggagaatggagtttctgggtgactggaagatgaggctgttggctaacttccctttccttcccacttaggggtctatttccagaagcattcctcatttcattttttccccagtggggcttggctaggggtggggaggcatggggaaaaagtgaagagaagagaacgaaatgcatggaatgcaagcggaggcctctttgtctacagcgttttcacctccacttgtgcaggttcatattcagggcctggtgaagtcagttctggcacggctctccagtggactggcagtggcccttaaaaatagttctcaggaagatgtgtaggtggcgacgctgagtagtgtttatgtcccaacatgaagagcaggcctcattgtgtgtgtcctgtgattacaactgtgtgaaaatacatgtgtttgagaaaaaatgctggaagaagatgcatgaaaatgtttatacgtccgttgagtttgtatctgaacttttgtctcttcccctctttatgtaatgttatagtatgtatatggtatattgactttcatgatttaaataatcagaaaataaatttactacgaaatgatgaaataaaggagtttgactagatcagtgatcctggaactgtagtgggtaatgaagcacctaaaaggctgctttttttgtttgtttgtttttcctgagacggagtcttgctctgtcgcccaggctggagtgcagtggcacagtcttggctcgcagcaacctctgcctcccgggttcaagcagttctcctgcctcagcctcctgagtagccgcgattacagacacacaacaccacgcccagctattttttgtacttttagtagagatggggtttcaccatgttggccaggctggtctcgaactcttgacttcgtgatctgcccgcctcagcctcccaaagtgctgggattacaggcgtgagccaccgcccccggccagggcttattaaaataagattctggggccctaactacagagttgctgattcagtgagcctggggtagacttggatatttacgtttctcagcagttcccaaatgatgctgctggtgtggggaccacagagaaccactagagaaaaaacaaaagaaccaagacttgaaactaggttactgacttccaggctagggtgcttcctacagaaacaacacgaggctacagggcaaacctcacttcacttctaactttctagggttgaaggggtgagaatcaacatccactgctcctggatactgacttcttccccagtagctacaaccccaaaagtatttaaaaccccaagatatttgtgaaaatgtatttgtccaaaataaaatatctacatgctaaaaagaaagcagtccttgaaatgaacaaaaattcccaagctgagcattacttgtaattggtagaaaaataatcattgcaaaagctaattaaccatccaccctgagcggctccttggcaggcctgaaaatatgatcaggaaaattcttttcctatgagtgaggcattatcaaagcagggcagagcctatgggttatccgttgactaggactgacctttccgtgactgccaaaaactttccagtgacaaatgttccagcttccttgtcccaagagaaactaaagtggtaagaaaacaaactgctttatactgaaacataacaagatcaacagcagctgtgacagcatttattaaactgtccgctgtgtaccaggccccatggtcagtaggaaagtatatccctgagggtacaaaaatgaaaaagcgtacatccactcaccaaggacttcccactgtgccagggtctctagccccttatggggtgtgtgtgggggcagggaggttggagattgggagaggcgcataatttcaacacaatgcaattagtttgtaaataacactacatgcaaaatgttacaagagccctgaggcagcgcaggttagctgagaagcctttacagaggaggtgatatctgagttgaatcttgaagtttccttcaagaagtggaaggacattgtaagcagagggaaaaaaaacatgaaccagccttgcttgactcagaggctggaaaagggagagtgaagttgggaattcttgagattttggggtggccctggatggggtacataaaaagaagtggccagagggaaggacaggaagggccatcctcagaagttttgtcctcatcctggaggcagggcagaccactgatgaggggggttgtttttaaaaggctgcctttcccagatggattgatagacttatctcagcctggctaaaaccctggccactccctgatagagaacaaggttcccagcaggcaagggcaggggtggggcccagcagggaccagttttgcaagctcacctggccctacacccgcaaacactcagcttttcctccaagacaagcctcaaggcttggagcaagtctctttgaagttttcttatgaattgctatgcttaacactaaatcatgggaaagattaacacccatgaaactgaagcaggagcacataacaggagcttaatatgaatcttccatcttaaaaatatcttattctacatctgaaaagagaaccatttggaaattccacgtcatactcacttatagacttaacagcaatttcaactttaaaaattcattcccacctgcattatatgacttgattcttacagtagccctgtaaagaatattgggtaggaattcttattcccattttagagacgtaaacattcaccatccgcggaccatggggaacacagctgacatcaattgcaagtcagtttctgtggtttactgcagcaagggagagctcactccagacttgggcttgtgctggttgagtctaaggaaggggtggaaagcaaggggaattctggattggattctgtcaaaaaggagtccaattcaatgattcggcatcataataatttaatagttatcactaattattatttaatataatcaataaatgatctagcagatgggaagatgaaaacagggctgagctggctttgatacagcaacacaagtcattcctgttagtcagaagagggaaatgtttagtcatgttttttgattttggagtggcctcctccctgtcttgatgcaaacacagatgtggagggtctgtgctgcacatgtttctgttcggtgggcattgtctctgttcacttgtgaatattatggtctggctgacggcagagctggtttttgttgctgtgctgtgttttcgtgtagtctctcccaaagggacttggggaatgcgtttgaggtctcttaatacctatgccctagctgcacagctttgggtgatgccctttacctccttacctctgatctctcaggagtaatagtgtcccttccacactgacattctgggtgtgaatgggactgattagaatggtcatcgtggtgccaggagatctgcagtggtgaccttccctggtatcagctatttaaatattatcaggaaagagaaatgtggaagcaaagttctatccattttaagcatgtgaccttttaccctaactgaaccttaattgactcatttgcctctagcaattcaaagattcccagacacccggaggacaaagatgggattctgtaagaacagcccacgcagtcaatgacccttatgccatttcttgcccggaactgttttattcagggcctgacatgcagcagtgtttgattaagtgctgacaatgaaaataggtatttgatgctgtttggaagaaaactcttacatttcttgaattgaactaagatgtacagaacaacagaaaccattatttttaagaatatttaaatgtgccaagttctttgcctatttatgtcaatgaatccagaaaaacaccctgtgagataggtattatccccacttcacagatggggaaattgtggctcagagtgttgcaaactctccttagaccactcagctaataatttcctctctggtatagctgaaacatgggcttgcctgaagggcagaggcagaagaagcctccaagcctcccaaggtcctgtgattctcattgatgcctacttctagtggttctggtgtccctctcagagcccacatgggtatctgagccttcagagatatctcatttggtttggggggttgtttttggtttttctgagtctcgctctgttgcccaggctggagtgcagtggcgtgatctcagctcactgcaatccccgcttgcagggttcaagcgattctcctgcctcagcttcccaagtagctgggattacaggcatgcaccaccatgtccagctaatttttctgtttttagtttagtcggggtttctccatgttggccaggctggtcttgaactcctgcctcaagtgatctgcccacctcagcctcccaaagtgctgggattacaggcctgaaccactgtgcctggccgagatatcccattttggataggggagcctgggacatattctcaacttccgtgggtctggccactacttatcagaagtttctgctcaccttacacaactgtgagtgatggccaggagcagcctcagtggcccaaggggaaaaacctctggatgaagccctggacccctcacatctcagcctccatcactgcccctggctacccaaagtcaagcccagaaacacagatgtgagcacaaacccaggcagcccatagaaggcacagccctgtgatgtcaagcttaaaaattctgggctacttttaaggtcaccagggatatttcgaaagagctgaagctttttcctccatccaagaatcctctatcttccaggttgtttttatgagctgaagaggaccctccacggctcctcggtgacttagtagtatcaagacaacacctgagaaagctcctttcatgcaaatctctgtctcacgcatgtgaagagaccaccaagcaggctttgtgtgagcaacaaggctgtttatttcacctgggtgcaggcgggctgagtctgaaaaaggagtcagcaaagggtggtggattatcgttagttcttacaggttttgggataggcggtggagtttggagcaatgttttgcgggcagggggtggatctcacaaagtacattctcaagggtggggagagaattgcaaagaaccttcttcagggtgggggagattacaaagtacattgatcagttagggtggggcagaaacaaatcacaatggtggagtgtcatcagttaaggctattttcacttcttttgtggatcttcagttgcttcaggccatctgggtgtatacgtgccagtcacaggggctacgatggctcagcttgggctcagaggcctgacagtctccttcctgcctgcgacacaggtctaggaattattccacagttgggcactcttggtgtattattgttcatgccctggcccccacctttgtgccgcatagagggactccccttcctgaggttaatgattgggaaggtgttaaagcaggaagaactgcaagaaggcactcgtgagtgagcctatccactcattcctggaagataaacaaacgaccagtgtggctctccatactcagagggtggtttctggatgtcagagatttcgccacacaccagctctgtgccaggccttgtgctaggaccccaacatggtcactcgatattcacacagtctagcagtctgccaggactgccaggacagaggaccacagactgggtggcctcaacaacagaaatgtattttctcacagttctggaagtgagaagtctgaggtcaaggggtcagcagggtgggtttcttctgaggcctctctccttgtcttctgatggctgcgtctcttctgtctgcacacagtcttctatgtttctgtgtccgatctcctctttttataaagaccccagtcatattggattaaggcccaccccagtgaccttatttcacccaaatcacctctttaaagactctggctccaaaagcagtcacattctgaggtactgagggttagaacttcaatgtatgaatttgagggaacacaaagttcagcccattacacccagcaaacactttgctaggccctgctgtgacccgggtcctgggcttggcactgggcatacagtggaaactgcaaatctctctttgttctatttgagcttcagcaactctccggaagccttccgcgttagaaaaaaggcttacaaatacacaggaaatttgaaagtgagtagtaagtccacaccaggcccagacagggggcctgtgctgaaaggtgcaggaagcagcagccctgctgagacacacaggagccggctggccggccgctagcagggtgggatggggagtgggggctcagggagcctgggctggggagaggcatccgccctcttcaacagaatgattgggactttctggcagcataagcaataaccggcaggagaccaagaaggcgccgtttagctggctcatgtgtgagtgagtgatgaaactcaccctctggcttggcgccttatggaactatcaactctgcatgggtgtgctcagtgtggaccccaaacctgctccctctggctttgagaggtatttctcccatacaggctggcttcagccagggggttgcctagactcgcccaggcctcagacgaggggaaagggccaaggccggctgccactttctcatcatgtgcctgcctcccttcccaaatagaagggtcaagcccaaattagaagggtgggatgatggctggtgcctgaggacagagctggggctaggaggacaaactcctgggctcctcttcatgtctgggctacaagatcctggcataaacaggggctcctggcacagcggaaataaaccatgggtccctgagggagactctgggtgagaaaagagacccagatttggagttgaaagacctgggcctgagtcccagctccatcacttcccagcacgtggccttgaacaaatcactcaaggcctgcagacctcggtcagtcattagtaaagagaagattactattatagagaccccactgggctgttttgagggtgaaatgagaccacgtaagtgaacgcactttgaaactatccattgctggtcacaaaactaacgtgtgtacgcatctatttactaaatagtcatataatactcacccgattcatatgctactcccagtgtttttctctactttttattacaaaagtgttcaactacagaaagaagtttaaaggatacaatgaatttccatattccctccagatagactcaataactgtttgcattttcgtatatttgctgtatgtgcatatttatatgtgtgtgacttgtaaaaccagttgagataagagggggaaaggaagagagaaaaagacacacacatacatatcccatatgaaagttgtggacatcatgatacttcaattctaaatatttatacgctagtatttctttctttttttgagacagagtctcactctgtcacccacgctggagtgcagtggtatgatcttggctcactgaaacctccacctcctgggttcaagcgattctcatgcctcagcctcctgagtagctggaatgaatgcctcttactaaggacattctcctacatagccccagtaccatcaccacacctcagaaaattaaaaataattttatactatccaatatccagaccttactccaattttcccagttgtcccaagatagttgttgatagcgtttttcagactgggatccactcaagatcctcctgttgccctgtttgctgagcttctgccatgtctccccagtgtctgaggttgtgagcatcttggttacttgctgccaattctcacactcatctgtgctgcccaccgtcccatggcctcttgcggacctctctcccatggcgctggctccttgcacccagctatctgcttgcacacctctctccctgctggaggataagcaccccaagggcagtggccagtcttagctactgttgtttccccaggacccacacaggcctggcatggagcaggcacgtggcaaatgactgttgcatgtttgaatcttcatcagagggctaagcaacacacacctttaaaaagtgagtgagttttggccaggcgaggtggcttatgcctgtaaccacagcactttgggaggccagaggcaggcagatcacttgaggttaggagttggagaccagcctggccaatatggtgaaaccccttctctactaaagatacaaaagttagccaggtgtggtggtacgtgcctgtagtcccagctacttgggaggctgaggcaggagaatcactcaaacctaggagggtggaggttgcagtgagccgagattgcgccactgcacccagcctggacaacagagctagactccatctcaaaaaaaaaaaaaaaaaaaaaaaaggaaatgagttttaagtaatttcatctgacaaattctgtacccctgccggagctcatggaaagcatcccagagacccaggtgacctagctcaggccctgccctacttccccatctacaagtggccactggggctctgaaatcgcttggactctcgactagtctgtgctcgacatctgtgacaggaccatcgactgagagggagagctgccctccagaccacaagtcttctctggaaaacacacacgtatatgagaagttggctgtgttcccattataggtcttacagaagtgattccaagtcttgtgagtttctgtggaaccagaaaaccacttccggaccagcaggagtgagaagaggcgcatgcatatcatgtttgcattgttttcttgcatgtgtcacttcaccacaatgctcaggacctcaatgagagttttaagttctcccagcttcaaattgtgctttccaggccagagcttctcaaaatttaatgtgcctttgaatcatctggagagcttgatacaatgaatgtttttttaaaagtagatttgggatgggctccaggatcctgaattcctaacagttggtctgggtgacgccagtgccactggtccctgaactacactttgagaagcgaagttctaaaggtcacaaaacaacttctcatttcttcagtgaactggtaattagcacctacagctaaatataaggcagtgttctagcattggaggaacaaggaaatgggaagaaatacaaagaagaataagacacaggcctttgactcaaatccaactggatatccctttatactacgtctagcattttgcttaagtgggacctaaaaagttactccaagctgcctcccctagggtcttctggctgtttctggtaatgtgtattcctgctgatgctcaagccctttgcaacaagttcctaacatggtatcaaatactgggcacactagcaaacttcagccataaattagggcccaaatgttgtcaccaaatggctgtgtgactttggataaatcactctcctctcacgtggactagggttgggagctcttcaagtcccttcctgtctgccaaaaggtttctaagcagtttccaagccgtttcttgcagttttcccatcaagccaggtgaaggcaagtgttatgtccccatcagggtcccccagccccctcttcttagctcaggactggggctttctggggctcacctacagtcttcctcctttccttcctaacttcacacgcatttatcaagcacatactctgcatcaaacctgtgctcaaggacagggaggcaaaggtcaataagatgcactccctccctggggaggagacctaaaacagaccgcaggtgccctgctgcgtggctggctcaggctctcagagtgtgaaggagagcacctcactcagcactggcagaggccggcaggcctaagtgggccttcaccatatgccaggcctggctaggagcttccctggaagattccaggtgacgcccagcaaccctcaaaggaaaatgctagtattgtccccattttaaaaatgggaaaacaggcttaaaaagtcagatgtctggcccaacatcacacagctaatatggattcagtgaaatatatgcaaaaatactcagcagagtggcaagtagtaactaaacggtaactaaaatacctttttcaaatgacagaacagagagtgggggccagtaatctgcactctcagacaaaactgacaagtgggagaaaggcttgtctcccctgaaggacaaaaaccaggcttgggactggccacacatgatgagaaaactgtgagaaaagaagcaggagagactttggaagagggcttggcaggccggaaagcgctaggtgcacacgacgggcagtgggggctcaaacacaggtgggagcccaggggaggagggagcgattagtcatgctggggaggctccaagggccctttgtccttcctagatggctactcagacgccagtctgcgagcaccccacgctcagctgctccatgcttcagccaccatgcaacccatctggataatggactgttatgaagcatgttggcagccatcgattaggactaaactctatgctcattgggttgtatttgcaaggatgctctgctaagatccacagcagaggtgcatctctctccttctcatttgatggcttggaattaaaatgccacccaacattctctgccaaagacatgaagatttatgggtcactgtcaatatcaacacatgctggccattatttgagtctccttgctgcttgggactgattgctatttactttgaaagataaatgtggctttgtaatccatgcaggttgctgggaggaatgggttttaaatgcatttgttcttttttttttttttaagacagagtctcactctgtcaaccacgctgtgcagtagcacgatcctggcttactgcaaactccgcctccaggttctcctgcctcagcctcccaagtagatgggattacaagcatgcgccgccgcaccctgctaatttctatatttttaatagagacagggtttcgccatgttggccaggctggtcttgaactcctgacttcaagagatcccccctcctcggactcccaaagtgttgggattacagacaggtgtgagccaccatgcccggccttgggttttaaatgcatttgtttcttcccttggagacctttctattccactccattctgctttgtctggtgatgttggtcccaccctgtacccaccatcagatattctaatgtcctccgaggctctggaacaaagaccagagggaccagcctgtcctctgtccagagtcatcagtatgacagtatggagagacccttagcaccttagtagaaaaattgcccctgtcttatggggtgacaccactcatatatgatctggggcaagagtcaagacccccaaggagcttacttaaggagcaataggttgtcccctttgcctcttctggtctttcgcgtttctgagcgtggtgtggaaactgagtcaggagctaaatcaattaggtcactggttctcaaacttgagtgtgcatcacaacccactgaagagctttttaaaacacagattgtggcccccactctagagctcctgattcaataggcctagggtgcggcccaggaatgtgcatttctaacgatgtcccaggtgatgctgattctgttgctggtcctgcatcccacctgaagaactgcctcagaacaagagtgggaagcattagagaccaatcatgggagagatgaggctgctggcagtgtttggcacttgggaaaaagaacagcaccgtctaaaggagaattttattaagtttcagtgaacaatgtgcaatttaaatctttttgtaggaaatcgtcagttaaaggtcaatttccataagtatgtggatctatgtattttggaaatgcattgaaatgttacatgggtctgggaccacacaagctacccactggtggtctgctatacctaggtactaggaaggtcaaggtactgagtaggtcacagtcttgccaccgggatgctttgctaactttattgagtgaaagtagtaagaaatgcctggtattgataagagcccaccgtgctagtttttaccaatggtccctaagcgattttccctgcagcagtcagggtttacaggtaaaactgggcccagggcaataaaggggtacagtctaaggactctgggagtttcctgatgaatactagaggtctttggaggcagacaactttttctttgcagcgggacttcacattataagccatgatgaggctgcaattgcgatttatcagtgctgccttccttccccaggcaacgtactaggaagaatcatggtttactgaaggcaggctaccctccccatcaaagcctagtggactgggcaagcaatcggttgggattcattacttggaggcatgtatccccagagcaatcaaaggccctgaccggcacaggattgggaggctgttgctgagacccaggcctcgagtgacaggtagagcagtggggtggaggaaagtcaacatatttggagatacgaaaaaggcaggtaagtaattgtattcgttgagactttgggtcacaagaataataatccaaaccaaattaacttgtggggaatttatttactcatgtaacatagatgtccaaattataagcttcagggacagctggatctatgaccttaataaagtcaccatgtttcttcattcgctccccacccccttctcccttcataacacttcagagtgccagattcctcagtccttggaactcaaacttccagagagaccacacttcatcacatacctatggcacatgttccagaaatgattctggccaggtgtccacccctgaatagatggccacaggcaggagaatgggatgtctgattggtctgatttgggaaacatcctatccaccacttggataggatcaactttacccaaacaggactgatcaggatccacatgggaggttcgctcctttggaggaggagatgccagcagaccgtggaggactggctgtgaggcacgaggatgagcgggaggcaagggcggctcctgcttccacagaggcgagcaggaggatgctcctgccctgctcacacagctgtggctctgcaccttgctccccgctagaaggtgggctatcgtagctaagctacctgggcagagcagacctcgtgagtgtggggaaaatcctgggcagcataacagactcatttgtagggcaaagggattttcagttagttctgtaacacactggagaaccaacacaatgctcaagcatcgttcctcccagaggaagcagatgggtgagataaataaaaccacactttcattggcatcctaggatgctcggggccctattttcaaggctgtgtatgttgaatacacatttcagtgatgctttagtctattccacagtgattctcaaattgtggcccccaggccaacagtatcaccatgccccgggaacttgtttgaaagacaaattctccatcccactcaagacctcctgaatcagaaactctgggtatggggcccggcagtctgggttttaacgcaccctctgggtgattctgaaacaggcaccaaagtttgagaacgtctgcctataaatgtatttgatccaatccatcaagttcaaagggaccacctactataaaaactaaggcttatgttcagggtttattgagcagtctgaatttagaagagtgtgaacgtgaaacagttttctatttctcccattccagccttcagccacgcactatcaagttatatgcttccatccctttatagcatcctgggcagattcctttaacttttggtcagttcgattattaagttattttactttattctaaagcctcaatctcacatctgatttgacattcttcccttctctcatgagctagactcaaagaagatggaatctgcagtggggaggggataggatagttctgctctttcactcctcttttctctggagcaccgtggggtagggtggagtgggatggggtgggagggcagggtgaggcctggtcctgggattgctgcccctcatttttcagagcccaacccccatgggactgggagctggtagtgagggtacagctgggggacacagaggtcctcatctcttgtgagtggtctgctcttgctctggttcactgtggtcccatctgctgctggtggccttggcctgtgaagatgtggatgtggttttctgagggccctatcggtgtgagcccagcccatttgtcactaaggacagctgtggccccttttggcttctccaaaggtccatgcccctcctactctgtcctcctgtacaaagtctcagaaatgacttcggtcttcttccccgcctctgaggattgatgggagctgaggtgtggggacccatcccctcaggtacactgcctcatagtatttcttctccccgcttggctgagcctcctctcttcagatggctaaagcaggcacaacccccacgttgccacacagtcccataaactcctatggatacaggtcagtctctctccaaaactccatcctcatatccccagcaccacatgggacctagaatagcaacgtctcagccagcatacagcctggaacaatatgaccatttctgcctcctgcaggcaccctcattccgcattctcggtaagtgattctaatcggtcccccaacttgaactctagagactaacaatgggaagaagagaactaaattattctcccagcaattcctactctccctctcccacttgtctgtctaacatgggctgggggaaggtggtgatgggaatagagactgcttctttgagagccctggagtttgaagaatttggccccagttgctggcaactctcattacagagtgtgggttccgtacattggcgcggtggcttatgcctgtaatcccagcactttgggaggccgaggcaggtggattgcttgaccccatgaggtcaagaccagcctgggcaatatggtgaaatcccaactactaaaagtaaaaaaaaatcagccaggcctggtatagtcctagctactagggaggctgaggtgggagaattgcttgagccacagagagcgaggctgcagtgagccatgatcatgcacagcaagaccctgtctcaaaaaaaaaaaagaaaagaaaagaaaaagaaaaaaaatggatagaatgtgggttccttagcacctgttgtttcagcagatgtcctggtgccacatttgctatttgcaatgcgtcttcacatacattatctcagttgaccccacagtgattctgtgaggtgtttaacctataaggaaacaggctcagagagattaagtgacaagcccaaggtcacacatgcagaggtgatggcaagatgggaacccagcccagtgactcctgagcacctgttctctccctgctgtttcatgcaggtgcctcagccacacttgtcttccagctctgggtgaacttggagcaaataaccagagaaatagcttgtctccaaggccacagagcagctggcaggggagagtttggggcaagggatttccttagggaaaacaccaattcgttctggtcatgcccagtcacatgggtcccaaccatcaccttcccaggccaaggtcttaggttcccctggaacccctttggctttactcccttcctgggctgggggaaagggtggggatataagctggtacttccaaagcagaaagctggggtttggggctgacagagccgaccttgagcttgagctccatggagtacccagcccaggtcaaatggggtcaggaagccatctgtgccttctggatggctctgtctgaatgattcacttctgcctatggtgggtggaagttcatggttttactcccacatggtgaccacagtgcatggcaattttctagtcaacaggtggggttggggcctctgctacacacaagaggcttctttcttcaagtttaagacttctgatgctcacaagaccctcccatgcccttaccacgtgcagcgctcacccccagggcctggggtttggtgagatgtgtcgcccacatgggctgggatcatattttccccagggaagatgaaagccctcaccctctcacaaagccaattgctaaattttcaagaattttgcaagctgatttttaaacatagccattattttaaaattacattatagaacttacaatgaaacaaatgtttaaaatgacagtaataaatactcaaaactcctctgttctcattttactattgtctctgtctgtaaggttatttccgtctgtcgtactgtgtggtggaaatactattcaatgatacaccaaagtgaatctcttcccaactccgttatcagtaacatcacagtgggagcttaacagcagccatgatggctgtatttatacatggacattggcaaacattatagattagggtttgatgtattgttttgttgactgtgtaaagcaaggttcagcaaacttttctctgtaaagggccagacagtaaatatttttccttttgtaggccataggtgtctgttaaaactactcaactctgctattgcagcacaaaagcagccacagacaatagacacacaaatggacctggctgtgttccaataaacctaattcacaaaaacacatggtgcaccagatttgtcaggccatggattgctagcccctcatctagacttaagagagccatagaaaaaaaatgttagtaatgaagattaaatttagaactgtcccaattgtaactagcacaaaacattaaggaaatattcttccagtgctcaaaaacaatgatttgattgagcaaagaattcatgtcattgttgaatgattgagtttcaatgtgtccttatttcatttttgtcttcttcattaatgtaaataaacctgtcagccaacctacacttgtcatttgccaccataggttgactagtgagacaagggtccaacaaacatcagcaaaagtattctgtgaaaatcaattgctatttggagtttacaataaagaatactgtatatttcattattatttataaattgtataataccttgatagcaatgaaatgcacaatatatgcatgtatgcgtgtatatatatatgaatatattttcttccagagagccagttgctgagtatccaccaatgcaccactgcctgaggggtgtctacataaaaagagacctaacagcccagagcagcacttgttaaggacccaaggcatggtccagaccccaaggaagggaagggggtcagggatggatagacaatctggaaagttctccaaggtggtctgagaaggcttcatgggggacagagagccgtaaagcatggtaggactcaatgacaaatgaagaatggctgtacttcagacaggcacacagcatgagcgcaggaggcgaggctgaagtcagggacaccgagacaagagggtgagcatagggaagcagaagggaatgaagtggggtcaaatatatgtaatggcatggaaacatgctatgagatcaagccaaaagaaaagaaaaagtagaatgcaaaattttacatttgcattaaggaaaaaacacgttagaagaaaatgcacttaaataaattgctctgtgtgatagtatgatagctgattatgtatttatcctcaatgctttctgtaccttcctgttgttctgaagttgtattactttgatattcatggggaaaaataagcttttccagtatgaagggcaaaaagcactgagccaaacctgaagccatagctaaggacagggcacatctcccctgatgcagcccagaggcccctggagggaggtgctggggggtgaatagagactaggggtgtcactccctcctaggaggactgcaggagcacatgggtagccaatgctaaggcctcctgcccccatgggcctaagtagccctgtccacactggggatctgcccgctacctcatagcctcaggtagatgtctggtctctctttgcaaatgtcccccgcaacccatcacattcataaaggcaacaaattggggaaaacgagaggtcctctgtctttttagggcttcaccactgctgttttcccaactaaagaaatatgtacatatgtttaagtatactttaccatgcgtagaatgggaaaaacagaagttattctagagaacatctcgctcaactcgtttattttactaataagaaaatagaaactatggaggtcaagtggcatacccagggaaacagagctaagtgagaactaggctccagcagagatgatgcccagggccgggcacctcctttgtcagcatgcaggtatcatcagacaaggccaaaacagcactgggcgatgtgggctgagcagcccttggcttcgaaaacatgatttttttattattttttgagacggagtttcactcttgttgcccagaatggagtgcaaaggtgcgatcttggctcaccacaacctccacctcccgggttcaagcatttctcctgtctcagcctcctgagtagctgggattacaggcaggcaccaccacgcctggctaatttttgtatttttagcagagacagggtttctccactttggtcatgctggtctcaaactcccgacctcaggtgatctgcccgcttcagcctcccaaagtgctgggattacaggcgtgagccaccgcgcccggcagacatgacgtattctaagcactcctcaaatttacctgtggacagcaagaaggcctacaaggcaccccgtttacgatatgccacttggctccttcagggcagagctgcagcagcagtccttgtttctctgtgccccacatcccctcagcatgtaagaccacttctgccccacccattgctgaatgggaccttcagatgctatcttctccataaagctttctatgactcaggccgcatcattttgtggtcaactactttcactattattgtgtttattctccctaaaccagccaagcaatcccatttggtaatcgaaagagcaagtagcactggcttggtcatttccttcacataaacctgactgaactggatatatggtaaggatttccatcttgtacataaacacttgtccacctccgtgattcacacaattccttttccactctatcccgggcccatgtctccatcctgcccctgatgctggctctgcaggcattttctacatggctgtctgtgtacatgccgtgtggttagtcttaaatcaagggctcctagagtgcataggacataccagtttatactttttctcatcaggaatatgtgtagctggaggattaagaaatacattttcatgagctagacaataacaaaaattaaatggcaaaagtccttgctgtccttagtagctagggagctttaaaaataaatacataagcacctgtttccgtttttttactcctacagaagcagggaaattgctggagaaaaaaaaaaaatgtaagtccatatattctgtactgtgtcccttggaagaataaaattttaaatgaggtcatcaggaagtgcttcctaaatgtgaagttcacagactgaactttgaagtttagcaatggacttcccctgagcaaggtcggcttatgctattgttagaccagcagctgagcctcccccaccacgtccttctacctcttgcaattaaagcacagcccaggcaggtttttcttaaacaggatttttctttatgttggtgcatatgctgctgttataatagcagggacattgtcctcattcccagctctttcctccaagtcaaaacatttagaatgacaccacccaaagaataagtcttacttgaggctttgcaacctctaacccttcccacctctaaccttttcccatctttatccccgttatcttgggtgctttcagttttcagagaccagctttccaacagggctaaataacactctatggtttctttccccatcagaaaccaaagaactccctgtttctcagcccttgccagcagaatctggtcacccctctgcccctcaaaattacacatcttatacaactagctcctgtccctgcaccattcctgtcccttgtccttgatcctggtttcccagtggaacaggaaaaaggttttacagagggttttttgccaccatctctttgttcctcaggagatgattaagttgtgcgttaagtggggaaaaagtacattaggtcaaccccaaaatctgccatcgataacatcagagtatgtccatggctttattagttttctagtgaatatttaagagaaaaaggtgctaggtcatagaacattgagaaggctatacatctccccttggctataggtgcaatacattccaagagggagagatggtagtcatgcctcctatttttttaggtgaggtatgtattttgtagttctgctgggacaaaaacagctttcagtcattgaaaaccaaaggcccagtggacatcaggaggagatggcctccctcactgcaagacgacctctgggtcaaagcctagtgaaactttggcttttcccagcaagcaggaagtgacatagacagtgtctttttagagacctcactttggagaatgctcagtgaggggcaaacatttgctggtgacattgtagttctgtcctttgctaagcttgagtgaaaatcttttggagaatcgacttttttctttcttttttttttttgatgtcccttagagagctcacaataaataaataaatcaaaacaaagctaaaagttcataaaaaagtctcaggcatggtccagattttcaggaaaccagcagtttctggaggaagtcccacccgctcctgaaaacagaaaaaataaacgagagagagtccaccagcaaacaggtgtttagtcttctctggagtcatattaagcaatttttacatttatggaaaagcaaacactccccccacatagggtgtggcccacactgggattgaaaatcagcctcgtgctctgcaccgtgttctggtggcttctgcagctgtcacaggaaggaatccacacccgtccccaaggacgcctgcacgggaacagatgcccgctcccttaccccttgggggaaggacagaggtatctgagggattcagccctgggcactcctctcagcttcctccttcacaggcggggccctgggaggccctgagtggggccactgcgttgctatgagatcagaacggtagccagttggtgggtgcagcaggctcacacctagcaagaacctacctctccctttttcctaagaagggaaaacaactctcaaggctcaccctggaggcccaaagggaaggctgtatgggtcccgtactgcagcttccaagcccacggtggttacgtctgagcaccctgtagggctctgctctgaaagtcttttcagctcccaatgagcattgttcaagccgatgaacatccccaaaacccttccactctcagggcctcggccccacccaccacctggcatctgtctttaaggatgtttataacagagttctgaaataaagttttggctttttcctggagttctaactctgcaggagaagcagtgaggtaggactttgaggaattcaggaagtggagaacagctcatggtgagaggaaaggctggggccgacttgggatgtggatgtgcaaaaggaaaggtgaaggctggatgggaggcagggtgggcacagttaaggtgggccctgggccaggatggcctcccaaccagagagtagccttcaacatctcagcctcgtactgcgtgccagacactctaccaagccctccacttaggtaataatcacgtcttccaccctcactctcaccctgtaagggagctcttagaataacgctgctctccacggctgggaaacccaggctctgatgggtgacatcacttgttcaaggtcactcagccagtaagggccaggctgggctgcaaactcaatggcccactgcagagctcacacaggtccatttcctactcgccatgatgttttccagggagagtttagagaagctctggagctgggaaaagagggcagctgttagagaacagccagcgagaatgggaagtcaggagacccagagctcaggaacagacttccttggcaggtggcgtagtcccatggcctctttagctctcagttttctcatctgcaagaggacaatgggccagattggtgcttctctgagagaaagtaccagtggttttgaccaagggactgacccgaacatggcatgtaagaggggtttgtttggggttggtccacaggatggttacagaggaaggaagaaagccaccaaggccaatttgaagatgtgcagaaacccagaagtgaggtgaggacggcagttctcaagtgcagagcttgaagtggtcactgctgggagggagacgtcataacaagacccaggaaacacttcaaaggaaaaactaacagcatttaaagattggctgcaatagtaacaataaaaaaagctaacatttactgaaggctataccagttatcccaccaagtgctcaactaccaatcctcacagcagccagctgcaggaattatcattgctcccactttatagataaggaaactgaagtttatagaggcagagaaacttgcccaaagtcacaaagctggcaactcccagagccaggatttgaacacagtctcagtacagagcctatggtttctttgtttttgagacaaagtctcactctgtcaccaaggctggagtgcagtggctcgatcttggctcactgcaacaattgcttggctccctggttcaagcgattctcctgcctcagcctcccgattagctgggattactggtgtgcaccaccatgccaggctaatttttgatttttttttttttttagtagatatggagtttcaccacattggccaggctggtctcgaactcctgacctcaagtgatctgcctgccttggcctcccagaatgctgggattacaggggtgagccactgggccccgccacctatgttcttaatccccgtgcaactctgcctcctatctatgtgccgaagaaaggaacaacactcccctccagacctctgcctttcacacccattggccttggatgcccttgtctccccccggttccgattcccttcaaattccagctcctttaaactttcacaccttactctgtccacccctccacacctgcctcgtgctgtccccccgcccccacatcccactccacccccacagttcaaacctgctcatggaagtcctggaatgtgttttctccctcatcctcagtcccacccatcacacagcctgcactggatcatccaagttacatgccaaatgtctgtacccctctgtgtccaagtgaggcccaccttcctctttgcttctgtcatctattttcctgtttcttgcatgcattgcactgtgttcattatgtctattgttgactgcttgttcatatttccaccttccctataggatcgtgagtgctttgaaggcagagagaggctgggccttagtacagtctgtttgcagcacatggcatatagtggatgctggagaaatgttgatgactgaattgacatgattgattgattggatcaaatgaatgaacacaagaataaatgaacatcgggatccaggaaaggggtccttctggcaccaaccctattctgtccccctaaacagtattacatttagtgtttatgataaaggctttcagcacctttttgaagagttggtaccactggtccactttctgccctgcccttaatccatccaattggtttagatactcacacatacattctttctttctctctccttcccttactggaccccagaccaaagccaaagaaataaatgtcccctctcctgctctgtttccacttagataaattaatcctcagcatgagaggaaccaaagccagcaccttagaagtcaggctcctgtcagctcggtttgctcacctgcacacagcccttgacttcctcctcctgtgtgggaggagcacagccctgactcagaggccactccaggcaatcctctcctcccaggcaatcctataaggaacccactggctgagctctggcctctcggcagagggggcaggcctgaagaaccctttccaagaccagctgagctctgctggtccgctgggccctgcctgcagagttattggcggagttattcttggtgctcattagcactgcacaggctgtggattattcctttattgctaagtggcccccagaacactgcagactcatccctccttttgaagtccttgtaaaagactccaagaagtcgattccaatctcttctctcccagcgtggactgcccctggagcagcactgggggtgtgtggctgttagagtggcagccaagggccagctccccagtgaaaggtgatattgtgcttctaccgcacacctgcacgttgggatggtgtttgccttccggcctgactgctctgttctcatcttccatggacatggaggtgggaggggaacttatgtgtcattcactccagggtcctgatggccacttgcgtagagcaaagaatgttggtagggcctgcagtctaggttctagcttcagtgagctctggggcctcgggaaaagggcttgatccctcagaacatctgcaggagtctgtgacccagaccacaccaagctttcagaaactgctctgctcttttactctcccactcctctccaccctctcaagctgtgctatatccacaatgcaccagcccaggctgactcaacttcccgcccactgctcccctttaagctacagcacccaccattttgccccaaactcgtctatcctacctgagctcctgcagccagactgggtcacccatgcccctcctctaaccaggaaagaaaggaaagaatccatcaggtcttttctgtgtcctgagattgcgcaggtattcacccgctccactcccatctccttgacctctttcttgccctgtttctcggcgacctaggcattgggtcctggtcagttttccacttttccatcactcccttaggacccctcaacctctctgctcatcaaaaaagtccaataaaggcattcatctctttgaatacttaattttacagtacctcttgcataactttcaagtttgaggtcaatacaaataaaatcatttaaaatgtctgatattaaacacttctgacccgaaaagcaaaaagccttttaacagatagttacattgatacaagagtccacaatgacaggtttcaaagatgaaagtaatggatcagtaaatagaacagtagagaaaacacagatgaaaggcaaataaccccacctgaaaaatccaaagctttcattttttttgaaaaaaaaattgtcaaaagcactgtattattttttaaaatcatgataaaaggagcatgcacctgtcaccctcccaaccccctctatacttgcccctttctatctttaagtgctgtggtctttgtggtgactttattggctcaagtttcctaggctggtactctcagagcctggtttcctaggagcagtactcataacgcaggtgcgatggacacctgtaggtgggtagtgccgcctgtgtgaaccaactcggctccaaagagcctaactccctatctgcatggttaatccaatcaaagcccaacctgctttcccacacaacagagttcaacagagcttttcattaaagcaacacatcatagcaaatacttaactagtacaaataaagcattttatttaaagcaaggtttaaagacatataaacattaagcatcagagctccattctttagttgctattcatcacagcttatgccagtccttgaattctgtctaacttgggtagtagccaattttctaactcaccttcaacttcttgggatgagtccttcccgggctccttgtttttctagaaatttcagtggcttgaccacacatcaaaacacacagggtggccaggcatggtggctcacacctgtaatcccagcactttgggaagccaaggcgggcagatcatctgaggtcaggggttcaaaactagcttgggcaacatggtgaaactcggtctgtactaaaaatacaaaagttagctgggtgtggtggtgtgcacctgtagtcccagctactcaggagactgaggcagaaaaatcgcttgaacctgggaggtggaggttgcagtgagccaagactgtgccactgtactccagcctgggcaacagagtgagactctgtctcaaaaatggggagcgaggggggagcccaccacacaacaaaacatatagggcttctcatctaaagtccgaataaaagaataatactatggctggtttgcactggaggaaagaaaagccctatcactgctaccttacttttctgatgttttgggttcctatgtcttatcccctcaggaaccaggggaaaaagaagattctgtgtcaagtgcaccctacatctgtccatgtcaccccccttcttccaatcagaacaactcatttcccccacttgactgctcccctaatctttgcaccttggagcaggatgtgtttattgattgatggatatttacttataattggtacctcttatgaaagccaacagtttttacatctggcttttaacacagactgtgctcttcaatagtcttagtgtaggctgaaggtttttcaaattcacatttttagaaaagagttccattaaattccacatgaacaacagaaaaaaatttaaatgggacattacagtgatcaattatagattgtaggacatgactgacatgtagggctgggctgggaggaagagacaaagaccaaatgctcaaccaagggcagaggtggggtgtagattacgggtcagaaccgtaacataacggatggagtcccaagtgaatccaggaagttggaggaagcaggtaagtacttgggttaggcattcacaggcctaggaagtcagctggggcaggaaggctcagacaaggcaaggggaccaggaagcttggacccgtcctgggaagatagagtccaagagggcagtcatcaccggtcccacactaaaagcatcaaagctctctaatcttctgtcttctctactctctctggtgtgttgtcaaggaaggaataggtacgtgggaaactagggagacaatcatagccctcgatgtctaccgtttctaattaatacagggcagaggaattagatcttttggtagagatctaaaattcctctgaagttctatcaagccccatctcctgatgattcagtgctagttctaaaataggaaaacttacttccaaaaccaacagatgtttgggctgtcatcattatgcctgtactaaactcacttgtgatttcactgtgaagtcctgtctgtgtaatttattaggaatcatttatgtaagattatgtagaaaatgttactagtcgtgagatatctatccatctcaatgatttgacttttacagcaatgcgatggaacgtgctgagggaccatttggtcaactttccacctaatggtggtgtgattagaactcctagcgggtgactcatagagagtgattagaagtaaaaaggttctggaaattcccccacactctttaaggcagcctttgtcaggtgtcttagtttcgtgaaaggtagactgatgttttccatctggtatacaaaacattttctaagtagttatagaaccttgaacaagccacttagctctctgggcctgagttttctcatcttataaaattaaatccatcaatagatcacatgatctctatggcttctttattctaaggatgtatggtaattttaaacacttggttagccatcttgaccaaactagcatcacaggtaagaaacaagctgcgaagaccaaaattcttctctggtttatacactctgggtcagaggcaaccactttctatgttgtttgggctacttttccctaaacacataatggctttgtctgcatcaaaggtcatcttctattttcctgcccattcatatgaccccataagaccttccagcatctcagtcagctgagcattttacctcctgcaaagcacatggtttccttcttctctttgcaggtcatatgaaatgctcacacagtacttactgtaatcacttcgtaaagttgattttcacatatcttcatccagaaaattatcccaactgttatatataactttattctaattgaataattccagttttcaagacacttttcagacacccattgtcttgtctgaatcctcatgacaacctcatttttttatagattatacagcattcctacttatatataatagttataactttttattcctaataaactttcgcatgacgtttcatcagattctgatagtttcttttgtttttcattcattgcattcccatccaaatgtttactgaccctgggaaataaatccagtagaccaatgaagcatgaatccaactcacagagggtggttagaactaaaagctgaaatggacttccgtgatcacctgacccactcatccctgaccgtaggctcttgttcacagcggccaaaacgtgcatgtctctcaggggcttcctgcttgtggagcagaacctttgcttgcgggctccttgtgtctgtgagctcctcagaaccgctcttgagctcacagtgcctgatttgcacgtattggtttccgctccgttgcttattctggtcccctcatagaagcaatgttatcctttcttcaaacccgtcctttcccagagagctttgcagccacttttaccgggtttaatgagtcagctgcagagtttatgatccggtactaggccttctgggaagcagctttcctgggcttacgtcaggctgttaaagaccctcctggccttcctgccgacatttgctcggctactttttcctcctaattaatgcctctatcttatcagagtggcccattctcaaatgcagtaaatgagtccttgatgttctatgttttattttggaaacttcccactctgctcatatctgaattggtatttgctcactgttgcgcagtggtttgcctaccaggtatcccttacatcaaatcctgtccgccgcttagaaaaaccacagctaaaagttgtttggcaactcttggtgttcacagggttttcccactgagggtcagggactgcacagcggttgagagcttggactccggggtcagctggaactgcttctaacacaaggaccgctcttaacaaagaactgaggcttcctaaacttcagtttctgggtctgtaaaataataggacccacttcctataaatgttgagaagattaatgggaatgatgcatgtaaaatgctcggtacatgataaaagcccagtgattactcattatcccactcaatgcttggggaaaggcaaagcagctaatattaccccagattatagataagaatactgggttcaaaagagatcacttggcttacccttgtctatactgcacctgcatgaatcatggacctgaacccaggtcacggccacctcccagacccttgctctctctgcttccccagcagcgcctctcagagtgaacacctatgtccatgacagtgattcccaaagtgttgtccccaaaccagcagcatcagcatcacctgggaacttgttagacatgttagggtctcaccccagacctaatgaatcagaaactctgagaatgagggcccacaatctgggttttagcaagatctccagaagattctgatgcacacccgtttgagaaccaaagctccatggaatactaatttgcctttggatctagccctgccgcccactcgagatggatggtccacaaatctcaatgtgattcctaacatgagttaagctgtccaaccctgtgacgttatcaggggatttgtgattaatacatagtgacaccatttaactgtggcagaggttcttacccttggaagctcattagaatcatctagggaacttataacagaaaggcccaccccagaccagttcagatctaaagacagcctggactgacaaccacagaactacagagctgccacccagactccatggaactctgctaggctggtaatatttttaattcattaagggtttatgtgtttaacaacccaggtccagtaaattggctcctttcctccctatgaaccttggacactctggctggtcaagcctccacctcatgcccacttgtttgcacagctactaacgtttatgaagtatttgcttaatgtacctaagctccactgcccagagctatcccacttgatctgaaaacgtcatgatgaggtatggtaagcattaaacattagttcaccatagttctatttttttctaataacttaaacggcttcagggaacattttgtgtgtgtgtgtgtgtgtgtgtgtgtgtgtgtgtgtgtgtacgccttaagagactggatctcactctgttgcccaggctggagtgcagtggcatgatcgtagtttactctaacattgaactcctggcccaagtaatcctcctgcctcagcctcccaaagcactgggatcacaggcatgaaccaccatacccaccctaaggaatatagttttttgagcatgttggagtactcagaattctcagctcagctcttggcccacttgggtctcaaccatttagagtactgattaccaaaggaagagcacaaaggaagaaaatcagcttttctcctcttcctcagtgtgggagaggggatttggcttgggctcaaagccatagtgatgctttctgctccaccccctttcaattaaagatcaccagcttcccaaaaacaggccaccctcattttccaacctggctcaggcagggaagctgagaagcttggggctgcccattcacccagtcaccaggcagatagacaggtaagagaactgggaccttcaggcctgccctcgggaggactggccaccaggctttacagcccagagcagagaaacactgtggccgttgcaaaactccttgagtgaagtgaccctaccctctactaaaaacgtggcccagtggattccagttactaacaaagctcgttgagaagatgcaagaaaggaatggaacaatggctaggacctccccgcggcagcacttcccccaagagaatagaggagctgatgggcacgtcacatttttctcaatgctggatgacattccatcaccttcctcatcttcatggaattttttttttttttttttgagacaaggtctccctttatcacccaaactggagtgcagtggtgcaatcatgcctcactgcagtcttgacctcccaggctcaagggatcttcccacctcagactcctgagtagctgggactacgggtacataccaccacacccggataatttttgtaattttttagagataaggtttcaccacattgcccaagctggtctcaaattcatggcctcaaacagtgcttcgggttcagcctcccaaagtgctgagattacaggcatgagtcaccgcacccagctggaatgcattctttgaattttaaaagactgtaaatgagagatttgttcagagaagagggtgtttcctatgtacaaaaccaaagaccagcttttattttttattaggtattatagtcacaaaggtatgaaagggtatatagtaataagtctaagaaatttttatgaagtttttgaagtaaaaagcatttttataaaattttaaataaaaattttaataaaattactcaattgttaaatgtaacttaaaattactttttcataaaattactcattttataaaacacatttttcctactttgaaaagtagtacatgcttaatacagaattggaaaagacaaaaatacagaaagaattgcatttaactccttttttttttttttttggtagagacgaaatctcgctctgtcacccaggctggagttctgtggcgagatctcggctcaccgcaacctccgcctcccgggtgcacaccattctgctgcctcagcctccccagtagctgggactacaggtgccagccaccacacacagctaatttttatatttttagtagacatgggatttcactctattagcagccaggatggtcttgatctcctgacctcgtgatccgcccaagtcaaaacttcagattttgccaaacaccttgaaagtatgagtagatagaggaagactcgtccttttgtctgcctccttttcatcttcctaatacctaacacctctctaatctttctagaaatgggtaagaaaagcttccataaagaaaggtggagagaattgaagcatggtagtatttttgcaggagaaattataaggtttgaaatttatggaggcctcaggacatacccaatgacctaaggtctaggccagagatggtaagtaggattttttttttcttttctcttttttttttttttttttttgagatgcggtctcactctgtcacccaggctggaatacagtggtgtcatctcggttcactgcaacctctacctcccagattcaagcgattctcctacctcagcctcccgagtaactgggattacaggcactcgccaccatgcctagctaattttttttgtatttttagtagagatgggggggggggtggtctcaccatgttggccaagctggtctcgaactcttgacctcaaatgatccaccagccttggcctcccaaagtgctggggttacaggtgtgagccatcacacccagctgataagtagctttaaacacaagtgaggattctattccatcaggaatggctgctttatgcagaagaactctaagattacatcaggctaagggtgacagaatgctgtaatccattagccttatctgtcatggtcatggcagcagcaagaggcagtctgagtgccatacactgcagtaatctaggggtgagctgaatagtgaatggagatttgcctaaaagaaacttctggagtcagtgctccaaaactctgaatcaaccaaatgaatgaattgagccaaatagaaatgcatgactattcaatatttattatgtagagaggcttagaaagggcaggcacctggagttcctccaccctcctcacccaatcacaactgcccttactgccctaccagtccagccacgtgccctttcccacccctctcaatgacccttgggctccccagtgaagctccctgagggcaggggacatagctctttggggccataaaggcattagctcacccttctcagccccttacacatttactgggtacttagatcaggccaagtgtggtggctcatgcctgtaatcccagcactttgggaggccaaggtgggtggatcacctgaggtcaggagttcaagaccagcctgatcaacatcgtgaaaccccatctctacgaaaaatacaaaaaattagccaggcatggtggcacgtgcctgtaatcccagctactcgggaggctgaagcaggacaatcacttgaacctgggaggcagaggttgcaatgagcaaagattgcaccattgcactccaccctgggcaacagagtgacatttggtctcaaaaaaaaaaaaaaaaaaaaaagaaatcttagcaggattacatctgtaaccccggcactttgggaggccgagggaggtgaatcacatgaggccaggtgttcaagaccagcctgaccaacatggtgaaaccctgtctctaccaaaacatacaaaagttagccaagtgtggtagcatgcgcctgtaatcccaactactcaggaagctgaggcatgcgaatcacttgatcctgggagatggaggttgcagtgagccaagatcctgtcactgcactccagcctgggcaagagagtgagactcttgtctcaaaaaaaaaaaaaaaaaatcttgccccttccctcaaggggctcacagcctgtgggagagggaaaatagatataattatatttaaagaattataaaacaaattgtataaatttaaaattataattaaatcattgtaataatttagatcagaaaaaataaaggcaagtaagtgccaggcatggggctaagcattgtactcacccactgtattccatgttgtcttcacaacggccttatgaggtttgctagtattgcccccattttaccaagaaactgaggcttagagcattcaagctagccaagggctaagccatgactcaaacccaggtgtgtctgactacggctgttactaagaggggaagggaatcatctgaacttgggtttcactcagaaaggggcatggttttggtaactttgaaaacactaccaccctaccctctagcactggcagaggggagctggacgcctggacagctggggagggggaggacggcagccagaagcaacagcctctgcagtcccagcagctgggacctcatgcctcaaccaaggatcagcactgggtattggctcagagtagtgaaggctgctgggggcctgtgtttcctgcatttcctatgtttatgctgccagggtgggttttatgtgaccagagagaagcagggaaaattgctgagaagtcagagatctgccagggaatcagtgatgagccccaggaaatgctttttgtctaaaaatatgccatttccgaaaggaaaacagtcattagagggtgtgagaagccctcgtggtgaggaaagcaaaactgtaagactcaatgggaggccagtggaacaacagagaagcccattacccacccacttcctgtgcgattaacaagacgtttggaggatgaaaggcaagcagacaaaatgacaacccacagacacaactccaggggaaatgtctggggacagcataggaagacgcagcagggaggtaggaggagaaaaaactgctccagttaatatctttctggcatcggctggttcagctatagatttggctaaaattacctgtgtacttactagacgccaggcagttagggggctttgcttaaatcactctcctgcattcttcacacagcacttgatgaaggaggaaagtgagtcttggaggttaagtgacttgtccaaggttacacagctgggaagggagaaagacatggctccatcccaggttccctgatcccaaatctccccctcattgcaatgtaccaagctgcctccaataagatcaagagtcttgacgatccccaagctagtccactcagtccagttttcctgccagactatagctgttttgcattccttatcttgtgttgaagcaaaccgggtaaggaaactccccaccttttttattaatgactcattttcagccaaaacacattgcagccacatcaggtacatgtgcccactcagcaaagacgtactgtgagaaagtaacatctaagttacttggtccaaagcccttctacatcaatcatcaagcaaccaaccctcctttgctgaaatctccaggggactaggccctttggtgggggaagaggggacggtttcttcaggggcatctcacccctgggaagtgcatcctctctgctgggggcagtaaaaaggctttacatgggccactgtggctcatgcctgtaatcccaacactttgggggcccaagcagggtgattcacttgagcccagaagtttgagaccagccgggcaatataaagagaccccatctccacaaaaaaatacaaaatttagctgggcttgatggtcccacctgtggtcccacttacttacttgggaggctgaggcaagaggatcagaaggtcaaggctgcagtgagccatgattgcaccactgcactcaaacctaggcaacagagctagaccctgtctcaggaaaaaaaaaaaaaaaaaagaggcttttcacgaatttcacattccaccctccaccatctttgatgtaggtaatttatcagcattttgtagaggaggaaacaaggtctcccctacgttgagcccaaatcagtttgaccttggggaacacagtgagcatccctgcgtggaggtacgcaggatccctgagggtgacaaccttcgaggtcgttccctggcctctctgcccagggtgagcatcctcagagacctcagctctcctctcagcatgcaattctcctccactcatggccctcccagctgcccctggcttctcaaagctactcctgcatggaggcaagtacaactagccaatgagcctcctgacctgccccatcccagagagcaactgctgctaggtcctcgtggattctgggcctctgtccagtgaccaaaggagaggacacatctccagctaccatccctccacctattttctaaggaaaccaatgagttctcaaatgccacctgtggtggccccttctcagccctcaccctgagaggccttccccaagtcagaatttcccacaggggaagttactgtgggcttctctctccttcccccacctcatgtggtcaggaagtccagctggctttttctcctgtctgtctctcaaatgtgtcccctggctcccctccattgccactgccctcttcagtgtctggcctgtgctcccacaacaacaggcttgaagctggctgccctctcccctccatcttccacaccataatccaggtgatccttctaagaggcaaaggtaatcatgtttcttccctgctcaagatctgtcaaaagattctgtggcctccatagaaaaggcagacagcccggccacccaggcccttcaccatctgcctcttgaccatctccagtgtcctgcagtgtcctgaatataccttttccctgcctctgcccaacacactcccgttctttcaacacccaactcaactattaccttctctccatcagatcttccctgaaccaccccccagaaacaaaggtgactgtcccctctggttccccacagccaccccaccacttacccctgtgctcaggcactcctggagcactgcattgcaaccattggctcacacatctgtctctaccagcaaaccactaaaccgtgaataagtggcttcctgagccaggccttgtgcaatgaatggatttgcaacaaagggagccactgagagattacatgagccaagtcatggcaattagtccccatggaagcagcagctcagggcagggtccagacttgggcagacttaactatgcaggacattccattaacaataagcaccactctgagcatttcctatgtgccaggaactacgtgaagctctagattctgtcattagaaaggactgagttaattaatggaaagcaggtagcacagtgcctgacacagtataagcactgaacacacgttagcaagaaaagtgacagatcatttacgggatggttcttacaccaggcagcgtgccaagcacagtccatacattgtctcactcttcatgacaaccttaggaagagagcagtcctgtttgtccccattttacagaaaaagatactgagtcttggctaggctaagcgatctgctcaaagtcttcagctcggaagtagtggatttggtcttccatccccagtccatctgctctggcacccaggttctcagagtctctggtacagcagggtgccaaagtccagttgagaagaaagcaggccaggtttttcaggcacagcctgatgaaatatccaggggaaacacatgggactagcaggcttctttttctgtcccatttagtctaatatcacatttaacacaccatcctctaagggacagaagtcacaggaagccatgcagtctggttcctcctgatttctcctgtgtgccacatagttatgcttccttctgggaaggtgtgagttggagtcagtcccctcctgcatgcagctggggaaactgaagccaacaccattttagttactcacatggagctaagacaatcatacaaaactcaggcatggggtcagcccaccagcagtgtggacctcaccctgccggctgcgttccaaatgacagtggcatggtgccacagaaaaaacatgaggtgtgcagctggacccccagaagccctgactctgccaggtgctagctctgggacatcttgggcaagccatttggcccgagtctttttccccacctatgaaacaagccagagagctcattcctcacaaggctgtggtcagaatgtgcctctgtacttgagaagctgtaaaatgttcctcagttgctgcccttagtagggagctcagaggaaagctagttttgcctgtgcgtttctgtcggattgccctgtacccagggcacgtcctgctctctgacaacaatcagggtcattctaactcaaatcaaacaacctggtctcagaactggtcttgcaccaccatggtgttaagctgccttcccacttcatccatgtttgctaagccgggtgggatctttcccctacaaactcctataggcggccacatttttcttttaaagatattttcccttcgactatagtccacaggcatcagaggatgaagctagcaggttgtctgtatgtagactttcttccagggaggaaagcagctttgctatctcctacctttttaaacaaaatctgccttgattttgtctgccaagatatgtctttggatggggtaaagcacttctgagggaagctacgtgagccacgttgtagctggagagagaattgaaagaggaagccgagctgagaccaccacagttccggggctggagcccagctttgcagaatgcctgtatagcagtttgaccccaacagatgaggctgttagggacagaaatgaaaagcactgagagaggggaagtgtgggtggagcttatggacattctatgagccaaagcaattttgaagtctaatcatttggagggaaaatatttgtcatgtcattttaaagggtacaaaacaacacagaggaaaatgaaagggttagaaaataattggagcgcttctccctttacccttgtagaagacagctctccggttttcagctccactcattctgtcctccattggaagctcccccagtgtcttagagatggatgatgtaaaagttagaaaatgcctgtgtttcctgcttgccttaatttaagaaactgcttgactgaaaagtgactgaatttcatttataggataaaatacttgatctccagggaagccaggcctcaatagatggatttttaccatgtcacttccccctagacctgtgggaactgacctgagtcttggggaaaatttgagccacatggcagtccgcaggtgcccacaagtccctctatgatctgagtacctgtcttcccagtctcatctcacctccctcctctccagccagggggacgtgcaccctatacccaccccatgcacacctgtcccaggctctggctttcagctcctaccccagaaatgcccacctccccccatagctcagtgtacccaagcttggcccatcctaaagccatctctgataactccaccacaacctgtcttggtccaagctggaagtgatgagtgaactctcagaataaataatagtagctcacatttcttgagctaagagccagacacttcacaaactcactctcacatttctttttttgttagtttgtttgtttgggagacagtcacgctccatcacccaggctggaatgcagtggcataatctcggctcactgtaacctccacctcctgggttcaagctattctctggcctcagcctcccaagtacctgggactacaggcgcacaccaccatacctggataatttttgtatttttagtagagatagggtttcaacatgttggccaggctggtctcgagctcctgacctcaagtgatccaccgatcttggcctcccgaaagtgctaggattataagcatgagccactgcgcccagccagctcactctcaacttaatcctggaacaaccatataatataggtattactatgatttatccccatttcatagaggaggtaattaggacttagggaggttatgcaagttacccaaggtcatatagttgataagtatcagagccaagagttgaactcataccacctttcccaagagcaccttgagctactagaactactgcacgcttgttttgtaacatttacagaactatagttcagtgggcaaaggccatgcatgattcttcacacctcccacaatactgagccaccagcaatcaatgcatgaataaatgaatgaatgagaaaatacccacagactagagagttaaggcaacttttacaaacattaaaaggatgccatgtcaacaaaaacacattaagcaccaaccgtgtggtccacattctgacgggctctaggcctcggagttgaagccagggtccactggactttcagatgttcaatgaattcccactttccaacctagaagacagtcttctatcgaggactgcttttcagtctcctagctgctgctttgttcattattgctcagcaaacagtgtgatttatgcatgagacacacaccttaagatgcaatgtagttcttccaactgtcataactactaaattgaattgaatggcaatctactggtagctcaacctctgcaggaaaaaataatcagcctgaaaataatcaatgcaatagcactgtagtgacactgtcgaaaactgtacaaacagtaggaaaggtaatgttgtgactgtcatttattaatgcagagttctagtgttcctaagataaagatcattgaaatgtgaagcgcatttgtccaaacagaatttctaataaatacctttgattgttcctttgtctctatcctttactaaagtcaggcaattagcagtgtttgcaatattacaggcaaatgaaattgggtctctgcctggtccgcctacagaggacttctatagcaataaaaataatcaactggattcttcgttttctgctgggtccatgtgatttccttaataatgtcaatgcagattgtaatttgtaggaaaaaaatactgcttgcatcaggcatgaaatttaagaccacagaaatgccatcttttcttacagaattgttttgttacaagggtatgtggcttggacgattagaagagacctcaggtgtggtgcccaattcatctttcatagaccaatattttgtttcccaaatgtgccttgtacatttctccaataccttcactctctagctgttggtgagggaaaggacaaaaattagagtcataaaatcaccattaaccccccagcttgaccactcactagctagtcatttaggctccgtgggcctcagtttgcttctctgtaaaatgaggcagaaaactatgaaagtgcctccaatctaagttccccaggctcctaagacaaggcctggcccatagaaggcacacagtacatgttgcttgagcaaataagtcagtttcttgtatggtatctggcatgtgatcagcataattaatggttgcttaaaaattaacagtctgttccccaccagtaacattcatcttcttcctcttggcctggtgaaatcttacgcattcttcaaagctaacatcacattctgctttgtctgagaaaccttcccaagaccacaccaactagaagtgatctatctccctaaactcctaagacatgtgttgtccataagcttcattcattcattcattcattttatgtatttatttattttcgaaatggagtctcgctttgtcacccaagctggagagcagcggcgcaatctcggctcactgcaacctctgtttcctgggttcaagcgattctcctgccttggcgtctcaagtagatgggattacaggtgcctgccaccacacctgactaatttttgtatttttagtagagatgaggtttcactatgttggccaggttgatcccaaacccctgacctcaagtgatccgcccccaccttggcctcccaaagtgctgggattacaggtgtgagccactgtgcccggcctataagtttcatttaaaacaagcttgtccaaccttcagcccaggactgccttggtccagaagctttgaatgcagcccaacacaaattcataaactttcttgaaacgttatgagattttttcatgattttctttttgtagcttatcagctaccgttagttttagtgtattttatgtgtggcccaagacaattcttcttccaatgtggcccagggaagccaaaagattggactgtcctgatttagaacttgggactcatggccttgtactgtaggttcccctctcaaaggatttcttagctgttcagttatgtcacaagcttctcggaggcaggtccagagacttcggttcctggtgatttaaacagcccctagtcaagagcatggcacacaacagatgttccataagcatccacagattgactgggggaaatgtccaattcccatggagatggtcagatgccctggagaggccacagtgattacaagccctacagccctccatgggatacactgggccaaagacactggtacagaagacttgtcttctgtagaaagtttgctccatttcgctaaatatcttcccatttgtaaggaaactgatatcctcatgacttgtggtgggagggaaattgtacaacctcttcaggggacagagtgacaatgactctcaaagtttaaatgcacatacaattttaaaagattaaaaaaaccataaatgtcctttgacacagtaattgcacttataaatgtttatctcacagactgacctacacatgtatgagaaaagtcattgagaagattcacttttgggttatctgtagtagcaaaagactggaaacaaatgtctatcaacaggtaactggataaataaatcaggatatatccatgtacaagaacactatgcagccttttaaaagactgaagttggccaggcacgacagctcacacctgtactcccagcactttgagactgaggcaggcagatcacctgaggtcaggagttcaagaccagcttggccaacatggcgaaaccccatctcttctaaaaaaatataaaaattagccaggcctggcacctgtaaccccagctactcgagaggctgaggcagggagaattgcttgaacctgggaggcagaggttacggtgagccgagatcgggccactgcactccagcctggccagcagagcgagactccatctctaaataaatagatagaataaagtagaaatgtatgtacttgtgtagaatattctccaagatataagtgaaaagacaaggtgccaaccagtatgcatggcttcatccagcttatgtaaaaagggagatgtacacatgtgcacttgtatgtgcctatcctgtctccagaacaatagcaacggctgacttggggcagcagggaaagagcctggggtcagaagcaggaggagacttgtcactatattcggtattctcattcatatggactaaattttttagcaagtgcatgcattatctttcttttaaattttaactttatttttaatcagatgatgaagtcacatgcacaaaatcatgaaaggtacaaaatggtacatggtaaaacgtcttcctcccagccctgtccccagccacccagtttccagcctagagacacctaataggaaccctttcctctgccctttttagagacagtccatgcattgcagagattttcttttaaaataatcacaatgaagtgaactgggagaaagcttccattgacctcaccaccctctccagctcatgctctgttctccagagccaagctttcacacagggttgtctacgtgtatggagtggtgaaaaagagttccttgggctttggagtcagacaaacctgagtcttcaatagttgacctaacctctctaggtcttatggcttcatccataaaatggacaattcatacctggctcttaggttgttataagggtaagaaacagtccatgaaaagcatatgggtcacttagccacagccactctaaatttctgggcaccagcaccctccatggctgggaccaatcctcactgagcagtgttcctggacacagccagagaccccaagacccctggatgtccccctaatcccctgagaagtacatcctgtatttctgaggtaacattttacggtaaacttctacagcaagcaaaaaaccttaaggagctcatgatcaagaccagtcctccctgggtttgggggcttttgaaagggcccaggtttagacatcaggaaacctgtatttgaggcctgactctgccattaactgagcctcctggagtgattcgcttctcatcccaagccttgcacagactgggtggtgattcctgaggcccagaacctggccagccttatagcgtcagtcagggatgtgttagtggagcccttcactcagcgaaagcatagctggctgagtctctagacagagagtgtgttgttcaggctaaactatctccctaccatggacataaaatgacatgggtatagaacacactaaattcttcaaggtaacaaatttaaattcttcaaaaagggagtggctatttaaaatatctctagttcatttttagcattactgaaattcaatgtaaatcacagtggccatatagagttgacatataaccctccctctgtcaaacaccaggttactaaagtcacagggattaagaaatgacccttggtaacaaaagttaccaatgtagaccagttatgtggcaggtggggagagctattctaaggttccttctaactccaaggggctcagatcggatatttggcaagtaagcaattggcacactgaccctgcagtttacaaagtgattcctacgatcctgagggtagaagaagattttgctcctggcagaggttttgcaggatgtgggtggggttggagaggaggctgctgtgagggtagaagggggtaacctctgtcccttcaccatgtttatcttgccatatcaccatccagcattcacagtccattgcccaaaataaaccacagatacaaagtagaaagatacttcatctattttctaagtaaatctaggaagttaaagatcacagctgtctccaagaccatgcccgttgagtaaaaatatctcttggcaagttgtcctacatcaattttttttaatgagacctcttttttcctacctagtattgataatttaatagctctgcaaaaagtgcttctgaagcaagaaaacttagtattttctaatttattctctgggagatttgactgctaatcaaatatcttaattccctccatacttaaagggggcattttaaagtgactttcccagccgttccaaattacttcttgaggtttattgtttgcttttaaatttatgtccaacatgggctctcttcttggggactgagctgtttcagaaaatgatggaaatttggggtgaatctaccaacagtgttcagtctttccaaaaagacagttcattaaaagctgaaaggtttgaccctctggctctatctttttggcctaacatcctaacacaggtgtggacagggtcaagcatgcaggcctgtctctgatacctggttatagcaaggctgtccttggcatttcacctccacctcttctgcatcatacattgtttattttcacctcattattccattcctactccatttggtgataatccactgtgtgctaggcacccttctgggcaccagcatatagaaaaatgccttagcattcgtccctgccctcaaaagggccttgggatcaagaagaagtggacacgagcacatctgactaaacacaacatcatggagggtgtatccaggatatgagcaaaatgctcagagacaactctttttatttacgtcacaaatgcttctacagcacctactatgggccaggcatcatgctaataagggctttaccaatattaattcatttaatcctcacagcaacccactgagatgaatactattcttatcctttggtactgtggggaaactgaggcacagagcagggaaataacttgcccaaggttacacagccagtcagctccaggtggggctcatggggcatgggccctggagcccacacactctgactccagggcccacactcctaccgtcgggccacactgcctcacaacacactttctcgccaaattcagagacacataactaaaaccacttacaaatggagtatgccaactgagaatgctacagaacacattgaggaagtgacatttacactaaaatctgaatgatgaacaggagttaactagactaacaggggaggaagtgggttgcaagccgtggttctgggtggggaaggagtgcaatgtgttccaggaactcaccaaggccaccagaaaaggagggtggaaaagaaggaagaaaacagctcaagaagaggctaaaacatgagcagcaaccatagcattcagcaccctcactacaggccaagggtcattccgtagttgggttccgcaagaatgataggaacctaacagctttggcaggggtaatagcatcagttatgcatcatccactgatcacttgggctgacatgtagaatgcattggaagaggacggcggggttaagcagggagaccccgggggaggcagcagcaaggagagagttgatactcccttggatgggctggaggtggataaaaatggattcaagcgagttttaggagacagtatcaacatgttatgctgcatgtttgcttatgatgggtgaggagagggaggagtcaatggtggctctgaagattctaggtattcacagggtcgggaagcacttgtttgtcacaggtttgttgggtgccggaggggaagaaagtcccgtgcaacagccacatgcaatgttcatcactcccctggctctcaggctgcttcagggctccagaccctcgcacgtgctgatctcgggctaagggctgtttccttccttcgactgaagacctttcatactgtaagattcagcttgaaagtctctccctccatacacatcacacgctgacactggaccaggcacttatttggatctcacaacatctctgcaaagaagatattgctatgcctgttttacagactactgagaatcagagaagttccaaagctgccctgtcatttgtggcataagcgagagagcccactgacatcccagcgctgccttcccagccacactgagggagaggtgggcttggcccttgaggccccttcttctcaaaggcattgaggttactttccatgtagattacggttgagaacaatgagaacttctggagcacattctgtgggctgtgtgaggacgtcggcaagggaacagactaagatggctagaaaatgcccctctttcatctctagaattcatctagtgaagcacttcccaagcctcaggtatccagggtctccctgttcttcctagaagtaggttccagtgaacagaaagcccacagcataactaagaaaaagctgtgtgtctctaccatgctggtgaatccatgctgctccttgacctgccactccttgacatggacggctctattctaacagtgccactctctcatgtcactgtccctctgcctggttcctcctcctctcttatctgcctggagagtcccactccttggatgagtctcacccagagcatccctcccccatctcctcaggctgggtgtagggtgaccagctgtcctagtatgactgggcctaacggatgttctggtttgtgggactttgggtggtatatcagctcaatcccatgcaaaccaggatggttggtcaccctagttaggcatgtggattgcccctgcttatggcaagcccagcaagtatccaagctgtcttgcactcattggttctctcctctgctctttccccaaaagtagttatgaccctctgagatgaagccctgtgccttgttcatcactgtattctcaacatctaggcctggtacagaccaggttgtgtggtcaatgtttgtgcaatgaacgtacgagcccagactcagcatatttaggagatggctcctaccacccagcaattagagaggggaggcaacgcaggcggaggacatctaccaatgcagcacatgagcaagacacagggcctgagaataactgaaccctggcccacagatgccaaagaactggttttgcttgtttgtttcatttgccagtcagaagcgtgggggataatttagtggaatcccttcacagataggttttaacttgaaataattcaactataggtgcttggcaaacaatcaaatagtgaacaggcccaagagagaaggaaataatttagatggcagatggcagttggctccactagaagtgccacctggtgagcacgggcccacagtgggtgtgaggcgggacaacgggggcacacttccctcctgcgtgtgtacctcacactgtgctaggatgattatggttctggcatacaaagtcacttatttttcatgcaacctggtccctaaacttaagaaaatgcctttatctggtaatcaactgggaaaaacattggctgaaccccatactttcaagtacttatgagattttcaaaggtggttcttacacactaacttaagagtccccagatggtgagtcccagctgcgccacttcataactaaatgatcttaagtagctaatgacttaaccttgtagagcttccattctcatgggcaaatgaaggataacatctctccctcatgggctcacagtgaggattaaacgaagggaaggtatgcacaacagttagcagactgcttggtacaaagtaagcgctcaataaaccaaagctattatttttagtggtggtaatagcactgcttttctttggcatttaaagctgtgtagctaatctgggcattccaccaggttgctgaagcaatagacggccccttaataaatagcttccagacagcatgtcatttaaaactgaatgcatttttgcttctcagttgttggacatattatttactacctgatggtcttgctctggcccaaacaagctaattattgcaattccagagtacatgccatcatccagaaatagctttctgtagagtggggactgaaattaacaggcaattagcaagtttaaaaggatttcctttccccatccccacccctggcacctctaacacattaaagctcatcacagcagttattttaaggaaattcagcagaggtacttgcagggcccgaggtcatcttgtgttggccctggatagatcatgaaatcctgttgccaaggagcatggtgggaatgtggcaggaaggctaaagtcaggaaagccacctcagccactaagtagccatatggcctggggcaagccactactcaactctgagcttcagtttcttcatcagtaaggaagtggccaggcacggtagctcacacctgtaatccagaacttggggaggccaaggccagtggatccctcgaggtcaggaggtcaaggccagtctggccaacatggaaaacccccatttctactaaaactacaaaaattagccgggcatggtagcaaacacctgtaatcccagctactcaggaggctgaggcaggaggatggcttgaatccaagaggcggaggtggcatgagccaagatcatgccactactcccaagcctgggcaatggagactccatctcaataaataaagttaagaagttagactgctcaattcctgagactccttccaacccagcaatctgacgtccacactggggctgaccactgaactacatggaggcacatgcctcagtttccttatctacgccattcatctaacagctatgtatcaatccctgttaggcactaggcactgtgctaggtgtttggaagagtcattctcaggcctatcctatctcagcaacctgtaggaatgtcctcacctccagagttagcccccttggaaggaaaatatttagtcccacattcatttctttcctatatgaacctggaatcactgggggcagcctctctgaactgccccattttctgaaaagtgtccgaagtacagcccaggcatggggcattcagcacaaagggcccaagtcttgagagggagtagtttaggagtgaagaaatcccagcctcccactatccagtcttaaggtaaaaagaattgtacagatgagcacctttcttccccttggtatttccctttggcatgacccaaagaccactcccataaagggccataccctagtgttttctgacaatctagggatgaattccctattacatctcaggatgggagaaaaacaggatttgggagttctggtttaatcactaaatgaacttaatcttgacttctggttttgtcatctgcaaaaggcaagtggtcctgatggctacttaataaagctgtctgtgagccaaatgagagtgtgcatctgcaagtgcattgtaaactgcaaaaataattgtggttctctctgggccgccttctacttcacaacaatactgagctgaccttacagataagctgaacagatggttgcctccatggtagtatttgaatagcaccagaaagtttcacctctccaaagcatctttctgctggcctgaaattcaaccattagggattcattttgttgcggtgggggggggggcggcttacaagcttcccagggttcaggagcactctattaaatagctgttgtaatcacccagcaggttcttcctattcgctgcatagacaaaaccagttcaccaagaccacgctattgtagtagagtttaacacaaagccagctacgcagaagacagttattactccaatcagtctccctgaatgctcagcggttagggtttttcaaggatagtttgatgtacaggggattagggaatgggtgctgcagattggttggggatgaaatcatagggttatggaaaacggtccttgtgcactcagttggcctctgggtgggggccccaagactggctgagtcatgagcctcaagtccggatgtagtcagtctaaaaaacaactcaaaagatccatcttaggctctacaatagtgatgttatctacagaagcaattaggcaagtcacaaatcttgtgacctctggccacatgacccctgagcagtaagggatgatagaaaatttgcctatatcttagcagaattcaggcccctttcataatcctgaccttctggcctttcactggttttgcaaaagtggttgagtttggggagtggctattatccttgctgtaaggttcaactataaactaaattcctcccaaagttagcttggcctacacctaggaatgaccaaggacagcttggaggttaaaagcaagatggagtcaactatgtcagatttctctgtcatcatttcacaaaggcagtttcactgtgacctgctaatactgtggggaaaagaaaaaaacagtactcattgggccttaggcatattctaggttctttgcaatacttaattttgtttttaatctcaaaccagtctgagacaggatttactattcagcacatttttgaaactgggaaaatgagtctcgagatgtttaggaaacttgctaaaaggtcacatgagtgacagggttaggacttaaacatgcgtggggtcgggaagatggcaggcacagggtatcaggccaggggagatgccctagagccagcgacactcagcctacttaacttcttctaagagccggtcacctccataaggacagccagagcttctgccaggaaagaaagaacgttgatgctattcgttttccaaaagagcgtatctcctccggctaatctgaacatatttcttacagggctcttgaatgcccctttgtagctgagtgggtgaaacggcatcaccaacatttggccctgctgctccactgagagccggcgccgttcgcgggataattatcctgtagtcttctcacctccggagagaatgcaaggcgccctccttccaaatctggcccgtcacgccagcaccacttatttttagaagctgttttcccctcatagtttcacaacctctaatctgccactctccagtgaatataaattaaaacacaacaatgaaatatggagaaatgttttctcccgtcatctccagctctctgaacccggggctgggagtgggtggagcgcctgatttgtctcccaggcgacacggaaagggaggcagtgagacgtgctacctggtcgcttccggctctgatgaaccactgccaaccagttattagggaggagggcagcacttgcaaaaatttcaggtctctgagagcccagagcctgagaagtgtggaggatactaattacacccaggtggaagcctggccacagctcacctcctaaggaaagagcgagcccattaaatagccaggaaggaatggagttcacaggggattagatttctagattatagcctcagagtcattctcaaatttatctcctaaaatctggaggtcaaggaacaaaagcacccttgaagaacaggtaaagggagcctggtctgaattcttagctcctgacagccaggccgcaagaggacagacatcccgtgcacacacgcccgccccatcgccaaagaaagctctagagctagacacttagactggcctttcatgaaatgacagcacctgccaaacacaatagggaaatagttagtccagccaggcagtgccatagagtggtcagagcatgggaatttcaagcagacagcagcaggctttaatcctcactctactctccccagatgtgtcaccaaggcaagtcactcagcttctctgaggctcagtttcctggcctgtagagtgggaataattataatactatcttggttgtcaggtttaaaagaccaaatgaatgtcactgcctggcagactacttaaaacaataagaggtgctaaagttactttaaaccaaccttctccaccctctccttccccacctcagtttcataccccagagaccaaattcctgatggattcctaaatgatatctctgccaaatactggtgccaggtgctgggcaaggcacagttttgcaaccagctgtcaggcagcaacaacttcacagtcgtacttttattcagtgtgtggtaaaacttctgggacaagagtcaaagtcgtagggctttagtgggaaactgccattgcctgaccagaggtacaaagcactggcccttccctcatccctggcctgacctaagagggctggggtaccacaggactgttgaccccactgagagctcagggtgccagaaacactgcctgccacgtgattcctattggtccttccagagatgctaacaggcctggaggctggaggtctctctgcccacactttcacacatgacctggagcagggggtcccagctctgtagctgcatttctgacccagttggataccttgacatggtcccagcaagcaacagagcacccattgtacagccttccccagccccagagagggactgtccctgccaagaacagaggtgccacccagaatctgacagcaggggaggctccccaagcattctacccagaagaacaagcaccctccccagatggcctgtggcccaccctgccctcagttcctagcagatcctcaacttggcctgctttgatgtttgtgaatggcaggtaggaaaggtcaggcaagtggaagaaacctaaaaccatgctctctatggccatggaagcttcctaggtattattacatagctgtagtatattaatattactgtcattaattgatattattgtaatgttactataatatacatagccataatataaacacattataaagctgtaatagcttatctttattctactatgtggcaagtctgtactaagcattctcctactctaaacccccacaaaagtattagctatgaactatcattgaatttcgttttacaaacaaggacaatccaaagaggccaagttacctgcccaaggccacacagtccacaagagcccaagttcccactcaggcccattctcttagctctgtgccacccagctctgcaaatgtagccacccaaagccaatcaagccagtggtagagttctaaaaccaaatctagggctctgtcccaccaatctccacctggtgcctggaattcctctatttttgttttttgttctgttttgttttaaagtttcactcacccccctccttaaacccaaatatccctgggacaggatggaaatccataaacaggtgcctgagtaagacatcattcacagagccttttcctcctgacagctggccaagaacaggagagggggccctgggcaaatctgcaggattacatcagagcttattttcccccgtatgcccctaattttctacatgctcttccattcctgatggattcctaaatgatatctctgctaaatcctggcgccaggtgctcttccattctcccagtgatccagaactttcttgctgtcatgaagaaaactgatttaataagtaaactcatacttaggaagcttcccatccaccctggccccccatggtatctcacatcatcatcagaccaaaagaacccataccctcatcagtgatgactcagcaaaatcaacttcacatgattaggaagctcacataactagcaaggcgaggaggttctctctgccggccacctcctcccgccagcactccaccacagcctgcctactgtctgcccgtttggactagcagctggtgctgtgggatctttaactccactgaaattatgtcacaaaattggggcatcgtagggaacctaggaaaacagacaagaaataaagactccatatgtgcctggcccacacccgagtttggctcactatgcacacattagatcctgccattcacaatttaaaatatatatatatttttttgtgtatatatacatatatacacacctagaaaaaaagtatgtattttgtatatatacaaaatttattacgtataaataaaatttatacaaaatttattacgtataaataaaatttatacaaaatttattacgtataaataaaatttatacaaaatttattacgtataaataaaatttatacaaaattttgtatatatttgtatatgtgaaatattttttaaatgttaatatatctataatatttatatatttgaatatataagtttatatatatttatatggctcactataaaagaaattgaaacctccttaagcatgaacaactcccacgggtgttttcttcatgagacgcacaggaagatggcaatgggtactgaaaggaatgaattgcttgtgggggaactttatttactagaacaaccccaggtaggaggagaggttttaagaaatgagagtaggggttctggaggaggtcaccttgcctcctagtacagaggtaagactccactgaggctggagaataatgctcatgaggagattggcaggccccagatccctgcagctactgggacagaggcttcagttccttgccatgggggcctctccctaaagctgctcacaacatggcagttggcttctcccacagcaagagagagaatccccagagagagcaagaggctccacaatggaaggcctagtctttcacaatctaatcccagcagtgacatacccatcacttctgctctgttattggtcagaccaaccctggtgcaatgtgggagaggaccacacagggtacaaatcctgggaggcaggggcccttgggccatttgaagggtggttactccagcaggtacagagtatggtgagcccacatgaggaggtgcccagattgcagccatagatccttgggcaggtcatccaacctcatttacgctgtttgcacttacagaaaatgagaataatagactcgtcagggcttggcaatgcctatgaaagtgcattgaacaaagggaagtatgctgcagatataagacaacatggttttgattgtaattactagtaccagtagcacatagttgtgaggactcctattctgttgagctaacagccctgacccacctgtatcaatcagtgccaatgtatatttcacattgccaatacccagcgtcagataatgaagttttgcaaaatacagcttgggtgggatctctttaatgacctgttaaaactgatttatagttagctttttacctgaatgcacataaggaatctggagttcttgctagttcttgcttggaaatgatctgtttcttcatctgaatgtcctcccttcatctgatttccttagcaaccctggtttttctgttttgattgacaatacaaaattaaatattagtccagtccctcactgggctatcacaggttccaaaacacccagccctcatgtcattgatccaacatcaaccgttccaccggtccttccctcccctgcccccttaccctgccctaagggctctcaagacagacctgtttaactctgggcatttagaacacagaagactttctcaccagggaatctctctttctaaaatccccacagagctggtcaagcaagaagagcactggactacgcatcaagacctggggtgctgatcccgactctcatccttgactgcagtgtgggctgggcaggtcacttcactgctctgagcgatttagttctggttttgaaagactgggtgattctacccattattcactgagcacctctgggccttctattatggcctcctccctttcctgccctgcagctccctgccaaaaacaaagcctatgcaaccttcgtagatactcttcatagaatctgtttctctccctgtgggctctttccttctgagcactggcaggacttaaccatatgttctaggcattgggtgtgaaaccagcaaggcttggtgctggaaatttagcctcatcttcccaaccaccatagctaactcttgtcaagtacttgctctgtgtgccaggcactgttctacctcattaaaacttcacagcaacgctgaagtggctattatcatcttcattttatagatgaggaaattgaggctcagagagagtaagtaacttattcaaagtcacccagcccacatgaggcagagccaggattcatgcccaagcagtccagaacccaagcacgctgtcttgggactggattttctttccccatgaagaatgtaaatttcttaatcacaggccctgtttattttacacacagtcagcatctacaagtctttgttaactgattacaggtttctgtaattctaggcatgttaagcgtagggtcaagcataaactctgtccctacctttccagaacatatgctctgatatattatagcagacaaatgcaaaatttccaagactcgtgggatttagaagggatttttctcaactcttcttttccagataagaaaagggaagcttgaggagattaagttacttctgaccacatagctccctgctgcagaaccaggacagaaacccaagccttctcatccctatcacgagttggatctagggcagtggttctcagtggttctcaactgggatggtttcgctccctcaccccatgggacatttggcaatatctgggggcatctttgcttggcacagctggagaagaggatgttactggtatctagtgagaagccaggggtgctgttaaacatcctacaatgcaccagacagccttcacagtagaatcatgtggcccaaaatgtcaatagttctgaagttgagagatccattctgtgggatttaccacttcctctaaggctctttgtttctgtatctttacaagcagtcatctacagttggacaccttgtcttattcatccttggctccagtgctcagagaagtgcctggcacgtaataaaagctcattgaacaagggagggaaggagagagggagaaaaggaagggaaagaatgacagaaaaagatatcaggctttcctggcaggcaaagaaagtccaacactataaatcaagacctctgttcataaaacagaagatgtctgactgtttgaaatcaattcttgtatatcattccagagagaagactaactccgaataccttaattatgcgttagcacaatttagacgaatactcacaaaattaagcagagaacccaagccctgctacagaagtcttccccctcaaaaaaaaaaaaaaaattaagatggagtctccctctgtcacccaggctggagtgcagtggttcaatctctccagggattacaggtctgcgccactgcacccggctcatttttgtatttttagtagagatagggtttcactatgttggccaggctggtctccaacccctgacctcaggttatccacccgcctcagcctcccaaagtgctgggattacaggcataagccaccgcgcccggcccttttaaagtaaatcttgattgatggacatgatgaagtccgtgaggtacaaatgcactgccttttacaaaagtaactggttccttggaggtgtccattgggaagatggcagtagttagagctgccactgaggaagacataataggcagctctcattccaaggcagctgagccacgaagaaggctggcctgagtggtcagtgtgcagtaaatccaaatctttaaatgcagttcatgcttcacccccgaccgaatgacaaatggctcccccgtcagagcaagctggcaggtgatgcaccactcctcccctcccctgccacccgtggtgggacaatctgtcagcagccactaattctcaggaatggatggggaagtgggggaagtcaggctgtgtttattgggcaaggagaaggggtctctgagcccaaagaccttcttgggaaatgcagctcctgccctccacagcaaataatgctcaatgaccagtcagggagagcttgtctgggctctcttcaagctatggggagcatctagaaaatgccttgaaaccgtcagatggaaacatcctctcatcttcctccctcctggaagcaatgtgctccgccgctcttccaaacccttcctgtctctactggtacacctctccaaagccctctggatacctcccatgatatgcctttcccaggctccaggtcagcacaatgctctccccactctattccccaaatgcatacctgtctccatcgcagacaccttcacatgcctggctggcaggagctcagccctgcccatctgcctgtctttgttgtgcgaccaccttcagggtcctcccttgggctcagcagtgagctgacttgccatggagccaatggagcttaggtgtcaagatccttcacttgcacaagcccctttcaacctcctctcccccaacacacaattatgtattcatgatgtattttttttcttaaagaggacctccaaattatatctaagattcaggctctgtagaacctggctctttccggccaaaatatgatctttacagagctcaacatgccttgcacacactaggtgtttaataagagctgaaggatcaaagagaatggatcctgaccatgattacaattaattaagaaagtgattaacaggaaagggaagattggtgtttctctcaggcgagctttcctaattcttcctctaccatcaaactgaaaaaagccaatagtctcccctatctcaaatccaggatcctcggaagggtttgttaagtcacagccagctggaccccacctcgcaaggatgtggttcaataggtctagagcgggacttacaatctgcatttctaacaaattcctggtgatgttgccgctgctggtccgaggccctcactctgagaatcactttgagcccctgcgttatcaataggggccatattgcccccaagagggtgaaattgtatcttgaggtgggtgatgaaaaaagtttttattataaagcagatatatatatatacacacacacatatatatacagtacacaaacagggtgcagtatatccctggtgctaaaacttcacgggtagacaattagggggtaaaaatgtctagaaagactctttaggggggcaatcatgataaaacattgagaaacactgacctggcccaagtgcctacttggtgcttactccccagcagctgagccagaagccctcacctgcagagacctgcagcccacaccatctgatactgtggaagaagcattagactgggagtcacaaaacccaggttcaaatcctagctctgcagtaacttcaggccttcccagccacacccacttcagcttctgtactgaaagagacaaagttacaaccaaaactgccagggaaagaatgctgtgcgtgcttggaagagatacatgagggggttgtttatacaaataggagtgagcaatactccacagggcattgttgagtagcaaaagcaacacattaaaccatctcccaaggaggctgggcctgtcaacggccttgcttcgctgagcatggaaaagcacgtgtcaggcagagcaggattactcggcacaagagaggccaggctggggtgggaagaatggagagacagtgcctgccagtgacaggctggggcagggcgagaacaccagggaacatgcacatcgatcctgatttgagcaagtgttctcagaggcagctctataaattccttcaccacccctaagaattttgtactttgtcgcctgcctctaaacaatgcctttggggacagcagattctttgggggtagagccaaaagaggctgagtctactttaatgttatgctggctcaaaaacagactcacacatagtgggaaccaccagactcctgggttacaagtcttgtgtctctgttaactatgtgtccaatctcccaggccctaaactaggattctttaggaatgagtatgtaacaggaaagggaagatctgtgtttccctgaagcagctttcataattcttctaccatcaacctgaaaagaaccaatagtctcctctatctctaaaccagattcccatttcttccttagaaactatgtccagtcagccaccgaaccctataagttgatcccagtggatcaactcttccgctccggtttctctgagcacctaggaactggtccctgtgtctctcctggggggatccatttcttatccaggccccagctctgcctgtccagcccaggagccacccgaaatgctaaatctgtcttcttgctaaacaagttggattgtcataactgtatagccctggtctaagtgaggttggataacagaagtggtctaggaaaactgtgtcctggggaggaggtaaagtgataaataggatgtggtcacggtgtcctaggcagtagcccctcacaatgccagtggatgtcaggatcacgaatcagggaggtctgattcggtagaagacatgagttggggaggtctgatttggtacaagagatccagaacttgtgtccagctggagtaaggagagtaaggtatagcagagacaggacaaagtaaattggacctcagagacagggcacggggcagagtctgattccaactgaaacgtaaggatccccacatccctcaacagtccctcagatggtgaggtttaggacacagtaaggaggggtggaaagagcatgggtttgggtatgtcttccctcatgaaaaccgtggagccagaagcagtagtgttacagtgatgtcatcccctgaggctcagtttcctcgtaggtaaggtgggaatggaaatgactgctgcataggctgtgagatgattttgtgagatgtaagcgcccaacagatggtggtgatgacgatgttggaatcaggtgactctagcctcttcactgtcacgcttgctctcgtctgaacgtgcttccatgtctccatattgctcttgtgtccacaagcaaaagcaataatccattgccatttaaccagcacaaaactgaatgaggctgtcaccttccttttctgaaacacatgcttcagacagcgcagtctacagtcacttgagggctgggagaagatgctgtacaatatttactcctgttgaaaattataatcaataagtccctgactgttttcatatgtgctgctactaagctaccactccctgaccttgagcagatagatttgggatccacgtgtagccctgttaaattttgtcttttcagatttagtctctccctctctctttctccccccaccacccccctctccctccaccacccacattctcatcctttatgacactatgagatacgatatctcttctagctactcgacatctgaaatgaggagaactcattcgtcatattatccaaatcagtgacaaaactcttgactaagacaaagccacgtcaaaacacaggaacccctacccccttggaagacacaccaggccattcattgatacttttggggtgcattgctcccattagtgacacaaccttaccattctcgcagccaatccatatttctcccatctttcctcatgggcatcactgagaaaccttagcaaatctgcttcccagacccttctgttctcctttcactccctcatttgatcagcctctgggtcctgctgactccaccttaaaatgcctcctgtgcaccctttcctctgcgtctctacaaccgcacgcctcacagggatttgtcatctcctcccagaacattgcagtgatttcctaacaggccccctcgcctatatacctagactctttctgggagggatttaaggtggctcagcctatgtatattcacatgtctccacctactcccaatgtgatcattacctagaggcctctcatacttttttttttttttttttaatgcctgaagtttttttgtttattcctttttgttttccagctctacccaccagtatttttttgttgatgacagatcttctcctaaaatgacaaagaatttagaaacattttccatgtatttttaacatctgcgtcagtgaacaaagaaatcatagttgatgatggggtggggagggagaaaagggaaacttaattagctttagtttttataagaacttccatcagcgctgaatgaactggaatatgacatctgattgggcctaatcacaaggaagagtacattaacttgccgtgaatatatttaccagtttttacaataccatttttaaatctctacagaagccaattttcttacaagaaaattaccctaccaagattttttttagaacaagcaaacccaaatttctttcttaccctaacccagttcatccagctctgacactgtggcctgaggacagacactgatgctatcttggagcctctgcctctccacccttcaggaatgttctgcaccctgaaggaggtaggaaaacttgaggatgcaaagaaaaaccagacatctgttatgtctcttgatgttagggagtgggagtgaaattccagctcacccactctcctggggaggctagaatttaatgggatgcttgagatgcgtgggccgagggtgaggctgcagccaaagatgcttgaggctggacctgaaggtgatttagtgaccagagggcaatgccagggagagagagccttgcacggagttagtgacactacagttcccagagtggggcaggaagaagcaggcacaccatgacatcttctcattttctttccttctctgccgttccccagatgccccctcaccaattcatcagccctttctttccttccacacaagctgctcagcactttggctctgctctggaaacatttccattcctgtgctgctacagaacccaccctccccaccagattggatgcacctggacagcaggattgtgacttagctgccatcccgagttttacctggcacacgcaggtgctaggtagtattccttcaaaacaaggaaaaggtggtgtcgcatccctacttagctcctaccgttgggttggtttgcaaattttgcattgaattccatgtaattttctcttttttttttttttgtttgtttttatgaaaacgtatcatttagcctgccttaactcttgctttgaggtcacaaatgtcaaagtggttaactccaagtcacctccaagaacattattcctattgggttaaggctccacccttttgagctctaattatctccttaatgtgtgagaactgggggaatatgttcccaaattagaaataagttctctaaaactaaggcttccaatgctgaagagaatgtacaaaatgagaaaggcatactcagtccttcacttacacagtcaaagagcaatttttagggcactcccatgtgccagacagcccaacaggctttagggaggcacaaggatgaagaggacatggttatcagcacccccaagcaactctcagcctgtagagctttcctaatcattcaacaggtatttgaggtgctgaaacattgtttaaaaaaaaaaaaaaaaagcccaggtgcaaacacttctatcagatgtgccatgcatcattgacaatagtatacacatattatttataatatgtataggtgctttataaatattaactcattttatctccataataactgagctatggacaataaatgattattatggacaatctcttaaccctcacaattcagacagtgttgctaatcccatgtcaaaaagggggaaactgaggtgcagaaaagttaactttcccagagtcacacagcctcttaagtggtagaaccaagattttatttgtcttcctggtgtaagagaacttggtgggttccttaaaccctgttcaggatctgtcactggatttgcctgttgtgcattcagaggctggagaaggagtggagggggcagagtccaaggtaggacactaagagtcagggagaggtgatttgtgaaaggctttaggggcagcgccagcctctggataacagggaccctggtggtaccaaggaatcattggcaggactctgggagatgaggacttggtctgcatggggcagcacctcgcatctgatactggcgcatatcagcaccctactggacacattcaaacaggcagcaccctgtgagtgtctcagcaccagcacatcaaccttccaattcaccaactcactccagggaatgtgaagggcagggttccactgggccgcaccacccagcccggggtggccccaaaggcagaggggatgtgagtgctgtctctgtgagcctaagtaggccctgcacctgccagagacagggcacagagcaagtgtctgagggcaagtcacctggacacagcagtggcagaaaccaaggagtaggcatgccaggcaggtctccagcagcctctgagtttccaggcacagggcccacaccagggtggactttttatatgtacatacacacccacacacccacacccccacccaaacacacacactgcaccagtcccgtttcctcagatggacatttttcagaagaaagccaatgacactagcaagtccatgacccatttcaagatatgacaggacatcattttccaagtggagaaaacaaaaattctcagaaagccctgtataccacagaaatccatacaccagtttcaagtctcatccaacagaccagccagagtgcagggccacagggcaccctggctggagtgaacaagctccctccaaaccccctcaagattctaggcccaccagcataaaagtcctcttgatggtggggtcattccaaccccatctggggttgtaacctctcagagcagaggaaaataaacaggctgttgtcaggcagcccagggcagaagtgatgacacctgctcattctgaatttatctttattatacattatggccacctgtggaccattcagaaaagatgctttttgagtctcaagcaagtgactctttaagccgaatcacaaagaaattcccattttggccagttctgtttctggacgtcaacacccccctctctgtatgaataaggggtcttccagatggccaggaacagcactcaacaggccaaaacaaagcagagggtggcttgagaactacactgctacattcagcctgaggcccagcatcgacctggccttctcccacttccaacaactcattttgtagctttttggttaagaacaaatttggatttcttctttttctcctcccagtaatctcaaatgtatcagaagaaaggaaatttctaccattattgtcagaaacaagacaagtaaaaggccatcctcaaatactagtgttctcttcaccagacagcagcacacgtggagagtagcagatctctaagcacgacccagtgtgtaactccaaatggccccattatcctatctcgaggagagctgcgcatgctgtaccctgttttacatggcctgccatgcttctggtagcaaagcagtaatctcctggttatgtagcactggggatgccaataacagccagataaagaatagaactcatgaggccagttattttcagtcaaaccaagctacaaaaaccacagtcatgcagaagctggaggaaccaccaaggcaaagagaatggaaattcccttatgctagacagcacaggtccccagttttctgggacatctgaaacttgatgtgacagcactgggagaggccaacagtccacgaataggccaggacctaaggggaaaggctaccactctacagccggccatcagggtgctgggctacagcagggctggcaggagcagacggaggccacatgccaactccagcctctgctacatatggtcccagcccccctactcaccagccatgtggcctcaggcaagtgggataatccccgtgtctcagtttcctcatctttaaaaagtgggataataaaagattcatgtactttatagggttgttgtgaggatcaaatgatttaatatacaaaaaaatgttgacaacagggctcaacacaaagtgtgctcaacagctgctgttggtattggtggtggtggtgaatggtctgccagcttggtagggatgtctatgaagtgggacaaacatttcatgagtatgaagatagactgttcagatgatactcatctaatgccattggcagctcctctctttattgtaccaagatctgtttccttcacgtttcacccaacgtcaaccagcccttcccttctttggactaagtctcccttcaacacatcctcaaatgacacagtttccagtcccctcactcttagtcaccctccttggaacaagctcaagttgctaaacaactatctctaaagccagttcccacccgagccaacattccaaggccaaaaaccatcacctctatcatgagttgagtatcctgctttcattaggggactgcactgacgtggctgcaggttgctggtcagccctagggagccagtaccatacagccccgcgagctccctcctcacaagaggcggctgttgcctccttgtgccagagctcctgggctttggatagaggaattccactgcttgggtctcatccttactcaccaacttggaggaacttccttagagtggatggcagccgcccctccccactctgtctctgtggtgtgtgccccacctaggctgtgtttgggtgcctgtagtacctcttcctgttcttgtctcaaacacacacctgtggggctcctttcccagcaccgtgcttcacaacggggctctccttagcccaggaggggagaggctgtgcagaaaggagacttctatgacacccttggggcaagggtgttgttttgctccttccatagatctctgaagccacagctatgcaggagaacagaaatagaagccagccacacccagtcttctttggcatgggcacgttgaacgggctcagttctcctgccacgactgaaagggcaccctcccacagaaggcacatgaccactgttccaagacagtccagatcaggagagaggcctttgaccagggcaaagcaggtgctgatgagaaggcacagcaaaggtggcccaagccactctgcctattccctatccctcccctgttaactccactcacaattccaaacccagagccctagcttctgagatatccaggtaggcgacaagattttctttctccacatgatacagactgctgagaggctcccctaacaaagcaccagtattctccctgaagacacaggctcaaattatgctctattcaaagctggctgtgttcccaactcctaagccctgctggctccctctgccccccaccctgacgtgggggaagatgctacaggtgtgggggtgtgttagtccattctcacactgctaataaagacatatttgagaaatacccgagactaggtaatttatagaggaaacaagcttaactgactcacagttcagcatggcttgggaggcctcaggaaacttacaatcattgcagaggaggaagcaaacacatccttccgcaaatggtggcaacaaggagaaatgcccagcgaaggggtaggggaagctccttataaaaccatcagatctcgtgagaactcactgtcacaagaacaagctgggggaaaccacgcccatgattcaatgatcttcacctggtccctcccaggacatgtggggattatgggaactacaattcaatatgagatttaggtggggacacaggcaaatcataggagtggggaaaccaggagaacagggaaataaaattggttttcacaatagctaaactttccctatcctcttgagagtatttctaagcaaaagagaaatatacttttctttttgctttctctaaaaaaagaaggaaagaaggaaggaagaaaaaaatggagggagaggaggagggaaggaaggaaggaaggaagcaaagaagaaaggaaggtcaaactgacttgatttagctcattattaaacatgcaaataagaaaattcctgttcttggaatgtgatcagtcatctgcataaggtcttgcgacatatctacgattgaattatttctttgaatcaaggattcccccggccacacacaaatcagtacttgccttactttggaaaacgaaaagagctcactaaagtggtccctcttataataaggtgagagtggcctctaggacaaatttcagcttgtacaattctggaatacagaaagggtagctggctagcgacctttttccatactccaccaggcactgtgtaggggctaagggaaagcttcccctttgccctctgaaagctcactgaaaactcacagaagacagattagtagaagaaaaggcatacgaatttattttaacatgtctagcactggaggatccatagagaacaattacccattaacccttcttcataggggaaggggagatgggggaaatgtggcaatttgagggatggtaaatgatttttagggggagacgagtggacttggggaacttacaatggccatggacaaagtctgttgggacttcagagcagacaagggctggtaaatgattctctttgaaatactgaatgagcaccaaaacagaagacgatggtttgtgacaaaatactgtccaggtgtgttgacagacttcagtctttcttcctgtgatatgggttcagttgatgaaaactcagggaggagactagaggtaattgctttcttccttggtatttccagactttaggcagataagggatgaagagaacaacttcatccagagctttgggagagatgaagaattgagagatggggtagggccaagggtggggggtagggagtgaagatcagagagaccctgaggctcttcttatttcagcatgtcaaagcaccatattttggggtaacagttgctgagccccaacaactgccaccccatagtcaaattaagccgatcatccccaaagcaatattagtccagtccagttcctctcatgacaaatgacctgaacacaggattcagcgagtcttactcgctgtggtcattttggaggtagggagatcattaacccacatactttgataaaatacgaaacgcctttcctagctggttcttttcctctcctataggccgacccccctccatccctttattagtattgaactgaacaaattagttaatatgggaacatttggatgtatcaactttgctctgaaacaaaaatgtattcatccccaaactctatgctgggggctgagggagagtccttacgactgacatagtccccaacaaggttctcattagtcccagtttttttttgacaccttttcctccgcattcacatccttctgccctctccagcactgtgcaggaagaaccaaccaacctgaccttggtgaaagggctgtgggtttttcaacccttcattcctgctactttttttttttaattttttagtattcttctgtgcatcctttcttctctcctaggcttctcacccagcctctctgttgagtactacttgtagacagagctccctcattcacaacatcccaatgtatttgtcctgtatcaaagcaaaccttatacagtagctcttttaagaactgctaaaggaatgaaggaacaaaactgagccaaataaagcaaaatgaagaggatatgtatgcaggcaattgtgggaacatatcaccagaatcctctcttgttattgtacccaaatccacacattctcctcagtgttgtctgggaaatacatcaatccactgtgaatggtttagatagaatagaatccatcaatttcaccagcttcattcctcctcagatgatgagccactttctccactccacctccagggctggccccagtcttcctaaatgttcattaactcctattaggtattccgaaactctcaggttttctgagccagcatagaatggttggaaaagcaattgctgtagaatcaagaagactgaaattggaatactggagcaactacctactagccacaggcaggttactctctctgagtctcaggttccccatttgcaaaatgaagcaaagctatctactccaaggattgctgtgaagattaaaagaccacgtgctaacctaataggtgttcagtaaataaatatatttttctatttttccctgcaaaattcatttcccaaacacaatctttgttcttttttttaacatataatagccatactatggcttaccaactccccagtaagccaggactctctgtatacgcagtgttttgccacatcatttacatggatgaaattgtttcctatactcccaaatttaccctgcttggtggccaagaatcacttctgtccctattactagtgatatcatgtctgcatttggaaacagacaagtgttatacaaaattacataatctgataggaatgctgtcaatggatatctattattatatttaccagtcaaaattttagttcttataactggtatcaccaattaaaaaattttataagaaaggggtttttgtaccattggatctattgaatcattaaaaaaaaagagtttagaaaaagaagaagctatttatatactatttcattccataagactttatccagttccactgttaataaaatgtacatgcgcagaattgtattgttttctccattactaaacatgtatttgctgagtaccttctgaatgccaacatggtgctaggtactgggcatagggtggaagacacaatagacaaggacacagctccctggtatgggaaacagatactttatgtcttcagttgtaaggtccactgttgttcctatttaatatctttgaatgtggaatatatcttacaatgctgtgggctagggcatggttgtgacattgataaaaagggctcttaactgccatcgcttcagttgacttgcttgcctttttgagtggcagtgcatggcttgagcttaatttccattcagaaggtttttgaaaagactaactcattatttgcacataaaaaggcacagagacagaggtgaggcataaatttgatattcatcattagagtaaccatcatcctatgttttcttacaaagtaacaaaaagtgttttatgaaatgtaatcacaatatatgaagctgtgctttactggtgcacatgcaagaggattgcccatcaggctctaagcaaagcaactaagagtaggagaaactgccaaaccctaaagtaggggaaagaaatctccaaacaacaagaggcactgtgaccaattcacataagactatcactaagacatcaggttttaacttgtaacttgcttttttccttgttagtggtatgttaaacaatggtatatcatgctatttgtgtatactggattcaatgaaatactataataaacaagtaagcaaaacataagatcataacacgtcctgaaaggacctctcagcaagagtgacacattgccaagtaatgcacattgttccacatggagttggtgaggataacagcacttccttccagaaatactttagtatacaaagtgctgtcacgtgatgacgtctcatttcagcatctcaacaaccgcacctggaaggccttattattttgtatatttacggatgaagagactggatctcaaatagcttaagagacttccctaacataactcagctaatgcctggaagacccaaaactagaatccagggctcctgactctacatcctatgtttttcttctcggctacatgaaatggtacaaaatacgaattaaatgattatccatggtcttgtgtaattctggcatgtttccagctaagacttctcagctgttcattcaactcaaaggcatccttcagtcctcttccccattcttctctgtctcggggatctgcctggggagagagtgtggtgaaagcagagtaactgaatcctcactaaccccaaggccctaacgcaaggagatgcaggcaataaatcattccattgcatttaccattgcattgcatttaccattgcattgcatttacccatacgtggggctctccagggatggcatcagatgctgcaggaacatgaatgataaataccacatcccaagggttagggcccaggcaagttctcaggggagagctatacatatgactggtaaaacccactatgtccagaagacaagggcaccctgctggtttgcatgagcaaagctaaattggcgctgacaactggcaataggtattgagagtctttttaaaagttgatgtcacttaatctagtaatcccatttccaggaattcattcaaagagaattaatctgggatatagagaaaggtctatgaataagattgcatcacagtgtggtttacatttggaaaaaactgtggttgtaacttaagttacaacagtagagggttgttcaaatattataattctggtacaaccacacgttaggattctctcttgccaattattgatgtcgtgggggagtgttcaagacaaaacattgagttataaaatcaggattctaaattatatatatacacacacatacacacaattaaactcaaacatacacatggagacacacacagcattttaaaacctagaaggaaatcacaaccataatacaatagttatctctgattatgggaatacaggtaattttggtgattttctctatgttttcttttttttctttttcttttttttttttgagacggagtctcaatctgttgccccaggctggagtgcaatggcatgatctcagctcactgcaacctccttctcccaggttcaagcgattctcctgcctcagcctccccagtagctgagactacaggcatgagccaccaagcctgactaatttttgtatttttagtagagatggggttttaccatgtttgccaggctggtctcgaactcctgacgtcaggtcatccacctgcctcggcctaccaaagtgttgttgggattacaggcatgagccactgcacctggctgtttttctctaagttttctacaatgttttattttgctttttaagacagaaagtccacgcaaaccagtcaggaatagatgtgaaaaatggggatggggcctttgaaccaggagcaatatgagaaggtgagaaggatggcctgggccggctgggtctgcgagactacctggaaaagccacgggaatcacagcccacagggtgacatctccagatccagcagtcttttaggaaggcagatggagtctcagacctgtcccacccatcttaaagtggcctggtcacagggtcagagcttcagcagacagaggcgccctgggataagttgccaaatatgggttgagcaacagtggcactggaacgaggtaggaggcggggaaaggggatggaaggtaaaatcctgcccctgtcctcaaggtacttacagtcaatgtgaggaaggctgacagccataaaatgatgacctatgacaacgagggtcgttccacacacatcctccagaccccggcacaagacctccgcctttcatctccattatattgggcaaaacacaaagcatcaacgaaaaaaaaaaaaaagtaaaagtacatagaaaaggagacacagaggaatacagaaaagcaaaaacctccttcaaactggtggatgtttcatcccaaaggacgctcgacctttctcaggcatcctgccactgaagaagtcaattactcacggcccacagtccctaggttccgctcagcacagtctggaatcaagggttcatttaatggaagcttaacagattcagatttctctaatattccacatccccttctgccaagaagctgctttgaaagatgacactcccttgatgtgaatttgcagcctgccccattaacaaggcttcagtcagaaaacatttttaaatcaaccctgttccagacacttgctcccaaggacaaactagaagaaactctgcaccagctcaaaccttccaagcactttgatgatcagaaatgaagggaaatattagaacaaatcttattaatccaaatattctcaacaatcttcaaagcaaaccgttgctctgggctgcagaaagcagagctcatgcagagccggccctttctgtcctaactcctgttagccaagccagccccctaaaaacagacctcagaacagcagagggaaacattcagaatcaaaggtgatgggaggaaaaaggaagaggaaacaggtaaatgaaagaaggaggatgaggattggaaagctgactacttaaacttttagcacgtccctcaaataaaaggataaggtgttgtatgccacactgcctcaaagcaactccctcagttcacagttgtgcagctgagaattctggagaaaccccacggcagctggcatctatgtcctggctccactcacaaggggctgagaaccccaggactcctcaccatgcacatttctcttgggtgtggtgggaggagcatttccgtttccaaacctcggggccatttgctcttagatacacaaacatctccccagcctttgccaagttcacccagccagaaggccataatgcagaattagtagcatttcaatcatttccgtgacgagctggtgacaggctggaatatgatgagtgaagcaatcagatgttgttacaggaaagaggcatgagaagagaatgacaacagagtggtacagtaataagcatcatcgtaaaagcccccactggcatcaagtttatcatcgccagcataactaaaggagccagaacacctgtttgtaatggggattccagctcctccactttctagctgtgtggctgagcacgcttctcgccctttctaagtcttggctgagcatctgtggaaggtggatagcaatcgctacttcataagattgtttagtgattaaagtcaaacaatgtctataaggcatttgcaaagcattagcagtaccagtagtaccagtagtagtagaagtagtagtagtatttggtattataaggagtattttatattatttcaaataggattatgcactatttcattatacccttatctcatatagaagacatttttaatgctatttgattgaaagtagaccagagactcagaaaggttaaacctctttcctagtaagtataaaaagttaatgcaggccaggtgcagtggctcacgtctggaatcccaacactttgggaggccaaggcgggaggatcacctgaggtcaggagtttgagaccagcctggcaaacatggcaaaaccccatctccagtaaaaatacaaaaattagccaggcatggtggtgcacacctgtaatcccagctacttcggaggctgaggcaggagaacagcctgaacccaggaggcagaggttgtggtgagccaagatggtgccacagcactccagcctggacgacagagtgacactccatctcaaaaaaagttaatgcagaaataaggctgcatatcggtttcctattgcttctgttaacaaattactacaaatttaattagttaaattgacactatcttacagttctggagtcaaaagtcctaaaattaaggtgtcaacagaactgtgtttcttctggagactctgaggacagaatccgtttcctcacctttttcagcttctagaggccacctacgttccttggcttgtggctccttcctatatctttaaagccagcagcatagcatcttccagtttctctctctgattctaagcctcttgcctctttcttataagaacccttgtgattacattgggcccattcaaagaaacaaggataatctccccctctcaagatccttaccttaatcacatctgcaaagtcccttttccatataaggtaacatattctaggttctggggattcagatgtggacaaatttggaggtggtcattattcagcctaccataaactggatcctgttctgcagaacatagctatttggagcaagaatgggagttttgtttgctttgctttaaactctttcatttctttactcagcaaataccatagagcagctactatgtgcagggcacattcataactcataacctcctcctctctggatataaccacatcagaatcgagcttcattagtgtgatataaaagaggtctttgcatatacacacacatatatatatatatatatatctcaaaatatcaccaaaacccatactttaaaaaacaaaaagggcctttggagatcatcagccaatccccttattctataaaggggcagaggagtaatacaactatcccagtgtcaaatagggagtttgtgagacataatgagggcctgaattagatctggaggaaaaaaagtaaatggaggtatttttgagaaaaatcagtgagctgaacggcaatagggtaggagaaatgtaggggtcaagggtgcctaaagttcatggcttggggatgtcactcacagagctggggacagatagaggaaagacacttttgagggaaaatatgtattcagtgtgttctagaactcggatctcttcttagtgtcactgtgaaattttccattacttcatctcacttcctgttctctcataagcgcgaacacggggctgtaatcatcgtctgaccaccacatgttagtgcactgtgtttcttgctgacacctggctaggctttgaggatgagtttccatcccaacatctaccaacatacaaggagcccaaggcaatgggattttctgcgcatctttgcttgaaccttaaaggtgctgccccattgtcttctggtaggcctcgtttctgggaagacgtctattgaattcttatctttgtcactgagtatgcagtttgactttttacctctagcttcttttttttttttttttttttttttggtcactggttttcagcaatttgattattctgtggcttggtgtagtttccctcatattttttgtgttttgagatcattgatcatcttggatctatgtatttagtgctttcatcaaatgtagatatttttccaccattattatttctttaagcatttcttctgtcccctttcttgtctcctttggaattttcaattacatatatatgaggcctcttaaaattgcccgacagctccctgatgttctgttaatttattttcagcctttattctctgtgtttcaaatggatggtttctgttgctgtgaattcaagtccactaatcttttcttctgcaatgtgtaatctgttattcatcccacctaatgtatttcatatctcagacattgatttttgaatctctagaagttcagtttagacttcttatatctcccatatttcttcttagcatgcttacattttcttctaccatcttgaataaatgaaatatagttataagaactgttttaatgttcttgtggactaattttaccatctataacaattctaggttggttttgattgattgatttttctcttcattatgggttgtattttcctgcttctttgcatgcctggtaatttttgactagataccggacattgtgaattttacctaattggtgctgggtattcctacattattttaaatgttcttcagctttgtcctggggtgcagttaaattacttggaaatagtttgacccttttgagacttgctttaaaactttgttagatgggaccagaacagcctttagtctagggcaaatttgccccttgaatccaaacactgtttatgttgttaatgatgacaaaatatccatgtcccacactattccttactaagtctcccttcaacaattgtgtttgagtagaactgttaactgcctcacctcactctcctgtgtattcacaaggcaaagatccccaaggttttgaccaatacccaatgttgttttggtgccagcttgcacagcaccagggctcttgcctctcagagagaattgtgccccctctctccactatgtggcacagcacattgagctcaacaacgttctatcagactgatgttgccataacactgcatatcttcacccaggaggggcgacagccctaagtctcttatgtggcaaaataaaatccaactttcagtgctaaaaaggccctgcttttctggagcgaaccccttcagaggtctcacaagcatttaaaagagaatttctagaccacaagtttcagtgtggagagctgcaggcttagagaattgcagggatgtttgaagccctgcccacagttccaggaaacaccctttgtatatgagctcctttcccacacaaatgtgagaaggaggctatgaccctggaaattgaacacagggcaacagaaaccctgccgaaactattcttgcattgacattagacacaaaaacacccatataagcttgatttgctgtcacagtcaaataaaacaataacatgtaagcatttcaaagagattccactgacattctcacttgtgattctgacaacaagcgtgtaagtaagaaaggcaggcgtcacagctcctaagtgacagacgaggaaatcagccttgcggaggttaaatgatctcaacaaggtcagacagctagttggtgcaaagtggggccctgaacccagatcttctgactcttggtcaagagctctattcattccgctgtgtctgctctcttactatatcagaaaagggaacagccaccaacttcctgtgttgaccctagaccaggacttcttgatgacagcacacttaacatttggggctggataattctttgttgtgagaggctgtcctgtgcattgaagggtgttgagcagtatccctggcctctacccactaatgccagtagaactccccttgccccctgttttgacaaccaaaactatctccaggtgttgccatgtttccaaatgccccaaggtgggggaaggtaacagcagagcaaacttacccctcagttgaaaaccactgccctaaatgatgcctgagaatgctgtccacgtgtttgagaaagcagtggtgattaagttagttctgtgaaaggagaaacaaaatcaaaagaggaacttgtgctgataccagtgagtctgggaccacgaaacttggccgtgagagacagaattgtgcagcaccagggagttatctaaaaagttctcttctgggccaccctctgaacttaaccttctgtgttctcgctccactccttcaggctcagtcagctctgcaaaacccaatccactttccaaggaaacatttctggaaggcaacacggaattagttaatgtgatgagaggcagaacagagcagttaagatgcaggctctgcacataccacaacgtggatgaatctcacttaatgttgggtgagaagagccaggcccaaaagagcatctattgtgtgaatctactaactcgaagttcaagagcaggcaaaactaatctccggtgatggaagtctgaacagttacatctgctggtggtgttgcctggagacacgtttcagagaatagaaatgttctctgccttgatggtggtggtggttacggtggttgtaaacataatagacactcacaacactcacagagctatacacttaggattcgtcacctaaaaaaaaaaagaaagaaaaagaaaagaaaagaatgttgactctagaaccaaattgtctaagtttcatccctgaggatgactctggttaccttagagcattttgtgaaaagttaataaactacacagggtatacaggaagtgcacaataagtatttgcatcattataattaacagaactacacttcagccaagcgcagtggctcacgcctgtaatcccagaacttcaggaggccgaggcaggcagatcacgaggtcaggagatcgagaccatcctggctaatatggtgaaaccctttctctactaaaaatacaaaaaaaaattagccgagcgtggtggcaggtgcctgtagtcccagctactcgggaggccaaagcaggagaatggcgtgaacccgggaggcggagcttgcagtgagccgagattgtgccactgcactccagcctgggtgacacagagagactctgtctcaaaaaaaaaaaaaaagaaaaaaaagaactacacttctagccagtcaggcaaagccaaggattaagagagttactctgaatttctctgctgccccctctgcctcacctcccatgcattgaacacagagtgtatatgtaagtcctcccaccccaaccatcaagacaggcacatctgccatttttctctgtcttcttcagttccttccaggttctctctgccttgcttaggagctgcccctgtttgcagagctcttcatcaatagactgaatatttacagaatagcgcagttttgattaaacagttcatttcactggagactggggtggtgtattgtgtctcctccggagttattcttggcatcagcagcccttgctcttagcatccgtttctttacattttaaggtggagcataagaagaactgcagtgaaacagatcagatggggggcaggtgggatttctctttacctttccccggctatttcttggtggatttatcccgttatcttcgctgctatttgctccttgctatcttttattcttctcttttgaaactggccgagtcagaaggaaataaacaaatgcaagggtgtgtagaaagagcattagatggtaggtccagaaacttggactctacatccagcatctagtgatgtgattgattgatatctgttttagcttttcggcacctcaggttttgggctgttttttttttttttttttttttaatctgttaattgaagtgattggtctagatttgtggtctttgaatgtgtgtcagccatggaaaccttcctacaaacagaatctcaagcagcaaatgttaaaacctaaaagcaattttgtttgggttgaaacaaggtgggcgggcagtcaggaacccacccttttaacttctgtgtcctctgccatctcctgtagcagcccccaaagtagttccacaagatccttggccttgggatgctagagcacaacgtctaaaccattcgatgtgcctatttagaaactcatttcctgctcttaaagcgctcagccctctcccctacacataaagccttgcctccatgaaagcagggaggactagccttcgaaaccccagcacacagaggtgagtgtgagcacagctcaacagtatacaagcccgctggaaagctgccccagacagaatttcctcagttgcatcctatggactatcagtcccagaaacgcttggccaaaaaaggaaatacggagggcgggggcagcttgcttcaaagtaattgaggttgagagccgctgtataccatctgccccttctagagattaaattcacagtagcttcttctctcgggccagcaggaagcctgattaatgccgcttaatacgacacttcccatatttatttggccacaaaactcctttttccccataactcctattaatatcacaggaaacagtttgagatcagaaaagccttcacaaaggcaatttttaaagactgagttataaggctcaaaataaatgaggaattctagaaaaggaagggaggagggagaaggacactggtttggggtctggagggctttaagatgagggcgaaacaaggaccacccatgattccaaagaatgtccggaacttgcttgctgtctgttggtgcctttctttcagctcattcctagagggcggacagaggcaggagttgctgtgttgctggccagtggctcctgaccataggaaggggactgtgggtgtgagaagtaaagcagagcaggcccctgcctctgttctccccttccgcctggtattggctcaccgtgacaaatctttccctaggaagggcagaaaatgaattatcctgttaaatcaattcagcagataacccacctctgtgcaggccttgtgctgggaccacacagatgcataagacacgtacagcttagagcctagtcatgaaatgggaaataaacagccccatcctcacggtctgaacaggggattggggagcacagagaagggccccaccccgaccagctgtcaagagaactatccatacattctaattcctccaaggttgagggctaaggtgtaggaagaggagagaggttccaagcagaaggaattgcagaagcaaaggcacagaggcatccgggacctgcgagcagctatggctggagccgcgtgtcgcaggatggagagcgtgtgaacagaggggactggaagcggatcctcccaggaagcagttgcaggcggtcatgctacagtgagttgctgatagtaggaggggaagaaagaggaagggggagtggaagatgactcagtggggggtgagccagtgcctggaagagaggaatgtgtgagcagaatgaggaagttagcaaaagctggttgaaggtaggaggtggaaagacaagttcagccctcaacaagttaagcaggttatataagaagtccaggcatggatgacgatgatcataatcatgatggggaggatgacaaagatgactaggaacgctctgtcatctctctctctctctctctctctctctttccttcctggttgtgtgagtttgcagggagacgggaggttgtgaagaacaataaccagaagagagtttgcgtcttcatcagaaagcacctggggcaggtagagttggtgctagcttctccatccatccctgacaccccagccccattcatcattcagcagaagacaggctgggctggcccaacttggtcctgtacccccaccaccccagaaccccactggtccatagtgaggatcccttctctttgactctcctccttctctgtgactcgcctaagcctgatcctacaccttctctcccagccactgcctcagcttcctccacccccagcttgggacgagccacctccctggctgggtagcatgggacaagccatctccctgcagaggcagagaaccagtgacactacacgcaaaccaaggccatgctgcaaacagaacaccaaggcaccctcgtcttaggatgcattatattcggggtagatgttgaattctagtaacacattccctggggtgttttcaaatccagacacactggagccttgttccagcctcactgtgggcgaaggccccgggctcacctccagcctcaggctggctctggctgctgcccctgttccatcctggcaagcggaactgaacaggcccgactccacagcccccggtgctgccagctgcaagctctgctgactccaacctcaggcccctgcgtgcctgcttctaaatccacacgttcctgctccttcctgcccctgctgccctctcagaatgccacttctttctgccaagacctcaggcattgctatggcccagccccatctttattgatgtcggggctctgtccccttgcagagcccatcccattgccacccacatctgggacagcaaaagacttctcagtttcctccagagttcagtttcttccaaaaagctcggcacatcttagctgccagtgtgaactgtgagctcccagagatgcccgtggcactttccaacattcgtcacttttgacacatctaaaatatcctagctcccagagctgcgtgagcaccagcccagatggaccggctgctggggaagcatcagtctctccagggcctctgtgaagccctggggcagtagggggatgtctgacaaagcttcctaactgaggagccccacttcctctcgctctgggcacccctgccaaataagcgggcacctctatgttccagcagccctcgctgcccagcttctgagctgcaagccagcttccttccacagaattctctgcaccttggcttccggtggctccaagcactttgccatctgccgagtcagttctgccagagatgaagcagctgatgtggggagttctctgtgggggccacctttcctctctcaggtcacctttactctcagaaggaaactgaccccctgacctattaaatagctgaaatcaagggccactaggggcccaagtcggtgaaggtgcaactgaaggcaagaaggtcagcatctagctagacagacacgtaagccaagaagacagacgaggtgagtggaccctttgactccacagtcagacagcaagagagctactcccagagttctctggggcacgaaggggctgcaggggtaggtgaacagcatccagagaaatagttatcatggaaagtgcaagcaggaaacaagctgggatttttttttttatttaaaattatttttcaggccaggcacagaggctcacgcctataatcccaacactttgggagcccgaggcaggaggatcacttgaggccaggagtttgagaccagcctgagcaacacagtgaggccctgtgtctatgataaataaataaataaataaattagctagtggagcagggctggtggcatgtgcctgcgatcccagctacttgagaagctgaggagggaggatcgcttgagcccaagaggtcaaggctgcagtgagctacgatcactacactccagcccaggcaacagagccagaacttgtctctaaaaatacaaagaaataaaagaaaagaaattcttttaaggaagtaaatactaacatggctcagaaattaaaagaatgtaaaatagaatagatttgcaaaatctcacccccatcccacgatgtccatatccattccctcctccccctttcccaccatgggtaaccacttatattcatctcatctgtatcgttccaacataaccttacgcagctgaaagccaacatggagttatttacttatgcccccacccttccacaaaagtatcacactttagatactgttctgcaccttactttggcaactcagcagtacattctagaaatcttttcaaatcagtacagagtgtttctttagtcaagctgcaaagtattccattgagggatatgtccccgttcagttatctagacactagatggacacttgggatgtttccagtattttacaattacagacaatcctgcaatgaatgaccttgcattaatttcatttcgtaagtgtgcagatatagccacagggtagagtcccatgcaggaaatgctgagtaaagagaaaatgcatttgtaactttcatagctgttgccaaatccctctccattggagttgcaccattttgcattcctgccagtgtctccatcaaggtgtgtggtcacactttttaatgtttaccaatctgatggttgagacttgtgtctcagtatatatttactttgtatttttcatcttaggagtgaggttgaggatcttttcatatgtcaaagggccattcatattcctttttctgtgaaacggctcctcatgtccttggttggcccattttttgttctgtgggttgctgtccttggtctccttgatttctaggcattctatagatatcggggatattcgccctttgtgttatgagttgcaattattttttctcactttattgttcattttttgcctctgcttatggtctttttttaatttagttggtcatacagaagttttttgtttgctttaatgtagtctaatttaacaatcttttacagcttctgaattttgaatcacagagggagattcttattcaaaaggttatcaaggaattagcccatattttttttctggtcattttatgattcctgttatttcatttaaaaattggatccatttggagtttttcctgatgtatgatgagaggtatggaccaaacttataacttttcatctttttccagatctcccaatactattttttaaagtccatctttaccccagcactttgagaaattagatttccactgcccagaacaacctggccaatttgagaagtcacttctatcaaatactgaatgcaaacatatgcatttgagtgttctgggtttctattctgcttctttatccaagctcctgtatacacagcttgaattactgaatctttacggtacgtgttagtatgaaataggacaaatcttcccccatagtcctttttagttcagagctcccctggccatttactggcaagctgagctctgtcactggggctctccttgctcactgtcatgttttattctcttctctcctacaaggaggccaatatatgcctgcaggcatccaaccagggaaagaggcaagcacagcccactccccaaacaaggcagaggcaggggtgcaaggccttctgggagagtcccagtaggccatgtctatgtacccctttgaggccggtgttctggggaaaggccaaataggagacctatgtcttcctggaggtttggactttgccctgaagattctcagcactgatcttctggtccatccaatctgtttaaatgagggtgatcccagataacctcaacataaagagttatcctgtctgatattctgtctcctcatgatctgttactgatcaggtgcagaagaacccttcaaggaggaagatgttacaatagcaatatcaatgcctacttctactaccaccaatgccaccagggccacctttattcattgagaacctgctatataccaggcattgtgggaggtactttacacgtttatctcattcacttacaaccccatgaggaaaccatctgtaaacgtgcccagaattgtggctcattagcggcagagccaagctttggatcccagcctggttccaaaactcatactcttcaccactgggcaacttcttctcagaatgatctgccaccctgggatgatgcaaattcccaggcctcccagacctactgaatcagctgctctgggaatggcacccaggagtctgcatctccagcacatgaatacatgagaaccactgctcacaaatgtaaaaagttaggtaatatatcagggaggctgtgaggatgagtgtttccttagcagtggtgtaagggcagaaccctggctggagtgttttgcagtcagactgatttcctcattagcagagagtgttaaccggtagcctagtttggctcctcgaggtgcctgattcagacagagcatcccacagctggagcaccctagctggtggaggcagggactcagccaagtaggctccagagctgccacctaagcccagtagatttctcttgcccagaacaacctggccaaatggaagatgggaggctgaaatcctcactccaaggaggggcctccttttcttggcacaaaggcaccgcaccaagctacacagctaaggcagtgtgctacctaaagcaggtgcacagaattcacagagaggtaccaaataggctggcaaagaccttggtggataagtacccacaaatatctggaaggaactatgttgggttgagacatgagaaggaagagatcttaggcaagtttggaaagggaaacaacacattgaatgccaacccctggactagacatttcatcaacttcgttcatcctcactaccacccacacaagacggtcttcctatttccaacttagaagaaggaagttgaggctcctactggttaagcaagcttcccaaggccatacagctaataagtgttaaacaatcaaacacagaactgactggctccaaagccagtgcccgccccactggccactccactaccctgcctctgccattgctccctatggcaacctggaaactgtggggtacctgcccgtggtctgaagtgggcaggcagcagtcagctgggcctccagatatgggtggtgaagggaggatacaggtccaaaagaatatcttaggggaaatagtgcacatgcccagaaaacttttatagtctcagaacttagatgtgcggagaaatcgaattctggtcctggtttgcttttttagccagttgtgggccttggcagtcactgaacccctccttatttcttcatgaggaaattaacatgcctaggataggaaccgctgtgctgcagaccccagggtcaggcaagtctcaaagaagatgagagtcaccaagggcctcaggaaagctgaagggcacagggtgcatgctgcagccatgacctcaacctctgtgagtctagaggtgaccatattggccacacataagctcaccttccccctacatttcataatccttccctcccatcagggccagcctttgattaaaattcccaagattatctgaggagctggcggtaccacccaccaatggagttcatctggctgcctttacaccagccaccttatggctgggtgggcactttcctattcttcggccaacacaacactttccaaactgtgtgacagttgtttatttacttgcctctaccataagaccatgagctttttgaaagcatggtctgtcttattcactgttaggtatcacagtgtattcacaatccctgacacatagtaggtgcttaataaatgtgtggttgaatgaataaatgaattaatgaatgaatgaatgaatgaatgggatcagggtgggccttcagtctctaaaagcatacccaagagccagccctctcagccgcaggtccgcacatggggaagccctagggaggttcaaggactagatcaggcccattttctcatcaggcagcccccaaacctctgccccaaagagcacatccaacatgctttcagcccacactccccacccacggtttactgcctgtaatcccagctactcgggaggccgaggcaggagaatcgcttgaactcgagaggcagaggttgcagtgagccgagaccaccccattgcactccagcctgagtgacaagagcaaaactctgtctcaaaaaaaaaaaaaaaaagaataaccttgggctgtttggccaagttaatgcttaatgctttcctcatgctgcaagcgtttatctttgcccagattccagctccagggaggggaacattcctgcagaacagccaggcgttcccaggtcacctctgctctcactctcacttttctttttgcatgattaaatccggcctaaaaacacgtctcaggggcacatatctgtcactcataataatcctataaggtaggtactactgttagtcttattatatagttgagacacagagaggttaaataactagcccaaggtcacacagttaataagtagcagagctgggatttaagccaggcaatctggctccagagctcggtgcctttttttttctttgacagggtttggctctgtcacctgagctggagtgcagtggcacaatcactgctcactgcagtctcgacctcgctcaggtgatcctcccacctcaacctcccaagtagctgggactacaggcacgcaccaccatacccagctagagcccaagctcctaaccgcttctgctgtgcagtaacaagccacgctcagggcatgggcccaacttgagtttcttccatccacgggtccagactggaaaggaagcagcgatcttctcttcttttctcactgagtataaggcacccaattcatcttctggcagctgacctggaggacggagtggccctgattttccttttacaggtacaatcactgccaatactaaagcagtgcctgtccctacctgccagggcacccaggatccttgtctccagcagtaacttcatgaggtaggtggctctgggctgagacaggacttgcatattcctagatcccttgactgtgatgtcgaaggtcctctgcccccacccctccttctattccttgtaagcttcacttggcaattgtgtagtttatgtctggtacaggaatgaaggataaggtcaaatgaagctcaaagccaggagctagatagtcatgatatatcaaataaagttttggaacaagaacacaatgggattaatttgccaatcaaaacagcgcttggcaacttgactgtaagccaagatctctcatggcaagagcagctgaagggcctgtgattgtccagctcctggggagcctccctggcctaaccgtggtcagatgccagcatcacagcccccttagctgggtaaggattctcctagtgctacctctgggagagaaagaaaaaaatctagtctgagaatgacaccagcagacagcagctctgccaggtgtttgaagggtgaaggtcatgggactctgtttttactaccctggtcaccccaattgtttcggggtattttccatagacaagaggatgccccagtcagctgtcttccgtgattcaagacccagtctactgtcttctgtgattcaagacctgtttcctcttgtgccgatcagaggccttatttggaggcatcggcctttatgtggcatggaatgtaagccctctgagctttaacagagataggaagagtcctagaacatggcagggaagagggtcggaacctctgtcctccagcacagtagaaggatgctggcttgaatgtcaggagagcccagagtttctacctggatgcatggtttggggcatgtcaggtggcctttctgggtcccagtttcttcaactgtgacataaggaaggtagactagatcatcactaccaataaaaggtccctggtccttggggagcagtggttggagtgggagaagggcatcgcccagctattttccaacacatcgtaaaagatatcgcacaggacaactgaatgttgacttggtttgcttacctgtggaattctatccacttggtgtggtaaaacggattctcgccagagaactggaagtgtagatgggtggtgttacctatatccttgattgataagagaaggaaaatgaatttttcctcaataagtacaggttgtttgaaatgcaggctgggtgcagcgacgctgcatggtctccaggcgccttgtgtttctaaccctcttgctggacaacttggcctccacagggtagtccccagggaacccttggccatctccggcctgaaggaatcagggaagaccttccggacatgccaagtctccctgagaccctgctccatgagggctggctccctccccgacctggtcttttggttcaaagtcagtcctggagttatgtctgccaattgaccccaacctccagaaaactcagaaacagcctgtcctctcaggcctgcaaaccaggagcagccaggcccagccctgacttatgcaagtaactaccacagaaggcctgctgtgcagcctatgcctctcaacctggatcaagggcaatgtggagaaaccacattattgcttgactgtagtgcagtattccaacaatcattttaaatgtgcactcgtgtaaccatgatcaccatcaagatgtaggatatttccatctctctttagagattcccttttgccctttgctagttaatccccaccccattccctggacccaggaaatcactgatctgctctcaatcacaatagctttgcttttccagaacgtcctgtaaatggaatcacacagtttgtacccttttaaatctagcttctttcacttagctttatgcattttagatgtatccatgttctggcatgtgtcagcaattgttcctttttcctgctgagtagtattccattggatggatatgcgacaatttgtttatccatttaccagttgatagatatttgggttgtttcagatttggggttattatgaataaagctgccatgaacatttgaatatttatgtggacatatgtttccatttctcttgagtaaacgcttgaagtttactgggtcctatagtaagtgtacatttgcctttaaagaacttgtcaaacggttttccaaagaaagtattttttgttctcaccagcaatctatgaggagttctacccggttttgtcagtctttttaattttagccattctaaagggagagaagtgatattccgttgtgttttaaatttgcatttctcccacgactaatgatgttaagcacattttcttgtacacatgtgccctttgtgtatcttcttttaaggatatctgttcagttctctcaccctaccttgaacctacacagggtggaatgtgcctatgacctcggaaggactttagggaagcaagccccactttccccagagaggattccagtacaaacggaaagctcttctgaatggcatactctttcataaccagatttcttaaaagaaaaaaatcattctgattctagcctgaagtgcagtagaattcaagagaatttaagagaaaagtttagaaggaaaaaatttttggcaagaaaaaagactctacttacttttttccctgggatccacaaaagaagaagttgtggcctcaggctacagtagtatggagccaaaatggactcaaaaaaaaaaaaaaaaaaaaaaccccagaataaatcagacatgaaaataactttccttccatcccgtatctcattttcttatttgacaaaaaaatagtaaagagcaactacaacaacaaagaagaggtgaaacaagaatgcaaaaaatgatgggaagatggcaacctccaaaatgtaataaattaatttcagcagctttaaacctaaagctatttgtaaagaatagctagaaaagaaacccactcaagacaaacttaggaatttcttctgagttcaaaacaatatcttaatgacctgaaaaattaccacggctttacaaagcacctcattcactccttaggagtgaattataccttgggtaattgaggttcgacattatagtgaagtgatgctagggtgtcacaagaggtgaaggacaatacaaagtttagtaactattgtgcacattcagaaattgagacacagaattactttcaagaaaaaaggaaatgggagggtcaggtgtccaggtcagggcaaaattcaagatggtgggagtgggagaaacattcctcaccatggccttgggcagaatctgcttatctccagacaaagctcagcaacagctaggagctgaatctgtaaggtccagcagtgactaaattcccacacaaatgtttccatctttccatcgtgcaagaaattctgaagccaacattgcccagctacagatcattggcctgaccacagaagccagggacagagctgcggttacatttattacataggattgttccatcctgagcagagtacatggcctggagagttttcagggcaattatgaaatttcggtcttccagaggacccttgccaggtctaggaatattttcagcagtggatgtttacaaagcaaaagcccccccacacacacattagcaaattaaataatgcatgttgtatgaaaaaccttgtgaggggcatagcaatacccgaggcttctttcttatgcacttgtgtgcccagtaccagccaatacatggaaagggctcaacaaacactgaactgagcaacagcttctagcccaggcatcatgggcgggaggcagatcctgactccaatcaggcctcctatggtagaatccctggttctctcccatggaaggtgccccacctcaattgcctgcagtcacccatctgctgatgtccttacccaaaagaaaatgaaataatttcttcttgtatgaaatatcaggaaccctcaaacctaggagttaactaggaatagaaaaatcacttgctgtaagaaataatattagaaatgtaatggctggacccagcttctccttctaactaattttaaggattgttttgctgctctaggaacttactgtcatacagaggacaaccccaagcctccctagtccatcaaccccttttcctggatacaggggctgaatcccttgatggatttgatcacttacctcaatttaatattcctcctcctaaaaccacagtatcatccccagattcttatcactggtgtgactacctcttctgaagacatgagaaaagctccagtttcagaaggtatgcttggagaatgtgctgcttctagcttatccaatatggaaccaatttcttcactcatagctaaagcatatcctttcctcacagcttatcatagagtggccaggtttaaatgagtcaatacaaataagactgctggaaaagtgcctggcacagagaaagcattcaatatatatcagcttttaaaaatgctgaagatcaatttgaatatatatgtatatataaagagatataaataggatcacacgtaaggaactgattctacttttaggaaactacactaagaaaatactaatagattccgataaatatttatacataaagaacatcatcagagaattgtttgtaatagggcaaataaaaccttgaaacagcatacattttcaacaatagtggagtaagtaaataaattacggcactttttccaagtatgttttgaagaatttttgatgctatgagaaaatgataatgataagtgaagaaggatttaaaaccatttatgtaacatgatctcaattatacacactgtaaataagaatctatggaacaaatatctccataagaaaacattatgaagatatactccaaatgttatttgtgtttttttctaaataataatattctttattttttcagcacttttcaaattatactgaaatatattttcagcatacatacaatgagcatcccttaattctacaaaaagcaaaataaaatatgaaacagttaaaagtctattgcaacactataatttgaaggggaaaaaaaaggctaaggacctacagtaggccactgggcagacaaaggagatcattctgagcctgagtcctcagtatttggtgacccagtagagaggcaagagagggcataagctctaagctttccaccttgggcatagagatgaatgacggtgttatgaaccacaataggaaacgtaggaagaaaggaagaagaatgggttgggaggaaggaaaatacatttagtttggccttgctgagtctgtagtgcccaaagagtacccaggcaaagatgcccagtcgagagctggtgatgtgcaaagctaaaacttgtaggaagaaactgcagtaaaggtatgagggtgggcacagcagtgagtccttgaagccacgggcttcccttaggatgcccaagtgtcctaagtgttctaggaataagcgacagactctgatctcatggaggctcagacccctgggcttcagggctctattccttccacccctaaatgtgacctgaagtggcccctgcctccctcagtcctagaggctgctgctcaattacagtgaagaatctcttatagactcacggtgacttaaacgctatttggtgctgtggctgctatttcactgaagattacagggctctcagagttaaccacataaaacttgctgctatatatttgtaacctcctttttcaataacacatagggaaaccatcttgggtttcaggaccaaaaaagtgtgagtgcctggccaccaggaatgctataactgatcccgcttccctctttgatgtggccaaaaagaagctcagaaaaaaatctgtggcccatcttcagcagccttataagatcacatagtgtacatttttgggtgttaatattgacattcctatctttattgttttactgcccttattttctctttgtcccaagttcttcaactatgaatttttgccaactacttcaagttaaaaatgttcttccatgtcatgcccacccagtgattctgtttgtttctacctcttgaagttacacaaaataagtctagtctaccttctccacaacagcccttcaactctcatgtcatcctcccaatcttatttttataggcaccagagccccactttctttaacaattgctcgtggatatgagctcttaaagagtctttcctccatctagacttgactgatgctttatcttctctcgacctcttccctaaagcccctacgcagggcattcctccgctgcaacacagcaaccacttttaatagttgcttttcaagcttgcatcccccaccccaccatggggctggggactcctgaaaggagccacatgctgtctttgcctccaactagtacctagccagggggcctggggcataatacatgcttaataagtgtttgttgaggaagtgaataaatgaatgagcacatacctgtatacagtatacagcttcctcgctcatacacatgttaaagagagctaaagcctccgggaagggagaaaagagagggccctgttcagtccagttgtttgtggggctttccatctgacaactgttttccatggtctctcctgaacagcctcgaagcctcagccacctgggctggagcgtatctcacagctaaatccagagtaaatatacacaagacagaattggtcctatgaggacaactggggtgaatttccacagaaagaaaggatttcactgatcagaaatgtaagatgctagatgctccaattggtacttattctaacaacgctctcttctctaggttctaattacatgtcaggcattgttctgagctctttacaaatatcttatttaatcctcctaacaacctcataagataggcactatttttatccccattttattttcatatgaccctcttaacatttgaggcagctatcctaaaatgaagaaaggtgtagtgtttcagtctctgaataaaagaaaatgagctacattaggtccaatgtataaatggctgaagattgagtgccagcctttgatccaagatctggatctggcaggacacctcaccgctcactaacatttattgagcacccaccattgtgcccagggctaccctccatgagttcgctgacaggtggaggaagcacacacctggataaataaatcaccccgctgcagggcaagtgtattaggatcagggaggcagtacggtgctgagagcaagaaggagtaattatctctgactagatgagaaggcttcctggaggctgtgaagtctcagttccattttaatgaatggagcagcagagacagagcaggaggtgaggtgcaaaggtaccggcatccaaaagggcatttgggaactgttggtagcaggagaacgaaaagagaggaggaggtgggggatgagggatcatcactcaggtggtggccttggctgcaataccatgaagctgaaagtcactaacaggtattgtcatttctgttttagactctttgagcagctgtgtgcaggaggacagagagaccaagcagagagagaccagttaggaggctgctgtaataaaccaagcaagacacagtgtgcacgggaactaaggcacaggattctagggatatttaggaaacctgaagctttggactgatcgagaagctggcatagcagtgcaaggtgacaccccggcttctgacttagacaggagggcagccagtgaaatcagcaggctaggttggaagcaggcttccaggagtgagggcaagctgagactctctataagctcagaaaagccaaagagagcggcagaaattttcttcattatctcagaaaagttattcaaattcttgctcacacctccttttaataaaatatgatgcatttcattctgtcttcatagtgaaaaatcattgccctttgctgagaattaataaccttttgagttaataccctttgggtaggaaaattggtttcattaacacctccccttgcactttgtaggttcatcatctcttggtcctgctgtcccctgaaaccaaaagcccaagacatattatttgagaagcctgaatgattttattctcagaaagaatgatcagggtccttattaattgggctgaattgagttcactgaccaaaaaggtcagagcggccttgtgtctgctcctcagccgcaggggagcccaccttctaccagaaggaagggatgagagcttcctctcccagctcttggcctgatccctaatcttggcagaaaagatgcgcccatcttgacatgccacgccatggaaacgcgccaccttgccaggctctaccaggcctcttggcagaggtgtccgtctctggtgcagcaccacagacaggacagctgtcgggctgcctggcagagttggatggccactcacccacccctccaaagtggctcatggtcatagtgaggctcccccagaagagaggctggaaggcccttcggtcaaacaacagaaggtgatatgttaaaaacaatcttcctctccttttccacctcccacggccttggaaagcctccgaatggacattcctctactcttttctgttgcaaactctttagcagcagcctggcatctggagcatgaagcccagactcttcagcatcccagggccctccatgctctggcctgcctggccttgtctcctgcctctttatgtatgcaaggttgcatgcctgtgagcctcgactcatgttgctccctcagccacccctgacccccgcaacaaaacacacacacacactcaatcatcctgcaaggccagggtcaacatcacattccctgaaaagccctccctgaatgccacaccctccctcaagcggcatccactactccctctgtgattcccccaaccctgccccacactcacccctgtaccttgtccctgcaaggcttacctgatataatctgtctgcacgtgaggacaagttgagcctcaggagctaatacatagtgtcacccagctaagatgctctattcactgtctctctaggtagggatgtagggatgaaattggagacagcgacacctgggttcaaatcctgtctctatcagtttttggcagtgtgatttggggtgaggtgcttatccaccgagcctccaaaactgccttgcctatattccttatgacctagagggtgactctagtgcttgattggctggtcactgggataacaggctagaggatctggtgatctcaacctcctaggccaccctccatcacttggccattccactggaaacagtctttggggctccccacagttgtggctcattctgatctccagcatctcccagtaacctctttggcttgtgcttgtagaagcagcctttgagaagacggagggcttcagatgaagcagatgccaggctaagcaccgtccccaatcttatattgcagagccatttggaagaagagctcaagctgttgaaacaaacaaaacgctgcatgagatgaagaccagattcctgctctttggagaaaccaatcagggctgtcagattcgaatcaatcatccggacacgttacaggagtgcggcttcaactcctccctgcctctggtgatgataatccacgggtggtcggtaggaaatgctgacatgccgtttttctctccgatttcacattttctttttttctttctagcgtgttcatgttcataaaaagatagggagctggtgataacaactccatgcataatgtttatgaagcacgttctaattttccaagtgcttccccacgcattagctcattgattatctcgattccatgagtaagcagcgtgagaaaatataattatctccatgtttcagatagaatgtggctcaaagaggtcacacagcccattggggcccacaagggattgcagtccgtgcaggaagaagcctccttcctgaatctgcatgttacacacagggggacataggaagccagaagaatggactcccaatgaaatgttgtatcagcaaggtttaagttcagcagcaaataacagagactcaaattagcagtggttcaaagaaaacagaaatttgttttcatttcgcaaaatattccaaagatatatgtaacccaaaaaccggctagacagctttggtcagtgaagtcctccaggccccagctccttccagttcactgctctgccatcttggggtgtgaccctcatcctcatagtccaagatggcagctagaggactagccatcacatctttattccaggaagcacaatgtagtaaaagatgtacacaaaggagtcaaaagcaaggtttttacaagagctttattgagatataatttacaaagcgtacaacttatccatttcaagtttacacaattcaatggcttttggtataaaagagtgttttttaggtgtcccagagcctctgtgaaattctcccagttacatccattgaccatatctaagtggaaaggtggctgagaagtataggctgttaaagaaaatgtagccttttagtgatgctaaaaattctattactatggaagaaggagagaaaggatattattggcaatagatgaagtcaaaccatgtgagaacttgtctccaagaggaaatcctgcctccccagtgtctagcccacccatgatttcaagcatagttcacaatttgaaccctccagagattttggtgtctacttcatgacttagaaacctttccctgccatctagttgaaaagtactcttgaaacccccatctatcctatcctggagaggaaaatgaacccttccatcacctgcctcccctcacctctccctgcctcccacatgacgttccagcaacatctaactgcttgtattaatagcttcctccacaccccatgcacctgccttctctcttcttggtcttggcttagtctgtgccctctgcctagagtgttctttctcctcctcttttcctgattaactcccacttttcctgtaagacacagtcccaaacaggtcctcctgcaagccattgctgccttcatcccagcactcccacagggcattcagtgtcaccgggagttcccgtgtggccctgagcactctccaccactgctctgcagctcggctttctaattgtctgtgtttctctgctctgctaggccgtaagcttctccctgggaaggattctgtcctattctcatctaatagactactgtgggccactatccattatgtaatcagtgctccaaaatgtttgttaactgaattaaagatcaaatgaatgagtcttgtttataaatgcaacatgaggaccacaggagcctcttaccaggatgcttttaccaaaatgcactcttcattatcaaaattctgtccaacctagtatatgtctcctcctcctattactgctaatattaataacaacaacaactgcagtaacgaacatttgttgagtccttactatgttccagacactgctctaagcgctttagatctattaacgtatttctccttcataacaatcctggaaggagagcattattaaccccattttccaggtgagaaaactgaagcacagagaaaaataacttgcccaaggttactcagctagaaactaggagagcctagatttgaacccaagatgctccatgcacatagaaggcacttggtaaatatctagtaaaggaatgcatcttaccctggaatggcatgacaggccctcaggggagctctccagcttcacccgctattgtcaagccttcacctcctattgtctagccttcacctcaccaactttcctcctctcccctgacataccacactgccctttcatgattctgtgactctgcacgcactgttccttctgcctgggatgccctagacctcaccactaccacattcacctgcccacctgtattctttttgtttctttgttttgttttgttgcgatagggtctcactctatcgcccaggctggagggcagtgtgatctcagctcactgcagactcgacctcctaggctcaagccatcctcccacctcagactctggagtagctggggctagaggcatgcaccatcacacctggctaacttttgtattttttgtggagatggggtttcaccatgttccccaggctggtcttaaactcctaggctcaagcaatccccctgccttggcctcccaaagtgctaggagtacaagcatgagccaccgcgcccagcccccacccatattcgtcttactggactcctattgatcctttaaggcccagcacaagtgtctttgctctgtaaatccattaggagtgccctgcaaattggttctcaaacaaggcacacacacagaacaattctctgtaaacattttttacctcctactatgtcaggctcacagtgcccatcccgctaagtccagcataacgcagtctgcagggcagagccagtgctatgggtttaggggtgaggtggggcagctgcacgcagaaggaggcgtacaaatggccctaagggacaggtcagcttccaggacctgatttacacatatttctccactgttttaaggtttagaaagtccctaagaggaaaaacattaagataattgttctcgggagggggcgggggggaacgtttggaaaaatctggagacatttttggttttcaaaacctggggcagtgggtgggtgttgctggcatctagttggtgaaggccaggaatgctgctaaacatcgtacaatgcccaagacagcccccacaacaaggaattctctggcccaaaatgtcaactgtgcatggctgagaaacgtcatagcaagcccttcctccagcattatccaggagctggagaaggaagaagggtgagcggggagaaaggaaactagtgcgaccctccctctgtcccctcctcaggtggacggcgtgctagaaaactggatctggcagatggtggccgcgctgaagtctcagccggcccagccagtgaacgtggggctggtggactggatcaccctggcccacgaccactacaccatcgccgtccgcaacacccgccttgtgggcaaggaggtcgcggctcttctccggtggctggaggtaccgacctgccccatccttccttcacctcccttccctcctttcccttcctctgagagtgaatgaattaagctggtctccaacagcagcccaggcaggagaagcactaatgctcagctcacaggaatgagaaggcacaggactgacaccagaccccagggctctctcagacgcctcccttgaacccctgtttcacagaaccaccttctcccctctcctcatccactattcctcttatgctcacccccttagacatgctaagggatacaaacacaccctgtaagctatcaagcccccacacaaatgagtgggatcacttctgtagggcattagtgtccaggggaagacaggcaggcaggaggctgcagctaccaggcgaggtcacaggtacctgagtcccaggagagtcagccagttgagagattagtttcagtttggagtgtgaataaggcacctcatttctgagcaggcacgaagaacagggtgggcgccacaacacactggaccgcaaaaggctttcatccaggcagctcttctcctgcccccatcccgctgctgtcttccaggaatctgtgcaactctctcgaagccatgttcacctaattgggtacagcctgggtgcacacgtgtcaggatttgccggcagttccatcggtggaacgcacaagattgggagaatcacaggtaaccatgcctaataactcacacactgatctccactccataggggcatccaacaaggacctgcttttccaacaggctcatcattaaaacaccccaacacttattgtgagggatcagcgctcatgagaggacttgtgacattctttcaaacatgaccaatgtcatggattgctgttccagagaattcagagcaaattatagcctcaattcctattgcctgccctcaaacgaatacctcatgttggtgtgccaaatgggactaaaagatggacttttctagcaagaaagagtcttattttttaatctataatttacaaagtccaatttgggcgagttaaggagtgaagaatcacagccttaatttgctgtaattcatcagccacgttagtgcctccgtttccacatttgtgaaacgtgtatgttttagtctgggacccatttgggttgagggagggagctctgcatccaaaacttcaccccaaactccatacacactcagaaatggcccaagatatccaggaaggtctgcacatgtgcgaggaaggccttcctcccaggcttccgtgacaccaaccccacccttcacactgccaggcattggatccaaaaacacacagctggtgagattgttccccagtccaagtctgaggcccactgataccacaggtataaaacccgggaggcacaggcaaggcctttctcggtgtggaagccccagagtgccccagcctctcctcctgctgatcccttcccatagctctaggcttcaacgacacaaggtttttctctacttcacaaacacaccatggcctcttgtgcctctgggcctttgcatgcactgtttgctttgcccaccactcagccactcaaactcctcctcatccttcaagacccagcaggctcaaacaatatttcacaggccaaaacaaagagcattttacatgaataacaaagttgttgcgaatttatattttatcaagtgaggacatttttttttcttttgagacggagtttcgctcttgttgcccaggctggtgtgcaatggcatgatgttaactcaccgcaacctctgcctcccgggttcaagcgattctcctgccttagcctcccgagtagctaagccacacccagctaatttttttgtatttttagtagatacggggtttcaccatattggtcaggctggtctcgaactcccaacctcaggtgatccaccatctcggcctcccaaagtgctgggattacagacgtgagccaccacggccggccatgaggacatttttacaaacaactactatctgctattaccattcctttataaaagaatttcttttaacttgagaaagaatggggataatggcagacgtttcaacagaatacacttgtgattatgacagctcatttcctcatgcttttttgttcatcttgctggtcactggggaagcctggtcacagaccggcgtgtggcccccatggatttaacccacaatagcctggggatgagcagccctcccactgaagaagcagggccagaggtcagagtccacacccagcgaggcagcctcaggcccaaggcccagaaccctctccatccaactggtgctgtgggtcacattaggcgtatcagctgggcccacccacctcagagacagcaggaaagctcaacaccctcttgccgtcttgtcatcagcctgataaagaaaggaacagaaatcatatcaggacatttttctttttctctttctttttttttttttttttttgagacagagtctcattctgttgcccaggctacagggcagtggcatgatcttggctcactgcagcctccacctccctggttcaagtgattctcctgcctcagcttcccaagtagctgggactacaggtgtccaccaccacgcccggctaatttttgtatttttagtagaaacggggttttgtcatgttgcccaggttggtctcgaactcctgacctcaggtgatctgccagactcagcctcccaaagtgctgggattaccaggcgtgagccaccgcacccggccaaggacatttttcatttgtcactgtgggtagggctggagaacgggtgatctcacggctcactctcaattccttcgccccccaagtagggaaggaaaccagggctggggtgggacaccagagggtcctccagagaaggcagaggaagaaagacagggaaaaaaaacttggagcgcataaatactccccaaccacagtcagccaggaggtgccaccttacttcatgcacagacatctgtcacttgaggcccagagctttgagctcccctacttgcacacaacattttcacatacagtgaaatgtcccgcggctgttctggacgttctaatgaaatgacatcttaggagaaaaatcagcttgtttagggaaattattgacaacatacaggcaaataaatttcattctttgataggtaggttggaactacttataatgagcatattggctttttttgtatgcaaacagatggtcttgaaagtagcttgagaggtactcaaaactgatttgctcaagtaaatcaagcattccctcataaccttattcctttttttttttctttttgagacaggatctccctctgttgcctagactgggtcacagtggtgcagtcatgattcgctgctacctcaaactcctgggctcaagcaaccctcctgccacagcctcctgagtggctgaaactacaggcacaggccaccacatccacataatttttgtattcttttttattttagagatggggtttcactatgctgcccaggcctcctggcctcaggcatcataaccttgtgtctaccactggagagtttccgcaaacctctttccccgctagctaatgcccagcctgtgtgtcattgttagcaccatgaactactgtggttttactgagaaaaggttacggcgaggttttctagggaaggatcagccctacgtgtttcttcttcctgctagttcactgatgtataataatatccaaaagctaaaaagcacatctctcttcccctctccttgctcccgcgtaacccttacccctgctttcccattagggctggatgccgcgggacctttgtttgagggaagtgcccccagcaatcgtctttctccagatgatgccagttttgtggatgccattcatacctttacccgggagcacatgggcctgagcgtgggcatcaaacagcccataggacactatgacttctatcccaacgggggctccttccagcctggctgccacttcctagagctctacagacatattgcccagcacggcttcaatggtgagaatgaagtcatgggccgggagcaccggcctacatttcaatggggcctctggaattcagcggaatctaccaacatacgggactcagggaagagttcagcaaggataggggcccagggtgtatggtcaccaagcccacccagagagaaggaatgctggagtgggcaagggtgcctgtcccccagcaggccactcctggcaacaggccaacgccacgccctgaggatgaacagagggcaccaacaggaacctccacttctcactccagccccatgtgcccaggcaaaccctctcccggggtaccagctcttctgagagttgagtccggatgcctgtggttattcttccttctctggaagtttcctcgttccagggaccgcctctattctgaaccacataaggatccacttaataggttgtggcttctcgatgaaggtctcactcttcatcccaccccatcagtttaattgaggaaattactcagactctcccaatgggaaattcagcttcaaatatgtccttgttatgccctttacctcagggcagacacggaatgtgctgttatctgggttgtgatcccacttctctctcaagtcctaaaaccgaaatattaacatgcacattgataatatgcacaggattaaagaacaaaaatgtcagcagaagcagcacattccacgggcattccaaatttcttgctattataaaatatcaccctgattaagacatgccaatcactccaagccaagtagagccctccacccctacaagccacctcaccctgatcatccaacactcagctgagaacacactctcttgtgatgacaccatcctcgcctctccaatatcagagtgaccttcacactccgcatcatctcattttggctggactcccagccttccaccgcccaggcctgagagagccttctgggaacttgcccttatcattgcttacatccctcccacctcccccactccaacacctcccctccagccaccagcagttcccagctgaccatccagccctcatcccaaacttcaccccacccaacaaagctcagtacagaccatcaggatggtgtatgggctttattttcctggtaaacacatttctgaccaatcattaccatttgctcttttgtgctaaacttcaaagtgacggaaccaaatgtaggtattcagcttgcccaagcttgggctggtttttctcagtcgtcttcacccctgtgtttgaaagggttcctggggtagttctcccagccacagctgcacaggggctcactggataactgcagattcaccttcactacctcctgggtggatgagcttgggtgagttagtggatgtcttggaagctcagttttctcgtcgaaaacagcggcctcaaggagctgcagtgaagatgcaggcagtggaggagcggagggcacgcagcatacacagcctcctagtaggtgcccaaggaatgcagccgctagcgtccaaggactgcagtgactaatcttggcatttagcctccagacaactggggaaatagcttttggcaaagtcacctgtgctgtccctttacagcaagtgtttcacatatcttgtggtggttcctcaacatcccttgagaattatttaccacagattaggttaaaatttggagagttaaaaaaaaaaggtcaaatccttagtagatcaacctcataagcttgttttgggggtgaggcctgtccagatctggttactgggcaatgtccttccaaatccaattcttgtgctggtttcacaggcctgttacctaagggatgcaatggctgctttgggacacaaggtagacattgtcgagaggcctcagcgttctccagaccatcagagtgccacgggattgtctcgtgtatctagttatattaagagaagaggagtcccacgcaagcctgttccagaaaacccaccctccaggcatcagcacctgggcattttaaattatctcatttgagatagaaatatttctataataaattacactaacctgctctcttaatgaatttgatctttccttagtgacttgggtgcctattaaaatgcctactgtaacacgctgtcataaaggagtgctctcaggatcccggcagtgcccgggattttgcctgacactacatgactcagagggtctacttcccttagtttcagtcagttgtcacatcctgctcttgtcaaggggtctgccttgacaagcccacccttgcctgttctgtgtgctactgctaacctcctgtgggctgagaaccaaggtgatcctctgagttgaggctgctttgggttaaggggtgataacgtccttcttgccctgtgttccagccatcacccagaccataaaatgctcccacgagcgatcggtgcaccttttcatcgactccttgctgcacgccggcacgcagagcatggcctacccgtgtggtgacatgaacagcttcagccagggcctgtgcctgagctgcaagaagggccgctgcaacacgctgggctaccacgtccgccaggagccgcggagcaagagcaagaggctcttcctcgtaacgcgagcccagtcccccttcaaaggtgagtgtggagctggggagccttcagaagggcaggatgcagtcccctgtccaaagggctcagaagtccccttggcttctttcctggaggtgcttcagctctgctgttgccgtgtttctgaaactgtgcaggctccagacagcaacgttgtcacagcccttctcctgtcccaagagtgtggccaccttgccgccaagggctaggaggagaaacctcgaccatttctgaaacgatccttgggttggcctctctgtccattttcatgctcccctagaatgttagatctgcaaggccacacgcagtttacctgggccacccggatctcactgtacagggacgtcaggcatctccaaacacatcctagaacccagttctttcatctctgttcacggcccccatgaaaaaactggattctagactgcatttcatttcttctaagatttgaatcagctgatctgataggacatgatattcaccctgaggcactcccaagacaagattcagcttccagtgtttcccagccagatttttaaccacagggcagaaagtgggcccagcagctctctggattgaatggaagattgtagaaagggctgtgaccacgtcttaggctgaggccagcagagaaatactccactgaaacctaaatcctcctggagggaacaagccgacatctgttgccattaacatttctgcctaatccctaaaacagctcgggagtgctttagcatctcactgtttcatcgcacagcctctccagtgctgggagaagaaatctgatgtgctgtttgactattaccaggcagatatttgtatctggagaatgtaaacaggccgtcaccaccactttgcttttagggagcattttacacaaaacattcgatgcagccatcagctccttgtggttctcccaacagccaggcgaggatggcagggctggttattatcccattctaaagaggaggaaagcaaaactcgcgtggggtgcccacagctgtgcagctgtaaggagacctggaacagggccacctgactctcagtcgtgagttcaaactcccaggcagcttatttttgaggcacaggatttctctgtgtatcggaacttttgctctccagtcaggtttccctcccttgagtcaagcaggtctaggaatgacagaaatttcttgtgggtgcgcacggcatctgaagagtagttggtgtgagggcaggatctttcgggccaaagggtccctccactggctgtcccttagggctggaggagatggcagcacgcaggtgagggaatttggaagtcctcctgcttcggggagctcctccgctgcaggctgccaattaaagactcatttgggtgaaccagctcctcttttaaatggcaatgccgcctggagtgattaagcctcttagataatcacatttcactggatctattttaatcatggaatgttcgcatcatgaggagcagttcaaccctgccgtttttcagatggggaaaccaaggcctaggcagggaaaattatttgtccagagacaaaaagctcttggcagacctggcatttagacctggggcctccaaagagtgagcagagtgatttttaaaaactcctaaacctgccgctggtctgtttatggggataagaggggtatggaagagaagggtgggggaattgctttctccttgaaatcacctgggaagaaaagaggtcatttttcatcttccagggctaaactgggcacttcatctgatttggcccagccctaggacatctactggggacttggagattgggaagggaagcatcaagagaaggaagaaggggaaacaagagcagtaggcatgaaccaggctgagcttctcccatttgccaacggccccactgcccgaccaccatgcactgctgatgtgaactcacaaggatccctttgttattaaggaagaccaaagaattgcattagggcatcattatctcacccaccagctaccaaaaccaacgtactcatccatccgtatattcttcaaacacagtcctaccctcagggggctcggtggagactaacccacgatgagttccttggagaccacatttgtgtctctttattaccgactacttatcttgctcctgggacatctagtgaggaggaggttaagggcaggactgactgaaactggtcaggaaccgaaagccccaggctggagggaggttccagtgccgagctgtggcttgtaccacaccctctccttttctttcttactttttttttttttttttttttttttttttgagaccaagtctcactctgtcgcccaggctggagtgcagtggcgtgatcttggctcactgcaacctccacctgcagggttcaagtgattctcctgcctcagcctcctaagtagctgggattaccagcgtgcaccaccacgcccagctaatttttgtatttttagtagagacggggtttcgccatgttggccaggctggtctcgaactcctgacctcaagtgatccacccgcctctgcctcccaaagtgctggaattacaggtgtgagctactgtgcccagcccataccctctccttttctgctcccccacaaattctccccagttctcctgcagcccctccagtgagcaaagtcctcacccgctcaacccagtttcacttgctagtggaaagtaacgtctctgtggtcacatcaagccaccctgggcatggctggaaagtgcactcatgcgagactcgcctgtttgaagcagctgctcatgggatactgctatctatataatgttatgttatccaatgtggtagccacaaaccatatgtggctatttaaatccaaatctaagttactttaaattaaatggaaccaaaaattcagtttgtcagttacacaagccacctttcaagtgctcaaatacgtggctgctgcatcagagaacacagaaataaaacatttccatcgccgcggagagttctactggtgatgctgggatgaagattttaatctaggccaccacagctacaccactccctgcccatcacaaccgtgatcataactgacttgggcccccaaagcctattccaccagccacctccagcattttgatgaatacatattacactcttaaaagagcagacttgcccaaccccggcctacagagaaaccacaatccccatttttcaaaaacatctaattgtacaatgtattttagtgcagggtctggttgggcaagataaacatcgcctcctgattgtagtttcacaaaggatgactaacttggcctgaattcctctggctcccaagatatttcgacaaaaccatcaaaggatctattttctacaactgtacaccagaactcgggtaaacactgcgagagtacagcagtagcaagagagaattgggaaacagtcgccgagtgaaacgaggcaatttatcgcccactttcattctcactctctcacaaggaacctttaccagtttgggagcctgtttttaagggagggggagggaaacggatctgtacggagtaaatcctgtttcgccagtgcctcctctcatttcatcctcagagcagtcagatgaggtaaccgggtggagaggagggaaggggccctcggggggcactctgcccgggcactgggctggatgtgttgtacacgttagctcatttcccatttgatcctcacagcaacccccagacagggagagacacacgcacacacagagacacggtcagggcaaagtcacacaatttgtgagcaggaagcgtcgcattgaatcccagcctttgctccttttactgcacttggcctcggcgtaggaccaaggccctcgactgagtgcctctccctcctgcggcattccagctgcatgtcccgcctcctcctctctgccctccttccacactccctcttccatatctcctccactcttctcctgtcttccccgtgctgcccttccccctcccccgccccctcacccacggccctgcactccaggctccctgggtcgggggtgaggggcacttgcttctgctgctcgccgcagccatgagagcacccttccttgctggtcggcgagatgacgagccaagctgtgactcgggcagtcggtctgtttttggcttctctcagctacttctttggaaggtttccactgacttcagggagagttccagaagaagcagggggtgtcgtagacagcacaggcttggggttgggataaggagtgtcaagaatcttggccttgctgccaaccacttatgtgaccttgacctaatgacaaaacctatgtgggcaccaaggaagaggtgtgaatagacatggggatgaaccactagcacgggacctgcaggtgggtctcaaaacctgccccggtcagttcagtgtggaggaaggaagtagatgacacccgattaacaccttctggaaggcaggcattttttcatcgccatcttatcacatttttacagcgacactacaagaaagttcctaacctgcattcacagatgaggaaatcgagccccagaaaggctatgtggtctccagatcacaaggaagcaggcatcagagaggactcaaaccctgggctctgtctatccgttgagggcccttattccacccacagcacaaagagctggcaacaggacgccagtcagcacaacagtcctggccgcacacacacactcccccatctccaccgctcgcaggcagcaacagacccccacagaaggggcaggcattggccaggcacggtggctcacacctgaagtcccaacactctgggaggccaaggtgggaggatctcttgagcccaggcgttccaaaccagctcgggcaacaaagcaagacgccatctctacaaaagaattaaaaattagccaggtagagtggtgcatgtctgtagtcccagctacttgggagactgcaggagggttgcttgagcctagaaggtcaaggctgcagtgagacatgatggtgccactgcactctagcctgggtgacagagtgagaccctgtttcaaaaaaattcaatttaattttaaaaagaaaggggcaagcatccagtctcgtgacatcagggcatcacttaaatgggactgtactgttaaaccaaaatgtggccacgaaaataccgacacatacaggtgttacatacaaaggctaacaaaatcactttccctttttcttcttcactcgcgcctgctctgagttaattcactttcattcagccttgccggcactggctgccttctttgggcagcaacaccctggacaacaccatcctgggcccctcaatcctatgatcttcagcttccctctgagttagaggcatttcgggtctaggaacaagccctctgggcttggagaaaacacaagaggtctcattcctaccatctccatgagagaaatccatacacggagggggaaaaaaaaaaagccctctttgatgtttgcaaagagagtcataatatctcccagagccaacatctaatgattcagaatcattgtttctgggaggcaaaaaatagaaagaaatatattctcttttcataaattcaataacctgatcttgtgaaaagaaaatgtaagttttttcttttttaaatggcaccagcagggtccacacagggttacaatccaggatttttcctagtgaggagactctccggaggcctcagatttctgctgtaaatggagtttccctgatcacattcgaggtcaatggactatttcatgcctttcatctttaagacctgaaataatttctcctgccagaacttgggagtatgttgtactggtctctttgcagtcacaggattaaaagcgttttccccaaatcattttttaacgtccttattaaacatgtcataaggtaaagtgggcaaaatcactcacacttttttccttaatctttgtaatagcatcattgtgctgggggtggcagggtagaatgataggcaaattgtcttttcttttcttcctttttttttttttaaagaaaaacacttacaaaaatccaaataagagtaaataattaggactgggtgtggcggctcacacctgtaatcctaacactttgggaggccaatgcaggaggattgtgtgagcccaggattttgagaccagcctgagcaacatacagacctcatctctacaaaagaggaggaggaagaagaagaaggaggaggaggaggaactagttctcagcaggaaccagttctcagcctgaaagactcatttatatttaaagttaatttcatttaaagatttctccaaaaaagggcagtcatgcaagattctccgtgcagacatggagtttctcaggagtgctcctgcaaactcaagggtgcctcagccatcagcgcaggttccgtccccagcccgttccctggtgagcctcagaaagcatgctggcttggctcttcacagcccacacaccttggcacgttccatcctcctgcagagatgctactctagggacacatgttgtagaaataggcaattctcattcataggatgtgcaagctaaaggggcctttgcatcctctaaagctgactcctgggttttacacaagcactttctcctaaaatcgtggaaccatagcatctcaaatgcagaaatcaatctcctcctactcacaatttaagaaaaagggaagaaaaagtgtatcgccaagacaagggcatgaaacattttccccggctcaggggccagacgtttaggggacaggagagcgtcctttgtggcagcgatagcccaggatggatgtcaaggggtcagagctggcaggcagtttgtcttggtggcttcattagaagcaggtgttgaaccacagcttttcttcaggggctgttggccatttgctttcaagggacagactcagcttgcagaacgaaaacagcaggcgatatagaaagagtcttttggaattagacacacctggctttgaatcctgctccactgaactatctggataactataggtctccaaacctccacttccttatttatattcaccaggataattaacactgtgtcggtctaggtctcagcagaaaacaggactccactggcctggatcagctgaagaaagcaagtgggactccttacaacagggtgggcagtgttaaggaaaccaacaaggactgaggcgactccctgcctctaacagcaggacagatggagccagggaagggactagctgtgggaaaaccagagccatggaggaggggctgctgataatcgtgggagggcagtggctgcacagtcaggctccagagcacgggggagcagagggaaaatgcccctgcctctctcttctccgccctgatctcctgctagtgcctctccctccagtggtcacacccaaccagaaaccaatcgacaagggagcccggcagatgcagcctaagggatcccatcctggggctcagagctgagcagtggagggcagagtggatgaggacagcaggggtagagggagcagatgggcactacccagcagggcatcattatttagcctgttatgaggagaaagatgatgtatgtaaaacacttagtatgtagcttaacacatagtaggatctcaacaaatgggagctattttatcatccttggtgtctttaatgcagttatatatgcatgttgttcttcactcagagagcctgtgaagtactccttggaggcctagtgtgtgctgtgcccttgtggagatacaagcagtagtgtggttccgagatggcctttggggagataagacatggacacagatgcccgtgagacaaggcagaggccacaaaggaccacaacttctagttctcttttttttccttttcaatacttgtaaaagctctttctttttccaataggattccaattagaatacacgtttactgcagaaaatgtgaaacttgcagaagaacataaagaagagaataaaaatgaccactctgccctctccagagataagcactgttaatatttttgtgaattcccctacttctatgcattctgttttgcagagttggtctcatactagacagtttcgtagcctgtgtttttttgtttttgttttctttttcacttctttcataagcattgaaatcattccaaaaatagcttttaatggcttcataagagtaaatcacatgtttgggacaatgaactgagaatcagcagactaacttctaattgcagcttcatcagttattagccacgtgacaacgacaagttacttaactttttctgagcctcagcttcttcctttgcaaaatgatgtgggagggaagataaagtaggcatcttataaagttgttgtaaagagaaatgagataattatatgaaactattagctcaatgtctgggacatagtgaagcgctaaatagtagttatcataattgctgttattagttcatagccatccctctattactgaatatttcaggtgttttcagtgtatttttacacaaatgttaggacattttttaactgaaatctctttccacaattcaactttttccttagaatatataaagctagtggtcctgggtataaacatgtaaaagttcaagttctggagtcaggttgtgtgagccgacgccccagccatatacgacttactagctgtgtgatccgagaaaagtcacttaacttctctgtccttcagtttcctcttctctaaaatgagataataatcgtatcatttgtttgagggtcaagtgagatgacagaagcaaagcacttggcaaaaaccaaaatagatattagccaatgttattatcatgcatactgccattatatgctcttttttttttttttttttttttttgagacgtagtcttgctctgtcacccaggctggagcgcagtggcgcgatctcagctcactgtaagctccacctcctgggttcacaccattctcctgcctcagcctccccagcagctgagactacaggcacccaccaccacgccccgctaattttttgtatttttagtagagaacggggtttcaccgtgttagccaggatggtctcgatctgttgacctcgtgatccgcccccctcagcctcccaaagtgctgggattacaggcgtgagccaccgcgcccggcctcattatatgcttttaattgcatttagcactgggctaaacacacagtagacttccaattaatacatatcatattaaactgaattgaagatcggttactatgagtgttccttgagaactctggaaggtaccctgactattcataaggaggttaacccaaggccagtcctcccacatcttaccccctcccccactttggaaagaactttctttttgtctcagtttgacttacaagactgttcatttgttacagagtttccttgacaaacccccaaatagtgtaagacctctccagaggcttctgggatgacaggctaagtccctctctccagtggtgccacccaagagtttagggacccttcccaggacttgcgcctatagctcttttctttttttttttttcttttttgagacagactcttgccctgtcaccaggctggagtgcagtggtgcaatctcagctcactgcaacctctgcctcctgggttcaagcaattctcctacctcagcctcccgagtagctgggactacaggcgcccaccaccacacccagctaatttttgtatttttagtagagacggggtttcaccatgttggccaggatggtctcaatctcttgaccttgtgatccacctgcctcggctcccaaagtgctgggattacaggtgcaagccaccgtgcccagccagctgttttcttacttctcacccacagcctcttttgctgtcttgagggcatcacattgctttattccaggcttgggatttgagcatctattgtattacagcaggggtccccaacccccgagctacagacagtgggcaattaggatccgggcctcacagccagaggcgagcagtgggcgagcaagcataaccgcctgagctccgcctgtcagagcagtggcaacataagatcctcatagcagcgcaaaccctattgtgaactgcacatgctagagatctaggttgcatgctccttatgagaatctaatgcctgatgatctgaggtggaacagtttcatcctgaagctatgccccctgcccccacactggtccatggaaaaactgtcttccatgaaacccatccctgatgcccaaaatgttggggactgctggtgtatagggtactgtagtaggcaccagatactacctgagctagctcttatctaaagcagaaaactcttggccaataaatcaactcttagtatttggctcttgttgtgaacataaataaacatttggtgcttcagagataacccctttagtaaacccaagagatatccccactcacatgagcaaattatatacaaaatcccaatgggaagattagtttatgccaaggataggattgtgtaatctagaaacttggcaatacaggcataccaggacactggagctggcagtaccctctgctgggcttgctgtatagctaccaacctccggtagaaatagtaccatttaggagttagtagattgattgatgaagagatgaatttccacatgctgggtacaagggatggatagtcaagtggctagttaccgtgatctaattttttgaaattctcctatgacaaagcttgaaactcaggtcttgaatcctcagaggtgatttccatgttgttagatgttaatgtgcattgtgatacgtcacccccaagcaaaccatcagttcattcatcccacaaaagtttattaagcacctactgtgtgcaaggcactgttaggattcgtggattaaccattgtctaaacaggaaaggcaaatacgcagcaagtattccataaatcccttatccttttcccaaaccagacactcatcttgccacaagcctggacatggcctcagaatccatctcaacagagggatccaggcagttcttatcaatcaaatggaattaacatgccgtattaaacctgtttgcaatcttggagctagaacactgtagatgcttagagaatatggagacaagagagctcaggaggtcaaggctgcagtaagccaaggtggcactgcacccaagcctcagtgacagagagagaccctgtctcaaaaaaaaaaaaaaaaaaaaaaacccaaaacaaaaacaaaagccaatcctggtctggaagctggaccctgcatccaaccctggggaatccactggggagaatatggagacaagagaaagaagtccaagcagtaatcagccattttggaatgaggtaggataattttcaaaacagctccatagctgtgccaccatgcaagctaagcaaacaccatctagggtgagggaagctaagagcacagatgctgctatttgaccttaagcaagtcactttcatctatctgagctccagttttcttatttataaaatgggggtgatactaacaatgcctacatcatagcgttgtgatgagtaaatgagatgatgcaatgcattcaacaatgcaaaaatgtattatcatttaacgatgccatgtatttaacaacgcctgtctaatagtaagccatttgctttcagtaactaaatgtagactgtattaggtaaagaagaataaaataaattatcctcttccaaccaacccatcagtaggaggacattccagacatgtgataaaacagaaagattttaggcccaagttctagaactacagttatcttatttccattaggaaatacacttattgaaactcacagagcttgtttccaggaactgccccggaatataaacgcttggtcactagggcatatatttcttggctggagctctgccccaccctgaaacacaccccatcagagagcagcaataatgtaaaatggcaatgtgttctctcttgccttgtcaaatgcctaaaaggcatatattctttgatttacgaaaggagaccctcaccaaacacatgaaatattacagcagaacttgcatctagaactcagtgagaatgccagatgtcctatactcctattctgccatcttttgttggtgaatatttatcattattacattacaaacacaatataagtcctgaatagacatttaggaaatacagagaaggaaaaacaagaagataaaccaccatttaggagcaaaaaaatgttgttaacatattaatatctatccaaactcttccctctgcatgtttaaattttaagaaataagagatttttaaatttaaaatcactgcttaaattatctctctctttctctctctgtctctctctctagtttatcattaccagttcaagatccagttcatcaaccaaactgagacaccaatacaaacaacttttaccatgtcactactcggaacaaaagagaaaatgcagaaaattcccatcactctgtgagtaggaggtgtagccccctagggtgatgacacacttatttttcttgcagaacataaatggactctgtaattttcaagagtcaggccagctacaactactttattccagacgcaaaccaaaaactatctgagacacatgtcaatcaatttagtttattttgccaaggttaaagacattatcgtgacacagcctcaggaggtcctggtgacctgtatccaaggtggtcaggctacagcttggctttatacattataggaagatataagacatcaatcagtacttgtaagatgtacactggtttggtccagaaaggcaggagaactcaaagtggtttggggttggaggtgcaggggagcttccaagtcatgggtgcattcaaagattttctgattggcattggttgaatgagtttatctaaagatctagaatcaatagaagggagtgtctggattaagataaggggttgtggagaccaaggttcttattatgcagaagaagcctccaggtagcaggcttcagagacaattgattgtaaatgttacttatcagacttaaaaaggtgccagacttagttcattctctcccagatcagtgaaaagacctggatagggaagggaattctctacagaatgtagattttcccaccacaagacagctgttcagggccctttcaaaatatgtcaaagaaatatattttagggtaaaatagtttaatttctttcagggcctgctgtctgtcatgtgatgctatactagagtcaggctggaatttggtgtcttattgctacaaaaagtctgcttcatcagtcttaaaatctgggttttaatgttaatgctggtcagttgtgcctgaattccaaagggaggagagtataaagaggcgtgtcccacctccccttcccaccatggcttgaactttggaatgcccttggctgagaggaggggtccattcagatggttggagggcttagaattttatttttagtttacatgggcttgagcatttaagcaccaatcacatacagggcactgtggtaggcgccagatactacctgagctagctcttacctacagcagaaaactcttggtccacaagacaactcttagtgtttggttctttttgtgaacataaataaatatttggtgcttcagaaacaacccctttagtaaacacagcccatcccacatggccatcctggtcagacaggacatccacccaagcccgaaccctcaggtccctcctcagcctctccagttcccaccaactgctcaatgttatgcactgtgggctgagcagacagggaagccagagatggccccaccacggcctgcagtgcagaggcaggtggtgaggggcggagcaggtgttcccaagaggtcccaagagcctttccagtgagttcgtaacccagaaattcaagtggtatcttttgacttggcacagatttccaatttcaatcagcctgctctgccagcctccccatctgtccttcaccctgttacccacctgctcactctgaggctccccagcctctctggcctctcaaccctcagcatggactctccctggaaagtgacactagcccctcacccactccagagatgatcctgagcttcccgaaaattgcccccagctttggatctctgatcatcacactgattcagtcattcagcaagcatttgttgatgctctgtccaacacctacctaaggatacagaggaccctagcctctggatgctcacaacctggcagggcggggggattcctaaacaattcttcacagcatactcgggaagagctatgccaagccacacaagggacccccccccaaccccaccatccatctgcctcgccctaaatccactgctgcctctgcactgccaaaaatctctcccaggggatggttctcaatagtggaaagggcatctcgctgctctgtcaacgttgggatattttagtgtcttggagattagtgagtaaagctgatcatgatacctcagagtctgcatttaaatcttgctctaaatcggtgcatcctttttatgtgtagtttttctattactgttatgcctcactgttttaacagaggtttctatttatatggggggaggagcattacttgggagagagtgcatgctgcaggcatactatgttaaacctacagagagctgaactgtccagacgccgttgccaaagccccactgtctccacagcggcttcttcctagaagctaagctagagaaagttaactagatttgttatagtgggacttctcggagcctttttgatgtgttagccagaaaatagtatagttttcgcaattttattatctggaaatcccttttttatcctggcacacctactgctaactctatcaatagtctgttgaacactagtttgggaaatgcagcaaaaatcccaagtcattcagggaaacacaacacatcctgaatgtgtgtgaccgtcactttgctgttacgactaaactgattgtgtctgattttctttgtgtattcaaggggcaaaggaattgctagtaataaaacgtattcctttcttatcacgctggatgtggatatcggcgagctgatcatgatcaagttcaagtgggaaaacagtgcagtgtgggccaatgtctgggacacggtccagaccatcatcccatggagcacagggccgcgccactcaggcctcgttctgaagacgatcagagtcaaagcaggagaaacccagcaaaggtgactgctgattcaatctcctattaacgtccattaagcacccacttgtgccaggcagtctcacaatttaatactcacattcatcatgtgaggtgagtattattaggccctagtgatggagtacagaagctcagaaaggtgaagtgactatcccaactttacatagccacaggtgccaggacaaggattcacacccaggtctttgaatacacaccagggtctccccactgcccgtggctaacgctgcctgcctctggagcctgaggaccaccacactaaccccaggcttctcaagcttcagtgcaggtgaatcaccaggtgatgtcagtgctgccagtccaaggtgctgtggtagatgcaacatcttttttttattgtttgcccaaagtaaatcttttaacagatcacaatatcaaaaatctcaatgtatctctctctctctctctctctctctctgtggtcgtatctttcaaatgtcagttgccaaagaatcactgggaagccaaacacatttgcagaattcctggacctacccgcagattcatggtgggcttgggaaggggtccaggatgcctgttgttgaataagagccctaagaaactccaatgtagaacaatgggtcacccataagaaatgctgctgtgtttgatttaacatctcccgtggccccaaagtctccagggatacgaaggagctggggtggggagcaaagaaaaggaaggacagagctgggcgtggtggctcacacctgtaatcccagcactttgggaggcctttggcgggcggatcacctgaggtcaggagttcaagaccagcctggccgacatggtgaaatcccgtctctacaaaaatacaaaaattagctgggcgtggtggcgcacactggtagtcccagctactcggggggctgaggcagaagaatcagttgaacccaggaggtggaggttgcagttagccaagatcgcggcattgcactccagcctggatgacagagagagagactccgtctcaaaaaataataataataatagaaaagaaaaggaaggatgctccagcgctcctgaagtcctcccagcagaagaaagggctgcccagcacaccctgccatagcaaccgtgcttttcggtcatccgtggttctccacggcagaattccaggcatccccgggccctctcctctctcttcccttctctattcaggaaacggtctctcctctcccaccttcacttgtcgcgaaggccatgtttctctttggcttgtcctcagagaggtggaaaacagcaggtttctaacctctgaactaccctcttccctcaccccctgggtttcactgccaggtgccggcctgtggcagatgtatgcccctgagtccctttatacaaccgcactctgagattttatctccctgggatgcaaaatcctggcaattactgagagcatactctgccgtctgccaacagatctcccaacaggatcaatctgggaagattaaactgctcgctcctcttctgcactgagctcttctcacatgactctttggcccattggagcagcgctgcttctgagctctgaccctgcccagatgctcttagctggagagtaattcctcagtttaggtggctgctcaccctgacaatcccatgtggcttgacctgaaagggtggctaaagcacaacactaccttctccactggggcacacccatgtggtacggaagaagaaatgaggagagggaggggcctggcccttccagggctcccacacggggtgagcattgaagcaggtgctccatggcattggtctcacgtgatctttgctgtgatcctgaaatgggtagtattggctgtgcagattaggaacctgaggctcacagaagttacacagcttgaggacattgctcaaaattgtcccagtccagatttgactgggatttgtctgatttattacccatttgttgggggtgtgctgtttccaacagttccttcttccattagttttggttccattaatctgaattttctcagtctaatctagcagagttgcagtgctggacattaacatatgtatgcatcaaacccatccttagggctgtaggaggtactgcatgcaggttatgggagctataattttttttaggttgtaaataccgagtgcctcctctgtgtctacacagtgccaggtactatcggagaatacaaaaaaaaaaaaaaaaatctgagttgtggctcttggtagaaataaactccaggacctaaccaggaaaataagatgaattaattttactaacggtgtggtccatcccagggcttctcaaactttcacgagcatacaaagcatctgggaatcatgttaaaatgcaggttctgctttagtgagtctggggtgagcctgatgttctgcatttctaacaagcgaccaggcaatgctgttgctgcaggtcaacagaccacactttgaatagtgagagtccagcattacacaacccgggaagtgtaagaagaaagttcagacccgtacacttggggctgtgctgcaacatgctttgaggaggccaagaggtgttcccagggagacaggcagccggcaaagcaatatggctggcaggatcggatggactccagtgtcagccagtcctaaactcacattttaacttcactgctcacaatctgtgtagcctcaaacaataacttcactcttcaagactcagttgtttagtgataaacgagaatcataatatacatttcatgagactaataacaactactaattttttagtgccttttgcagaccaaaatcccagaatcgggatgggaacattaaactctacactcgtaatatcgctgctaagtgcaagtgggaaaagaagtaggttaagtaacttgctctgtgcctccatggaagaaattcagtggaaggtggttttcttcccccaaaggcacaaaatcagggatgagtagggttgtggagatggtgaagagaaagagaagaaattattggccctacagcaagaccaagtataataactggctaaacctaatgagaagacattcaatttccacagtactcatataaatgcaaaataaaatcaaagaaattatcactggttactcattagtttggcaggaattcaaaaacggacaacacccagagttagtaaagatgtggagaaacgggcattctcatacactattagtgagagtgtaaattacaggcattttgtaggggaatttcattcaacaactaacgtttagtgagtacctaccttatgccagacaatgttgtggacaccagatgtataatagtgaacagacaggctgggctaaaatacaaaaaaattagccgggcgtggtggcgcatgcctataatcccagctactcgggaggctgaggcaaaggaatcgcttgaacccaggaggcagaggttgcggtgagctgagatcacaccactgcactccagcctggcgacagagcgagactccgtctcaaaaaaaataaaaaatatatatatatatatgtatatatgtgtgtgtgtgtatatatatatgtatatgtgtgtgtgtgtgtgtatatatatatacatatatatatacatatatatgtatatgtgtatatatatatatatgtatatgtatatatatatatgtatatgtatatatatatatagtgaacagacagagtccttggtctcatgaagtttacattatcacatgtttaaatatgcatactactttgagccagaattttatttctaggtgtcttatcatctttctggagtatctgtgcacataatcaaaatatgcacaaaggctatatatgaatacatatgtacagaatgtttgttgcagtactattaaataaatactatacataataagtaaatagtaaactcttgagaaaatcttaatgtctaacagtaggaaaatgcattgtggttcatccttaaaatggaatgtcatgaagcaggtgaaaaatagtgaaatagacttctacctactgatatgagcaagtctctgagtaccattttctggtaacaggaaaaattgcaggaaaacatacacaacatgatgccactcaatatatgtaaatgcataggaacaagtctggaaatgcataaaccaaatcataaatgtagagaggggagtgatgttagtgaaggccgatggtgaagaggttctttattatttggcttcatttattcctttaccatttgaattttcaagaatgcattcacaaattactcatagcatttttaaattttaaaagtccagtttagtgaagacttgaccttagacgcaattcaaagaaaaaagaagtaataaactagaatttttctacagatatatctatagatatatatttaacagatgcaattggaaataataacacaaaatggtatctcgggccaagccaacagccaaagcagtctagttgttgtttccaaaacacatagtggtgtcctctttagtggacaatgtcagctccaatatgaggaaggggcagggcttacagggctgagccaggcagaaaccgatgacactggcctcatgccaaggacctttaagaacagcatttacaaactggagcttgtccaaggagggaaggctgaggaggtaagcttgccttaggaggaagggttgaggaactagaaatgtttgccctgaagtcaaggcaaatgtggtcaaggaaacaatagtcaccctcaaatcttcgatgagctgtcataggggagaacaaaggagggctgccccaggactttccttcttacagaactgaaatcaccccagtgaagaactccaggaagtcttacactgatggctttcactgacttgggttttgtttttctctgaagttacaaaaatatttgcgaacataagaatctaacttaaaaaaagacatcacatgccttacacaaattgagtgaaatttgataaagaatgaaacacttcaataagctccacctaaaacttaatgctgtgtttgcttcctgttttctattcagaatgacattttgttcagaaaacacagatgacctactacttcgcccaacccaggaaaaaatcttcgtgaaatgtgaaataaagtctaaaacatcaaagcgaaagatcagatgagatttaatgaagacccagtgtaaagaataaatgaatcttactccttatctggaatggctgccttatttagaagccaaaattacataaagaatctcacacaaagcttaaataaagtttagatttaaggggggtatgtttcactctcataaactgagcttttaaaaacgatatgatataactattttccagtatcagtacaaccaaaaatgtcccaattttatctctggttaaatgttaatatatgcaaataagtacaaatgcaagagccattttagatctgttgttctaatttacaatgtcttttataattaagtttcccacatgtccttgctagtttattatgacccatttttgaaccatgctagaaagatacttttttattaggtaactagtgcttcaataaagcaagattctaattaatcaccactagttgtgtataccaaatacacatcctttaagacaatacagttcttaaaagaagaaaaattataattattctaatatttatacaaatcatataacgatttcacagaaccaaacacttacaagtagaattctactaaaactacttgtgataacagtgaaagctagacacgtggtcattttaataatggaattacaaattaaataaacataattattatatcttactaatgcttgcaacaaaagctaattttaaaaacttggaatgtctcaaagcatttgctatggactgaatgtttgagtcaccccaaaattcatatgctgaaatctaatccccaatgtgatggtgtttggaggtggggcctttgggaggtgatcaggtcatgagggtggagccctcataagtgggattagtgcccttataggggataaaggatcagaactctctgccatgtgcggatatgagaaggcaactatatgcaaaccaggaagttgaccctcacctggaagtagactaccagatctgctggcacctttatcttggacttctcagcttccagaactgtgagaaataaatgtttcttgtttaagccatccagactatggtaatttgctatagaagcctgaactaactgagagagttagatgtcaaatttcaaactgtccaataagtgaaataataatgttttgaccagcaaattccatcacaaagcacatggtgacaatggacgctaaatatggtaatcagttagatatgtgttttacataattcagagaggaggaacatgttatgcacattaaacaagctaacctaacttgcacttaggctcagctatatacagaccataattcatattctcttcaccaaagcggggtaaactggggctcatgaaaacaaaaatcctggaaagatgtctgcctctgactaatcaatttaaaattatcttgcatgattcacttttatttccctttgaaagacctagaaatctaaaacttatggggtggtgggataggaagaacagctggtcaatgtttccaaatgaagcattctgtcctgaatgctaatcttacctgcaaaagtatttgaccctacttttagggaatgtgtgtgagtgtgtgtctaaaattgatagataataaaatgaacatttcccattatgtctaaaatactaaggtttacaataaaatgtttgcattggattgccaggttttatcattaatgatccagaaggaatttagaatatcacttttgaaaaacaacagggaaacactctttgctgtatatgcaacagagtccatgcatatgtattccaggagacatgtatgtgagccttgaaatcatcgcagccagaaacagcccaaatgtctgccagtacgatgcagaaatgaactgggttatagtcttgctaatggactgtcgtacaaccgtaagaaagataagccaaagctacacacacaaaagaacagagctggggccagcgtgaggcagcgagacatctagggagcaacatttaaggaagcactcatgcatttttcgtttgcacaaagacacaaaaaaaggtatagtatgatacaaacaatggataaacacctgtaatcccagcactttgggaggctgaggcaggctgatcaattgaggtcaggagttcgagaccagcctggccaacatggtgaaacccg

SEQ ID NO: 16296 - DNA, 49301 bp, Human
  misc_feature (1)...(49301): n = A,T,C or G
ctgcgagggtccactgagggtgagtgcccgggctccttcattctccaggctcctctcagaacacagcaagggtggctgactccttcgaacgtccattaagcacaatgcaacggggcgaggcagtagggggtttgctgagcccggttccgcggcggtgggaagttattcaccggcgtctccgaggacggcccaggcctggagaatggctggggccgcgggctggggtaggggttaccgtgagagtcaagggcaaggtggcccagcccgggctgggaggcgcgggctgggcgcagccgagcatttcctccgggaggcccagacagcgggcgggtggggcgcggtgggcggggtcctcgcagctggtggcgtttgaagcccccccgaccgcggtgggagaggggcagcctagaagagttggcagcgggcctgcggcgggatggggaggaaggggccccgcgttccctcagcagcggcgccggccgccctggcacgtagttcgcttctggaggcacaggccgcggtgggcgcgccacccgggctgccaggctcaccgccagccgaggccagtcctgctcgggctgacccgagctgaagggcagcgcggccgcaccccggaccccaggaacgagcccgagtctgtccctcccgcgggagctgccccgcccggactcccggagctctgcaaggcaggggcgtggggagggcgagcggcctgaggctctaggcgcggccacccggcaagccggcggcggagggcgcggcgcgagtgcgttccgcccctaggcagccccgcgcccggccgggcagacacgcctccccgccggcgcccatcgcgggaggaacaaatggcgccctccagaaaccgctcccctccatgccgggggccaaggctgtcaccacataaaagctccggcagagaagtgctcgctgtgtccccgccgcggggggtacaagcagccgctccgcgccgcgactacccggcccgccgcccccggacgtcatgcgtcagcgcgccccgctccagtttccgcccctcctcccaccggcccaggggacacgcccactggcgcgcgcagggcccgggaccgggcacgcccctctaacggctcggattggcctggccgtgcactcacggaccaatggcgtctgtcccggccctcggtcacgcccccttgcccaggcgcgggcacgcgaccgctccgttccgccggtgcgcgctctggggtccccgccccctccgcgcgcgcagctccccgcagccgccgccgcctgtaacctgcgccgccaggatgtggctgggggctgacgtcgggtccagatgtggccccggccccgcccacccccggggccgggccgcccacacggagccgcggcgcgcacggcagctgtcccgcctgccacaatgcgcggcgaagctgcggccgcgacttggcgaggtggtccctaacgctgccgctcggcatccttagaaccggccgcccctgacgccgcgcggggaccccagtcgcccgcgcgccccatgcgctcactcttcggtgcccggccgggccggcgcctcgcagacgcggagccgcgcgggtgacggcacaggcggctgcgcgcccagcccagcccagcccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcccagcccagcccgaggagagggcgcgccgcgcccccgccccccgcccgctctcccgaggccgtgggtgcggatgcgcggctgacgactcgcagcaagagcaccgccgccggccccagcccgcagcatggcagccgccgcctatgtggaccacttcgccgccgagtgcctcgtgtccatgtcgagccgcgcggtcgtgcacgggccgcgggaggggccggagtcccggcccgagggcgcggccgtggccgccacccccacgctgccccgcgtcgaggagcgccgcgacggtaaggacagcgcctcgctcttcgtggtggcgcggatcctagcggacctcaaccagcaagcgccggcgcccgccccggcggagcgcagggagggcgccgcggcccggaaggcgaggaccccctgccgcctgccgccgcccgcccccgagcccacctcccccggcgccgaaggcgcggcggccgcgccccccagcccggcgtggagcgagccggagcccgaggcggggctggagcccgagcgggagccggggcccgcggggagcggcgagcccggcctcagacaaagggtccggcggggccgaagtcgcgccgacctcgagtccccgcagaggaagcacaagtgccactacgcgggctgcgagaaagtttacgggaaatcttcgcacctcaaggcgcacctgagaactcacacaggtcagtggggcggcgcgggcgcccggatcgcgcggacggggtcggcgcgagctgcccgaccacgcccccggagtccccgatggggcgcgaggtgggggccgggcgggccggaacgcccggggcctcgccccttcccctgccgctccgacccgcggctggccccgcgcgtcgcgcgaggcgggtcttggctctcggagccggcgcccgccaggcgaccgcgcccccgccgggcacgccccctccccgggcgcgctcgggtggggccgcgggggcggatatagtcatctgggctgggggcggggacccctcccggccgggaggcggcgcgggcaggtgcgggcggcctgggtgtggaccgcaggcggcactcgtgacggtggggcgcccggagcgggggcaggggacgctctccggggtccctcctcgtttcctcccccgctgcccgggcgcgcgctcaggaggggaggggccggccccggcgcgcggcgggcgaagttcacgcagggacaaggtttccttcgccactcggcacattcttcgctctcttcttcctgtaatttttccagcgctctaaggtttaatttgtcgtaaccaaagtcagcggcggcgcttggcgatgcggggggcggtcccgggtcccgctccccgcctgcggctctttgtgggagcccccgcccatccggcccggcgggggcgcgcccggccctaggctcctcggcctcgaggctctctccggaaaggaatgccctggccgctgcccatcctccgtgctgccctctcgcctgcccacctctcacctgccctgggccggtgcggggcgggcggcacctgcaccagggcgggcgctgagcctccagcctggggatcaccgcccgcccccgccagcccagcggcaacagttcccacgcgcggcccgatactttgtagttgattcatctgtggcggttccctcccccctttttgtttcgtttttaacataaagatgaaaatattttaatggacggcaatccttccccattttggtgtaaagaattgtatgcttcctctgagctcacgtgagttcttctgtgacactcacctcttctaccttgggggcaggctcaaaacccgtctactgaatactgttgtcttgtgaccaagggtggtggtctctcatttgtaaaatagttcacatagtgattaaaaggcataaaaagaagctgcagccttggataccctagagctgaaggccccttttttttaccatttggaactgaaagggcccaaggtctgcaggtgaggctttcagatctcggactaactttccccagggaggcttttgtggccgctccaaaccacgtggcaggtgatggggtagagggtgagagcggggccatttctaggcattcggggtcagttaagggtgtgggggctcaggttgggggtgggagtcagtgtgggctcagagttcagctcgggacgcggctgcagggtgggtgtggccctgggggaggggccaggctaggctcagctcggctccaggtggatcctgagtatcgggtgggggcagcgattggggcgtggctggggttgagatccgctttgggggatgatgcccgtgctgggcaggatacttaatgtttgggaaatttttctacggcctctgtcagggtggcctgccactcggcagcaccggtagcggggaattgaggaggggggtggccgaggggaggggctcgccgtcgtgggcggggccggcttgtcagggcctcagccttgggatgtcttcctggtgggttcatctcccgcttcaggctctggccccgcgcgagcctcttgactagaatattggcgcaggggctctggagacccgggcctcccgctgtaggtggggccagtttcctcggagcgcctggaaaccgaaggcaggcaaaagagcacgggaccaaccctttgagtgtctgcagtgtgctacagtgctcgttcttgaagcagagaaactattccacccttcaggtgtgcagacatcagaagtcctacctccagggtggaagccggcctccaagttggaagtgcacagggctccggcagcggggtggcggggagttgggaagaatgcagatttccgggcccctgatgccgacctagtacacacagttccagcgtgcagttgggagtgcatgttaccggtaccccaggtgacccattatgagagttgaactgcccagaaacctgcctctggagggagtctggttcagcatctggtggagggcacccctgggaagcccatttccagccccttcccaggtgtgcagagcataagtaactggtgttcctcaagggagaagaggagcttgctgttgggggagaaaagagcatcttgcagaagggagaaacccaggcaggcctcagggatgactgagaaggcagggcacaaggtgatggctttgctgcagccgtgggctctgaggtgtccgtggtttgtgggcctctagcagcattgtggggtctctgcagtcagtgactgaggtcatgccgggccccgtactccattaggctcgggaaggtgcccccgccccacttcccgcatttccaggatccacagtaatttcatggcagagggtgaatatcacaaccaggaaggtggccagctgctctgtgctgttcctctatgtgaccagggaccggttcccagatctccctgcaacttggtgatgtctgccctgaccacctgcaaagtcttcagggacatgaggtcaagtatgtgaagaccctttgagaagtgcaagggtcagccttgactctggaggcacttgtggtcccttggccgtggctctgctctgattttccacccccactctctgaacagctgcatgctaagagctttctgtcctggttagctgtgtagcagtgtggtttcccactcccactcttccaggagttatcctgtggacacattggtctctgtcacatttaggtaattgttgatattataacaatgcgtaataacacaaaaccaagaaaaacatctttgcagctcgtgctactttattatttggccaattagaacttccgagtccagacctggaaagtttgctaagaggggcttaggggagcagcaagaccaggagcagattttcttggaacctgaggtgctttgatgcaggaattcaaggactcaccttcgataggtcaggctggggccctcttgagggcagactggttgcccagatcctgcctctggagagtcctgcgtgttgtcctgaatggggagacttggcaggcccccagcagaatggccacttggtctttcttggcagagagaccctgaatacatttctacctatttgttcccacagagaattgttttcaaaactgctctgtgccctgttttccctccagcgctggagtcaaaacatctctctgcatgctgggccctttctgggttctgggggtcccatggaaaggtgggcacagtggcgtgcccagccttccctcctgcagaacccgaggcatgtttgtggtcacctggccctgtttggggtggaggagggaagtagagtaagatcacattctgtcagccatttcctgtgataatttgggtggggttcacctgaaatttatctttacccactgaagcaaggatttgatcctgacagattattgcgacccctcccccagggcacactctggctttagagacttgtttccaagcacaccgccccttgggctccctgcaggtcctccctgatgctgctgcctgggaaagcagagcagagggcatctggcagagcagagggcatctgggtgggatctcctttacccagggcaaagccaggcttgttggtggcctgtgctttgttcagagacacacacaggccagtggctcagcacgcccacccctccctctcgtaccctcgctgtcccaggctgccagtggccctagttgtgaaactcctcaaacaatgcagaaatgtatgcagcatgggaggtgccagcctgcaccaccaccaaaccactgttaccccgcgttggtgtttttctttacagaccttctagatggatttgcacatatgcatatgtgtgtgtccacgtagacattttgaaacatacttaaataggatcctagcaagtatctcactgctggcattttgttccgtgtgtttgcttaaatgaggcatcttcattctttttcacagccgcatggtattccaagatgtggttatatggctgcattgtaacttatttacccttcacttatggaaaggacagctacattgccttttttttgttttttctgctattacaagttgtgtagtagtggactctggtgtgtgtgtgtcttggtgcagaggagctggcatttctgtaggattgagacctagtggtggtattgacagggttgataagtgttggttaaatgtgttgtggagttactgtgttatgtttttcaaggaaagagaccacacttgttagtccccgctctgagggagagacctattgtgtcacgactccaccttcttgaaaatgtttccttctcccaattctccttttgcatgtgtgagaacattgagaacgtttaaaacagtaccagcaaaaccactgtcactcccgcacgcctggtggctggctctcttggccatcttcagttctggttttacagagattggaaagtgtgtggtgggcgctcagccctggagcagtaggatgggggctggtgtggcgccatctccactccccccttccccctcgctgaaagaaggctggaagctgtgctgcctgagcaaactgataggacgcagttcattaaaccagtagcctgtgtctggggcttcacatgtctggaacacagcagagatgggggcctgatccttctgagtaggtgccctgaagcccaattctcaagcttctgacagcctcctgcccttagatcctgtgtgctcccactttacacatagctttaatctgattggttactggggaagggcaaaagacatggatggcagctaaaggcaggggaagaaacaaaccagcaggttgttaacatatgcatgtgtaagtgtgtgtgcttaaatgggtcatgaagaagccctacagtcaaccagcactggaacaagcatggggccatttgtggagaggcacatgtttctccgcagcaatccctgaggtctgcatgagagaccctggaataatgaacactctagcagggatcttgagataccatggcactgtgaagtgtgttcagtttgtgctttcaggaagcaattaaaatagttttaaaaataaaaacttctagaatagtacactcaactttcacaatcctaagacttccagactgtttgctctaggggccaggcatcattctgtttgtgttagtttacatcaagctatctaatcttcacaaggaccctatgaagtaggctctattattaatactaaatttcaaataaggaagctaaggctccagtgccttaggaatcatgcccaaggtcacacagtaagtgagggtggaacagggattggagctggggcttgagcctgggcagccgcccccgaggtgggtgtacctgctgtgtcctactgccactcctgtctggaccagtgtttcaggtcactgcaggtgagcagggccctgtggtagtagaaatctggatgtccccagcacacggcttcccgcacagatttttgctgcttcttaaaggttgagggagtagtatagtgaacactcctatactcttcccatagggtcattgggtaatattttgccacatttttctcctttcctccttctctttttctttctaaagaaagaaaaattaattttttgtctatatttttctcccttttccatctcgcctctctctttaaatattatatattatctgatacgcagtccatattcagttcccctagtgattcctaaaatgtccagtataggattcaggatccagttaatcacacattgcatttggttgtcctctctagtttcccttagtttaggatagtttcccatcttttggtcctttattatgttacgctggcatttgaaggcccaaagccagttgtcttgtagaacaactcacaatgtggattggtctgattgtttcccgtgatcaggtctggtttaaacaaattttggtccaaaatatggcacaggtgatactgggcacttccatcgcctcatgggggggggagggcatgggatattagcctgtcctactgcaggatcacatggttaaggtgggcggccaggctcagccccttctgtccacctggttggtttctactccatcttccagcttccttgactggagagatgttgggggttgggttcagctttggaaggcttttgaagtcaaaggaccacctggaggaggcctaggtgctcctttccccaaacagacaagacaccctgattttcttttgaatgaaaatggctccagatggtattaatagccagctcaagggtaactgtgagtgtgttcttggtcagcccacctgaatgccggccctgtggccacaggcagcctgtctcctagggctggggagggcctacggcgggtgacactctctaagtcctggtgagtctttatgtgctttcaagaaataaacaaaaattgtcctaagtccacacacctgaacctgtttttcttttctttctttcttttttttttttgagacgaagtcttgctcttgtcccccaggctggagtgcaatggcacaatctcggctcactgcaacctccgcctcccgggttcaagtgattctcctgcctcagcctcccaagtagctgggattacaggcgcctgccaccgtgcccagctaatttttgtatttttagtagagacggggtttcaccatgttggccaggctggtttcgaactcctgacctcaggtgatctgcccacctcggcctcccaaagtgctgggattacaggcatgagccaccacacccgaccttttctttcctttcaaagccccaaatgggattattttcttgagaagtcaacttcctgtcgagatgggaataaacttttctccagcttggcaattcagaagcagccactgtgctgtgtggctgaggttggggtcatggagacagccaccagtgcagtcctcggggtgggagatactgagttcagaaggctttggacactcttctgggccaaaataacagaaactcgaacttgttttactcttggcatcaatcgggcactgggcacagaagaaatcctcacccaaccaaaagctctgccatttggccataaacacgtatgcctccatagccacgtacatgtgtagaaacacatatgggtgtgtgtgtgagtggacgtggcaccctgctcatgcttgctgaatgggggagcatccacacctggaacatagtggctatgtggaacttctgatttctagttcagttttagatcttaggtccgtcttcatccccagcaaatgttaccagctgtttgtgaggcaggcttttgggggagacatgaagtttgttcagttgaaactagggctgtggtgaaggggctatgccttcacaccctgctgccctgcccagcagagtgaccggctcctgtgtcctccacactgcttcagttcccctcctgatgcagggccaggctgtgatcgccatttgctgttgggcattgtgtgtgtgtgtatgtgtgtgtgtgtgtgtgtgtgtgtgtgtgtgtgtgtgtgtgtggtggcggggcagggggcggggggagggcacagcatggcaccgagcaccagaaacacagccttgaccagtccctggtttttaccaacatctttctggacaaacaagacagcacacttggcagggggagtattctgtttattgttctccatttttgaagttcatcacacaaaaacacttgctaaccagaaacttggctgcactccgtggccattggccagtctgtcccaaggtgacttgtttggggaagcactgaagcttgatgtctcagattaaatgtccttatgctggtgccacaggggtgtggcctactctgcatggatgggtgaccctgggtccccaggcacagggcacaggctcgtctccttgaagctggagcccacgctgcatcatgaaagagctctgcaagaattgaaggcccagagcaaaaatcgcttaccaaagagcatgtggctcagagcctaccttggcctcctgtctcaggagaagcttctaaaggtggagttgtgtcacgtgcttgtctcctgtgagcacaggccaggtgggaggaagcttgggagtggggagaggatgacgtgggctcagaggagccacgagcttctcccccgaccccagcgtacactggacacacatgggaggtgaggtgatgcctgagcagcctggcgagtggtcagggccctgggtggggcctcctcattcccttttggagcactggcagctaatgcttgggggggccaccatcctttcccggtctggcctcgttgggggacacatctgtcttcctcctggagtaaggagagcctgtgaacaaagcagtgaccccaagacctatggccactggggatggcaggagccttgtgcttccatatgtgggtccaagctgtggatggggaggccaagtgtcctggcatgtgggaggtggtcaggtgctccctggagatctaacaggtatgcatgggttagcgagacctgagagtccttcttgggccacacctaagtatgtgcagggcctgtgatacagccagaatttcctcctctgataaacttctctgagcctttctacttgtctttaacccttttattgtctaaatgctcactaaacaagaaaaataatacagggaacttggtttaggggtattggtagaagttaaagttgatggcagagcatgaataggggtgtctgcaaggaattgttggaaaagagattggaaatagagcgaaggcgtatgtgagtctcagaacctgactcctttgttgactgggagtggggcagagggcatgggtccagcaggtcattggtctcgggttaccaaaaaggttaaggctattcacctgggccactggctggggtgctgctcaaagccaggatctgggagccggggtcagcaccttgggtgcacctgggcatcatagcaacaacaaaccccaacacattttcagggaccagggcggataaatgggagttaatgacatggttcccacacatccgaatctgggatatgtaaatgtgacacacagtctgagcatttggcaggctctccatggtcttgctttgcatagtttggcctatctgctctccagacttactgccccgttgtcctcacctgcatgactgtccatgtctggtttgtttactcgtcattgaaggcatccacaggggtgccatctgcccccatgtccctctcccactaggcatgctaagtggcctgcggcagggcaggcagggactcagattccctccatcccatcgctgaggtcttacttccttcttccgcccgccttacacgtggaaggtttctcctgtgcttgtccaccagttgttgtttttgtcttctagcacggatggtgtggcagaaggaggccttggacagcagcacgttaggacccacaggggctctggccccttgcagctgtgtgttctgagggaagatgcccaaggttttattatcttttccagagcgccctttttttctgcttgcatggcaggccctttctaaaattacagtcataggttgcttaatgacgggtgcgttctgagaagtgtgttgttaggcagtttcgtccttatgtgaacatcatagaatgcacttactatgcacacctaaatggcatagcctactgcacacctaggctgtatggtgtagcctcttgcttctaggctgcaagccggtacagtatagtactgtcctgaatactgtaggcaactgtaacacaatggtaagcattttgtatctaaatatagaaaaaggtacaattaaaatggggtgtcgtcttatgggaccagcctctcgtcccacgtggactgtcattgtttgaaacgtcattatgtggtgcatgactgtgctttgctgcttggcctaaggtgccagggcattctctgggtaagcctgaggggctttgcaggataccatcttttatcaaggttgaaattagttttagcactttattctgtgtcccctttgcggctgacagagcaggagcctgtcagtgtctactgtcacaggtgtagagctgctgtgttggcgagcaggtaggtggttttcctgaattactgtcaggctttagagtcttacaggaaatacagccttggctacttatagcttgtgatttgaagtttccctaatgatgggctgggtagtacacttcagcagtttgctttggacaaattgtatcattcttaagttcactcactttagcctttgagaaatttcaaagtttgtttccctgatcttcctagttgccctggattatgagccaagcgtttgaattcctttgcacatctagcactgcacatggccttggaagatggacatttatgtgagtgtgtgcacgtgtatgtgtatgtgtgtgtgtatatatgcccgtatttgcagcatgtgtgtatgtgcttgtatatgcgcatgcacacgtggtcagccatgcagccaagtctcagaacaatcgttccactggaagtaacccagtcttgaggcatctggccaggtggtgcgggctgcagcacaatgtttgtttctcccagccctatgaaccccagtggggctgcatcacttaaaggccggtctctacaagagcagggtaggaagcagcagtgcgtgcccagccgtggctgtgtaggcagaaccagccttcaggatggagggtgggaccctggagccaagccagagggtgtgtacccttggtccctgatgaggtactccatcttgggccattctgccccctggtctctctgctcctcctctgcaaaccaggggggccagcagcctgctgggatcctggccctggccgggttaatggatgggaactgagctccttggctgccaagctgaggttcagtctggccccattctcacttcctctactcccccttgtactgtgggatctgagcatttctttaacagccttcaggggtttccagcccttaggacaagcagcaggtgggtatacaggggagcagaccccaggggggcctgaggagggagggtgaaggcaccccttctttgtgctgtctgtagctgctcatcctgggagacactgtgggggaggctgtggcttccttcttccgccctctggggatgccctggcggcctgtcccttgggtgttgggaggaggtggcttggctgactgtccctgctcatggtcagggtcctcctacacagcagaactggaggtaaacactgggttgccttggcaactgggctgtgccatggctccaagtgctcctggctagagaagttcccattgtctcaagtttctaggatgggtttctattttgatttttttttttttaaattagcaagaatgactaagataccaaaatgtctgacctggtttctataatttcttaataaacatttgtcttccctttataggaggaatgttttagtgattcattgacttttcttttagacggtggcaaggccctggtgaggcagtgcgggggcagcacagaggaccccccactgccgacagctggcacgggaggctgggagagcactggccacgatccagggaccaggcatgcttacgtagacaccacacgaggattttattggctttgaggctaattaagttccatggaaaattttggggagatgcctctcccctgtggggggttcagatacccacaactggtgcttccagaagctgtctgaaggctgatgcgtctgactgagcccgaggagcgccctcccacccagtgctgcactctcccgccagaggcctggccccctccctgcaggtcagggcatgtgcttgtttataccttgttggtgtttgctgttaaattctaactgctcacctaggtagcctgggctggctgcgcccagtggatgtcctcccgccccccgcctgctgtctcgtgggagtgccccaggtggcactttgctgtgggagatgcagcagcgggctctcgtgcaggcctgacccttcaccttggatttcactgggcttccctgctctgcccacccatggattatcttgtaaagagtcacctgccccatggaggagccaggtgaggatccagggaagtggctttgtttattttactgtcagtagggctgacccaggttgccctggtgggtggtgtgtcctgtgagcctctctgcctctaggcctgtttccagggtctcgtcttcgttgtaggcctgcaggtctatttgggtcccttctcacgactgaggcaggctgaggatgtacccagttgggctgggctgccttgtgggtcctctctcccctgccctcatggccaacctcaggcgtgaacctgcctacaaagcctctctgtgcagcagcagctgtggcagttgccaagggagctcagcaccaaaaaagatgttcagatttgctgcatttgttttggaatgagtgcctggtgttgcttgtgcacaccccaagcctcctggcctttccaggtttccctgttgaacaggcagctctcctgcggttgggtggcacagggctgtggtgagggccccagcatccctcctcacctgggtgctcagttcctttcttgtcatcctttctctgtttgtaaagcagaaacagtcctgctaacatcacccccttcaaagatgtatgcagaatttgattttttttcctggaaaatatacttttttagtgtttaagaaaaaactcgtgctgggcatggtagctcatgcctgtaatcccagcactttgggaggctgaggcaggagaattgcttgagcccagaagttcgagaccagcttgggcaacatagtgagactccactgggcatggtggtgcacacacctgtaccagctgctcaggagcctgcaggcaggaggatcacttgagcccaggaggtggcagctgcagtgagccacgatcttgccactacactcaaacctgggcgacacggggagatcctatcttaaaaacaaaagaaaaaaatctcaagtcaaaggtattgaaatagtattggaaagtgttaaaggagtccaaaacatgagcacacttgggagtttcacgggagacccagcgcccctgtgccctgtgttcatcctgacaatttgggctctggacctggagccccgagacattgctgtgtctctcttattggatcgcctcatggaagcttgactccacaaatgttgtatttgcatgaccttccttgggaggctctcagtgttttatttttcatcagagaaaggccttcttgtctgttggttctttgttatctaaacagaggcactgtggtgtagtgatgaggagccctggcctcagagtgggacaggctgagcccatctctgggttttcactgtgaagtgggtctggtcatgctgcctctaggagcagaggggtagaatgtgggtgaggcacccagtaggaggggtgtgtgtgcgtgtgtgttcacgtgtgtgtacgtgtgtgtgtcgggtaagtggtgattaacttgcaagagcaaaatttcaccccctgcagtattgttcatgggtacctaaatgaacagacaggtttgctgtcttctcttttgaaaagaaacagacacatagacaattcagaatctttttttttttttttgaggctgggacaattcagaactttttttttttttttttgaggctgggtctcagtctgtcacccaggctggagtgcagtggtgcgatcatggctcaccacagcctcaaactcctgggctcacactatcttcacagctcagcctgccaaagtgctgggactccaggtgtgagccaccacacccagcccagaactactgttttaaagcaggtgctgggtcactttccaggatcctcacagcctgacctgagccccccttcccagagtcaccctgtgacacagcatgtggggtgatgctcctggcatcccagccccaggcgcatccagcctcagcttctgcgtctgtatcctcctggataaacccagactggctgcagaaaagtggtacagcctgtgagcttctgtgagcatcctgttgttgctatggagaccctgttgctagacatcaggcatgctcagactagggagtggtgaccctgtctcaggtgagcctcacgtgttaccaggtaaccaacccctctcaggtaccaacaggctgtacctggctagactctttaattagcagaagtagatgaactgaaacctcaacctcaaggtgaaagactcagtcaccagtcatcagaacagttctggacaagtccacctctctgaggtgggcttgaaagttgccctgcaccctgtgtcagtagtcttgggcagtcttacagggacaggagagattgtgcctgcaggtggccatgctagtcctgccgagtgaccccaccccaaggaaaggactttcggagaccaggcattctctgggtgagactccccacactgggcagtcttgggtgaggatgccggctgccctcccagggacgcagtgccctgctgggtgccccgccttccctcctgagacccaggcaccatgacaggtttcttaactgacagctctttagtagagaacagaaatcctgtttgcagcaaaacttgcctcactggatcgcttcataacagctccttcaagtggggcgagctcatcgctgcggtcggcatctcagccatcagcagcccggagaatcccactcaggacttaggtttgctatttttgtgtctcgcctgggcttcgctcgtttccacaggcattccacttcttgtttacaggagtaattgccttcatgagctttgggccatctgcggatatatgtatttttttctttattttctttcttttttggggcagcagttctatgtttgcaaatatgaggattgtttcctaaagggaagcatgaggccttcttgaggctggcctcttggctgctgagctgggccttcgcacccctttcctgctttatttccgtcttcctgtgagtgtattttgttgtatagaggcgcttcctgtggtcggaggtgaacatttggagtgactaaggagagcatggccttcctcgctctcccggcgtctgattgctccgtggacacttgtgcctgttccccaggcagggcctgcttgctggagggggtcggggccactcctggccatggagtttccgcatccccctgctggccaggctcctgtgcttggggagaggaggacgccgaggcacatactgtctccgtgctctgctcttgtggtcatgagtggcctcttctctcttctgctttgagtgactgggtgtagagtggcgcctgagctggggactgtcttgcacccttgcacagggcccgccggctcaggtgtgcagcagacaccatcctgggagaaacagcagcaaggtctggggtggccacatttgcatgttctgcagaggcagttgccttcgggatttcagacttgcccccagccgtaaggcgggatgcagtgcccacagacaaggctgggtgcacacagcctcccaaacagcatcctgcagtcttaagtctgcacacctcccaccaggtgtcggcccccagcagtgggaaggagaccagccttcaggctgctcacctgaagggagaaggcaaggaggcatgaggggtgcatccagcctccagtggggacccacaggtggcctgggtgctgatgggccctggcagagtctgtgtgcccacccatgccgtcagtctcctgaaccgcaggagcaagaactggatttcatgttaggagatgatttccaacttcaagaaatgacctggaaaagttttctacttaaactgcctgttgttgttaagagctggccagctctggctttccaacagcacgcacagccctcgggccaggctgagtcctgatgtggggatgtgcccactgactgcgggtcaccatgactccatggggaaggtctccttggagaggtctgaggctctggtgcacgaattaacctgctccttagtcttccctgggagacctcttgatctcctgtccccacccatacttctggtcacttgtcagtctttgtataatgtgttcagtgtccctccctctgagacggcagcagagacaggagagccacgcattgcaagtggcccatgcctggttgctgccctaaatacttgctgtgcacaaatggcctggctgtcaggggtgactttggccctgggggatgttttccaaccccctgggacaaacacctgccaatacttagcagctacctcctgctagcgctgggcacccacaccaccctgagcctgtcactccagctccagaggtggggctctccccacacccatacccatctctgtgcagatgcagacatcccagatccacccctccagcctgtgtcaggaggggagtgggcacctaggctttcccctctttgtggcaggactggaggagtgtcagcagagtggcctccttcacctgccttttaagccagggcgtgctctgaaaacacgccatggctggacgttttcatgtgtctggctggcaagggctccaggggaggtggcaggggtgccaggcaccaacgccaggaatccccagccacccagacatttgccaagcttggctcctcagtgccttggctggtggcctttgggggtgacttcaccctactgtcatggctggcccatggcgaaagggttcacctgctgcttaggagctgagactgggctgggccaggccaggggccctgtttctcttctggactgtgggggtttgggccagtggggagggagagcttccccaagggaccattacagaatttgctgtaagaatgtggagaaggagttctggtccttgggtttacagatttttattctaaacctaatggaacctttcttttaacaaaatctcctggaatccagtgcagaaaagagctgggaggattgctgggtggggcaggatgagggtgggaggggttttgactttgtcctgaggctgtgcgggatcctccctgggtcccccaaggaagccgcctgagtggggagggaggggccgcaagtaaccaggagcaggccaaggttccagggttcagcccaggacagccagtctaggtgcaagccaaccctgggggctggccagggagtgtgagctgttgcagtttggggcaggtgccttccaggctctgtgggtcagggttctctcctggcccttctgagggtgccaccctggcctccccgcctttgagcaggtgggggttgggtctgggttccatagggctgggcaggaggaggcagctgtgagatcccaggcagagccaggagaggagcaggacagatggcatgcaggcgtgctgcatcgggctgggattgtggggtgccagcagacaggggtggagtggggacttgggcattcctcactcattgcctgagtgtcatgaggggcctggctttggctggtgtttctgtcccttgagggcgtggtgtctgagggcagggcctgtggctccaccctgtgtgctgctctgggggcctggaggcctgtgcccccgcctcagcctgcctttgccctgctgcaccgctggcctgcctctttcccattcgggcacctgcctggagagcactggggtgcgggcagatcctgccttgagtgagcaccgcgtgcctagcagcaagcagcaggggatctccaggagcgtggcagggtcccatcctgaaactgacaggaaatctgtgagtatgagggtgggacggagaaagcccgggaggtgtaccgttcctttggcccccatccccctcaccaggggaccctgccctactcactgtcttccagtggccctacatgggcagcatcctgcctggctgttgtggttgtgaggccgcagcctgagactgaccacaccagggcttagtgtgcttagttctgacccgggtgtctgccctgccagcctggtataaagtcgtcagatgctgtgggccacacgaggtcatatttgcaccgtcagtttaccgggggcaaatgaccttctggggagggctgcaactgctccccacctctcacccctggttgtctctgtttcccggagggttccgtttgtaggcactgatgggggttctggttctagaggaagagtatctgagctcagagggagtgcagctccacaagtgtgcccctctgtgccggcatctggctcaggcatgcgtgagcccctctgtacagatgcctgcctcacgctgagatgcccacggcccaggcatatctctcaggagcccccgagaaccctgacgggaacccagagctgttccgcacagaacaccaggtcaatgatcttgactctgtttctgggaagattacccatctgtggcttccagaaagcacctcttcgtttttctgaaactcacagccttctcccccgacctcctgtcctctgcttttctctgaggccagaaggagagatttccacaccggccctttgccctggccacaggcctgagctcctgcatagcagctgctgtccttccccttctggactagtccactctaacctgaccctttggtaaagagtatgatggaccccccaccgctgttaccagtattcagccaccctggagctgcggccacccacacagctgtggaaagcccccaggccacagccaggcaggagctcctccccgggttctcttcttcctctgcaggagcttccaggccagagccccaaggcctcatgctgccccctgccccagctttctcaggacatgaggcgtcccctccttgcaggccccccaggctgacttctgtgtcacacagcagccttcacttccgtatctttctttctcttttaaaggcatcaccttcaactggaagaagaaatgaaaataccacctgtgcctcgaaatctttcagtttctagcgagggacatcccaggcacttggtggtggggccagggctcctgccggccataggtgggctattggcctgcaggccaggttcctgcctgccaccactctgcacccctctgtgctggcggcatcagggagggtctggggagatgcagactggacgtgtgggttgggtgggccagcaggggagaggggcagcgtagggtcctgagtctgggggcaggagcagactgtggtagcaagcatgggtgaggacctcagttcccctacctgctggctctcatcggggctgggacaaggtcaggtctgtgacagggcacgacaccgagcccagcaggtaggaggatttgaggacctgtgaagctagaaggtcaagcagggaattcaggatttggacaccctcctgggatcagcaggcgttcccccctccattgctctgctggtagcaccagccttcccagaaaaaggcttctttggcagggcctgggaacctcctggagggagctgggtgaccagcttctctgctgagccccactgggacagcacacctcaggaagaggccgtccttggtgctcgtggtggggaaggggagctgtgaacaaggcttccccctgaggcagggctggggatgggcagtggagactggaggcagggaagagctacccaggctttgccgcacgtgggtggcaagcccgctagaacctgtgtgtgctagcgtcaaagggcaccctcagggggctgggctggggaggggccccaccttgactgtggtgatgagagaggcaggatgtggggcccaggaggtgactctgccttggaggtgctgctcatgagggacgagggcatcctatggcaggccctaagccagcggagcctcagagtaggggagagaggcggggcagtgtgacttgggaagccaaggcaagaaatggctaaaggaaaagtgggtgtcacagtggctgggcccaaaggctcccatcctgccatcctgtggcagcagcttgagggggccccaacctcttctgtctgcccttccaccccctccagcctctggggccctggggcagcatataggctgcaggggttgggggctgcctctgttgtagtggctgcagcgctggtggaacaggaaggtgtgttgttggcttctcctggaccacaccccctgaaggtgacaccctcctaacacgaggaagagagctgcgcttctcagtgcgttccagatctcaggcttcagtgtctccagcctggccttcttggccactccacatgagtctgcctcagtgtggaggcttcttcctgcactttcaggggggtttatttctgaaggcggaaggcaggcctcgaaccccaggtgttcttgctggtggaggaaagtggaaaacacgcaggctttgtgggaagaaaggacgccactcctcctcccgtggattgcctgtggagctgggacaggcagcttgccactcttgtcaggatgactgtggaaggtgatgtctagaagagagagcaggagcacaggcgcccctcttcagcttggttttgcactaaagggacagcagaacccagagggcctggctctgtcagcccagcctccagtgccttccgaaaggaaaaaccacgcgtggtacgtaggcacacacgcacgccgcaccacatgctttttattgaagtatacgtgtgctacagaccatttaagtacagaaaagctaaaagaagaaattaagtggcacccacagttttacctcccagacaggactgttgcttggcctggttctcactgaaaagctgccagcatagagcccaggaagcccctcctggcagccaagggtgtgaccctgcagtcacggcagcctgcctgctctggccactgatgtccgcattttttagaccctggggtcctgactgcatctcaggccgcagtgccttgggctccagtggggtgtctcggtgctggcattgtagagtttaagcaccgccccagagctgtggtggaggctcagtgtgctgctgtaacagaaatactggagatgggtggcaaataaacaacaagtttattttcatagttctggaggctggaagtccaagattaaggcgctggcagattattctgtatctggtgaggaccctcttcctggttcgtagacagctgtcttcttactataatgtcacatagtagagggagcaaagggattttctggggtctcctttctaagggtactaatcccataaggagggccctacagcctcatgacattatcaccttccagaggccccaattcctaagaccatccatcaagctgggagttagggcttcagggtatgggttttcaggaggcacaaacattcagcctatagtgcccagcgttcttgcctaaccacggaaggcagatggcgaggtagggtggggtactgtatcctctgcaggcctactcccccaactcatggcagcttttttgccccttaactttgtagggccgaagcctgtgactgtcattccatctgggggaatcccaggacccagggcaatgctgctgctgcccatttagggaggggaggctgacactgctttccccatgagccgccacctgtgcagattatgacatgtttccccagagtgtgggatggaccaatgcccgctgggccacatgggaggcgggtgccctgtcaggcagtagtggtacagcagcgctgtcttcgatggaacagccaccatgccgaggacctggggatctggagggcacttgcctcgttctgcactgacccttaacatgagtctctgggacccagtctgctccagctggtgccagcctgtggttagtcagcttgcctctgatacttcactgccctggctgcatgagtgcaagggcagtgctgtgttcttagtgcctagcatgcagtggggaggaattaggctggtgtctgcaggagaagtcctccgggcccatgtgaggcgagtatgggccaagcctgtgcccctgtgcctgtgacccaggctgggagcagggggcttcaggtcctcaggctgctttaagcctgtttctcctgggcctggagggcttcctggggagggggttcacagcttccaggtcccctcctgccactttgaacttgggtgtgaattaatgaaaagcagatgagctcagatgtccctggaattccacatgaagttgaatggtataaagtaaccagccatgtgttcttggcggaaccaaaagtactcagagtgttgctgaagctgccaagtcctcagagtagcctagcctttgccgaatttgtgcttcatgggatgaatcccatttcatgagatgatgtgcttttctccattgagtgaagccctagagaaaatggcccctaaccctcggccattccagacatggagagtagtacagcatgcggcccctgcttttaagccaatatgcccattacagggcaggaagcagccagggtctgccgcagttatggtaggatattgggcatcctggacccacggatcctggacagaaggatgaagctttgggattggggagggaggggatgagccgagcaggccccccagcgtgcagggcacctggatgccgaccacattggtccattgttcggaacctcgccttagctctcttctgccagggcctaatgagaacaatggtctctcagctgagcaggtggacacctgtgaacttcatctcattacagatctcaaaggagggagtctatgtggttctgggcaaggatgctccactttgcttccgtcttcaccaaactcttaaaatatgaagtgtaggaaattatgcccctgcagggttcaggataaaggaaatgacacccaagccttggttctttgtacctgttccatccactgggtatttagagaaagtagcttggcgtgtaaggtggtctctggcccaacttcacccccttttttggtgaagtctgggacttgcacaagcactggctctttggctcagctttcagaccttgaaggatccgcaaggaagctttggtctgggtacagcccttgagaagggccttagaggtggccatgccagcggagaaggtgaggctaagcaggctcttgaggtgcgcccatggccaggccagaatgcaggcctggcactcttcgcccaggcgccttctgggcagcagcagttttgagtaagtaaggagcctaatgtttaatggcctttgtgtaagaacatgatgatgacagcgagagcagggaggctgggagggagtgtgtggatggacatccgagtaagagttccccagtgtctccaggaaccacttgctttgtaaaatgacccaaatccaccatccctggacctggcgcagattctgagttgggccaaggcctgggaaacctgagttggaaagtcttttctcagcccgtatcatggacttgcttttggtgctctgggctggggtcagatttgtaagtgtgttcctgttgtaagaagttgccttgccaaaagatcatcatttgagtgcctggcatttgtttttatttctatttgtgaaagtcaagcatgttaattaaggatgatttgagaaacaggaaagtatcaagaaaaattaatgaagaggaaaatcaataactttaatcccaccactcacaagtcaccactgttaaaacgtgggatcattccatacaagtcattttctgttctacattttcctgctttaacatcctgttaggctcataaccccaaggcactgactggtttctaacctggttgccccgtgtgcgcttgtcttgcactgagagctccagtgattggctgtcctgggacagccgtccacctcattattttcagggggagttcccaggagcctgcaaaggaatgtgcattttcagggcaggttgcttcttttcagaaaggaaggatgagtgtgctacccgcaagcaaggcatgagagcgcccaggtatgcaccctggcagggagagtgggcgggtggctgttggatgtctaaaagggttttgcacaccgggcgcggtggctcatgcctataatcccagcactttgggaggctgaggtgggcagatcttgaggtcaggagttcaagactactggcctggccaacatggtgaaacactgtctctactaaaaatacaaaaattagctgggtgtggtggcggacgcctgtaatcccagctactgaggaggctgaggcagagaattgcttgaacccaggaggtggaggttgcagtgagctgagatcacgccactgcactccagcctgagcaacagagtgagactccgtgtcaaaaaaaaaaaagggaggcggggggagttttgcagtgaacagaagtcactgtttaagtagagtttacacacaacaacaaaaaaagggttttgcagtgaacaaaagtcactgttggagtttacacaacagaggggtcgccacgctgccccgtacctgggagcttcagactgttccgaataggcctcccctggacactgagatcttggaggctttgtgatccagccttggatgccgggtcctgagatcttgcagtccagggaaaggtgagattgtctcacagcagaggcttgcctgctgcaggccacgctcaggggtttctacctccctcagtcccagtgtctgccctacaggctcccttggtcccgctcagaatgcacagacctgaccgtaccagtgagaaaggacaggctgtgtgagctctgcctggcccaggtgtgggctggccacgggctccatgcctgccttctccatgggccatgacgtcggccagcagcctcagcagctgctgagattagcgtctgtatgtggtgccacttggtgtgcctctggctcctggccctgtgctggccccgtggaagggcctgtcagcatgtactctctcctggggacaggagcagtatcttcagggctgggtctaccaacccggtctgtgcatttccagcctcctgtgtgcttcccagctctgaattatgaccactgggctgatttatttcttctgacatttgcaagctgttaggtggcagagatcagtgaataaaaacttaataaaaggctgtatttaatcccatgcatcctaggctgagccaagttcccttaggattgagcatcaccagatagaacccagagaccactggcattgggacctccagggtggctacttggagtttttgtggggagggcagtttcttgaccgtggagcatgacgaggctggacccacctccccgtctgtatgcagccaccatgcagcccacctaggctgtgggctctgttgatgccgccttggagtgtgcggcttgctctgggtgggccttccaggggaggagggactgcagaggtagtgacagggaagggaccctgggccagggggctgggctcaagggtggctccacatctgactttgtggcctcatttcctggtctgtcacttagggagttttgctggggcctgttaaagggggagtgcctggaggtatcaaagcaggggcttgtggccctggtcatccagtagttactgggggtgtttacagccgcctgtgctgggcctcccctggagaggaagtcacgcccacgttaagtgcgtgggaaacctgtcccaggcgttctgtaaccgtagctgcaggtgctctgggtgttgcctcctggctgtagagggcccccttgtgaagaggggagccccaggttggggggcctgggctgggcaaagtccctgccatctggcctgcccacttggggctggctgtgttgggcctggtcccaccagggcttgggctgcttccagatctgttttcattttcaattccctttattgctataaaaccacttcggggctgcagagaacaagctgttgtcctcagctgacctcagattcctggcctcaattgtttgcctcttgctaattttagcttctgatcatttccactcttatcctccccccaaagggagacacagaccaagaatagctgctgggaaggggggctgtggtggctgtggccagagttccaacagtgagctggcagggctgtggagtggctcgctgtggccaagcctggggcagggggctctcggcaggcaacccccacacccttcccctctctcaccgaggactctatactgcaggcatgggcctcagaggagaagaggacttcactgttccttcttttaaacagaaaccaggctgcttctggggaaaaagtacacccccacagccctgcctagcttgaagacccctgagagtccctaactcccctgagcccttcagactccaggacccaggttgtagtgtggggtcagacgtggcacttgactacagccaggccctggatacagcgtcagtgtggaggcctcaggcctatccaatccctacccagcttggccccagagcctggcacagctctgccctcccagtgagtgtcaggctgcagttgactgacagcaatgtccagtccaggacatcagcccaggcctgcaggatgggactttgcctgcctggggcagggagagaagcagctgaccaaaccccaaaccgtggtgtgctggtgagcaggcctggggagagccagaggagggatgggctgaaatccagcgaggaggaatggcctccaggcagggcctagggttgcaatccttgtccatatattaatagttttgtaatttttgtttttgtttttgagacagagttacactcctgttgcccaggctggagtgcaatggcgcgatctcagctcactgcaacctctgcctcccgcgttcaagcaattctcctgcctcagcctctcaagtagctgggattacaggcacccaccaccacacccagctaattttttgtatttttagtagagatggggtttcactgaaatgttggccgggctggtcttgaactcttgacttcaagtgatctgcccaccttggcctcccaaagtgctgggattacaggcgtgagccactgcacctggtcatattaatagtttttaaacttctgtttggagaacttcagacagatgcccacatcttcaggacacccacattttcagcacctgctagccccctgcagtcttatctctgcccctcccccaccaccgtcctctccagttgttttgaaggaaatcccagatgcaatatcaatttgtccataaatatttcagtgccttacatcttcaaatgaaagcctgatacgtctaattttcatactgggctaacagtaagtgtgaagcaaaaaatccaaagcctgaagtcaccccacatgacttggtattgggaattgtgtggatccagccctaaaacccccgagcttggggttggagccaccatttaaagaagtgttggagcccatctcgccatccctcagcctcgagttataactagtcataggtaaaaagaaggcaaccaggacacaggtgtttatgagatcaaaagcaacaacaaccgaaacaatcaacagtgctactaaggtaacacagataggtgaggaagaggccaggtgctcagtaagtgtctcctgtggacggtccctcacctcccctgagcagaagggcagggtgtcatctccacatgccttggggagatggcagggccagcactctccaatggcttctgaagaggagctactaggagaagaaagtgatgctctaaggaaaggctggactgccgagagcagtatacccatcccattttgtaaattatgttaaaaattgtgttagagtagtgcatgtggtaatacacatagcttaaggatcctgtctttctgtacgttcattgtgataagcaggtcacccccaccatctgccagcttcttcagctactgcctttggtatttacctttcccagctcgataacgtgctcataggggctcttcttgatggtagaagagtgttaggcattatctcctgacttcccatgatggcacatgagcgcctgcaggcacccttctcccacccatgtgataattggatatttaggatggagccagcatgcggtattttgggggatcatgacagtaaatgctagttgcaggtgacccatacattacacgtgtttctttcccttagactcaatagttgccatttctgcttggttttcccagtgctgttgtccccacacccccagccccccatttgtccccacacacccagtgtggcctgctccgtgtggcctggataacatctctgtgggggttggctgtcatcctgggacccctcccctaccatccaggccccacttcctggagcccctgccatctgcttcttggcagagctcctgctgcatagcctcctggaaggggtgcactggaggccatttttcctttccttctgacttttattttagggttgggggtacatgtgcaggtttgttacatgggtaaattgcatgtcacggggtttgatgttcttatttcatcacccaggtgataaacatagtacccgataggtagtttttcagtctttcaccctcctccctccccgctcaagtaggacctggtgtctgctgttccctcttttgtgtccctgtgtactcagtgtgtagctcccacttataagtgagaactggccgggcgcggtggctcacacctataatcccagcactttgggaggccaaggtgaatggatcacctgaggtcaggagtttcagaccagcctgaccaacatggtgaaaccctgtctctactaaaatacaaaattagctgggcgtggtggcgggcgcctgtaatcccagctactcaggagactgaggcaggagactcgcttgaacccgggagacagaggtttcaatgagccaagatcgcgccactgcactccagcctgggcgacagagcgagactccgtctcaaaaaataagtgagaacatgcagtgtttggttttctgttcctgcgttaattcacttaggagaatgggaggccattgttttaaggcttatatgtctggaaatgtcttgatcctggtctgaggttgattcacgtttctctgggttgaatcataggtgggaatggtttactcgtgcggtttggagctctgatgttgctgtggagaagactgaagcttttctgattctggctgtgtgcacctcccggtctctttgcctctcagggccttttgggcttgtgcctttaccagggcttggaggtgtgcacgtgtgtggaggtgcttggccaagctctgtcctctgcagcgggcccgtcgggtggcatctggaaaacattcttgccactttcttcacgatcacctcacctcctgtgttctcagggctgcctgcagttccttttatttggagctgttggtctgatccttacattttcatattttttccctcttacccatccatttgtatttttgctctgttttctgtgaaattctctcagtgttctctcccaaccctgctattgggatttttatttctgccacatttttccttctgtatctttactttcagactcaggtttctaagcctttgctttcaaactcaggtttctaagcttcccttttaaaggcgcatgcggttcttgtttccgccaggccgtctatgcggtgaggatgttagtgacagctctggaagtcttctcgttgcgtggcctctgctccctccacatcacctgtctctgctccttggtctgggtctcttgcccacccacgtcaggctcttctgcattgtctgctgatccttgatgtctggtgacacggcccagagagcctcgagctgcgtgggggcttctgggtgcccatcaggctcagcgacggtggcctcctgtgggtggtctactgggccatctccttccgggttttcccccaagaggagtgttctgctcctgcctgggggagggagggtggtcctgctgcacactgggagagaagctgggaggcagcactctgtgagtgggctgttccccacacccctgttctggaggctgccctactctgagctgggtctggagtcgtcagtccagagctccctcctgtgtagaccctcccagaaagtcagcctctggttcctggcaggtgcaggaagggcaagcagccatctgtaaggtgaggaaagaccttgtgtccacagctgctttatctgatgttcaggtgccccccaccaactgcacccccacccccgccagagactcccgagcctttgtggggaaacgtggattgcttccttgccttctctgctgtctttctaatttcttgcttccagattatttttgttactctctttcccttttgctttgtctgttaaaatccactttctttcattgtagtgggatctggggctggaagggtggtgggtgcctgtgcctgacctgccagctttatccagagttcctgttaggcctttggtccagtgcaggaggcgtggggagagatgagggtaaggtaagcactaggtagggggcggctgagagttgtccagctgttgggcagccagcatctcctttgttcttgcccaacaatgttatccaggagtttgccagagatacatccagcaatatcctggaagcaactgaaggcagctcacaagaagacagttgtgcagtggaaggagggggtccaaacctaaggttggcaggttgactatagtacagttgcgattgtctgcattcttacagtttctgtcaaaacatcgttttcccaagtggctggtcagctcccctgtggttaacatgcttgcagcaatggatgagagctccagttgctccaccagcatttagtattgtcagtgttttggattttaaccattctcataaatatgtatagtgatatctcgttgtaatttgaattttcataataacaaatgacactgaacaccttttcacacagttgtttaccatctctctatcttctttggtaagagtgttcagatcttttgttcattttttaaattggcatttgcttattgttgagattgagttctttatgtattttagatacaaattgcctttacttttgatcagcctcaaatgaagagcatttttatcagctaaataaacctggctctgtaattgtggattccaacctcatattcctgtcttgccttgtgtttcagaaaatatctgaagaggtgcataggaatgtcatccctgggctatcaccagccatcagggctgtgttggtatgcaagcagtcacattgcctcccgatgcccagaacaaggatgttaaccgcacactggctcctgaagccagagaacattcccttcaagatggcagaggaaaggcgggggcagtggggtcagctggacatgcgtcaccctaccgtgctcagggaagatgcttctggcttcccctgggaggcagctagtgatgagggtctcacaatggaaaggaaatggaaatgtctgttctttgggttcagctctcatgagtccacaggtagcaccgttcatctggagaaggccttcacttgcacaatccatgatctggaagcttctgtggcaaggggccgatatacgtctccctacttatccattgaggagcaataagggttgtgactcgggtgtgcgtgaaggagagaagctccagagcccttgtctcaggtggcttctggccttctgttggcagaaaccattggtattctattatttctgtttttaaaagggaccttgagaacggaaattttcaagtgtgttttgtaacccttagcaaaaggagagcaaacacctttatgaaattctggcatgtggtccttttaacctttccaggcagtgtactggttcatgcaaactagtgctattcccttcttagggattggggtgctgggttctgtggaagcagtcccagtggtgagctggagcttgggtgaaaggtacgtgtgtgtacatacaccactttgttacatagtgttattgcattaattctgactgtccaaagtgattcatttgatgaaggcagaaatgcagaaaggacagtcacacacaaatcccatcttcctgaggtaacctctgtttccttcctgcaattagagctctggcatatgcatttcatgtgtgcatttgagggtggggctcagccacttggtagtctgttttcttccctgtccacgttcccaggggctgtttatcagcagctcacattggtggttcagaagaacattcgagagagacagctgggctggctccgtgtgcttactctccctcgtctaccccatccaacagattgtgaagcctggttccagtaaccttggggatgacaccaaggagcgctgagccctccaccccgcatgttgtggtcttgggggagggaggcaggtaggacacagaacagggttcctgccccagtggctcctcccagctcttgctagccctcccttggcatcaggcagacctaggtagcctcaggtcttggagtcccgtacagagctgttgcagagggggtcactccaaccttgaagcttctgggggcctggccgtgggatagtgcagagtgtggcactgcttttcttcccggctggtgtccctggggtcagctgccttaaggttagggccctgttctaggttaggacagggaagggcttaggaaacagggccagcaggatacagggaggaaggtgtgggcacggacatgcagcgggcaggcctgtgccgggaagagggtgggctttgtctcctgagaagaggtggccccccagagcactggtctccccacatggcaggcagtggggctctgtttcaggccctctccaacgcacttaggctgcgacaagcctgagcaggatgtagggggctactagacctgcgggcagggctgagggacagggcccggggctgccaggtcacctgttctctgcaagagggtttttgaacacaagggctttcccaaagggtaggggtaacttgctcctagtgggcaagaccgagagcccctggtggctccatgggcctgggctgctgcaggagaggtctgggggctttctagctcctccctgggggtctggaggttcctagcagaagccccggcactgttcacctgtttcagaaaaaacagaccgttgtctaatttgttgttgttgttgttttgtctcggctccctcaaaaaccaaaggcgttttttaggcccgtcgtccaaattacaagctcattttaattcggatgtatttactttgtgaaaccaaccctgaagaatacattgtttcgttatattctgctggaaaccttgccacatttttcctgagaaaactgagcctgctgtgcacctggagccggccaggtggcaggtgctgggcctggaagaggagcctgccgaggctcctccagggcttctgagtgccattgttttgagtgcgctgcctggtagcgctgggcccttccagggaactgcctggctccttcctcagctgcagcctcctgctgcaggggagctggggaccgtggaggtcccccacaggtcctcaggcccacatgcccccagcctgggcaagcctgccgtgaaataggcctcgtagagcctggctgtgggggcagcaggggcccctgggtgcagagggtagcctcgccgcactgtgggtgggtgcccctgcttgctcctcctggaacgtgaacgtgggcagcagtgttcctgttccatgctggggaggggctgtgagaatgtctttcttcccggtgtagcctagcctcaggcccacccttctgggtgtgttaccttggtgaggtcacttggttcctcacctctgacaagggtttcacatcaacactttcctgtcttccgggttggtagagtcagatgagcccagtgcaggccaaaagtaaaagctgcacccctgtaaagagtgtacatgcagctgtttgtgccattgagtgtctgtagcagagcttagcagggtggggtccctgcaggcaaggtcccccccaggagacacagaaggagagggcagggggaggaaatgaaggctgggggaggggagacacaggaagaggaagtgggccacgatggttgccaaaggctctgcagacaggggcccctccctcagttgcctagagagccggctgggagcacgggcacctggggtgcagagctggggctggctgtgcaggtgcttgttcgtgtcaagaagcagttggacttctctgtgagattctgcagatctcccctgtgactgtcaaggctggtgccccccaccccccaccccagacgtcacagccagaggcaggcccaagaggcctttccatactgtgtccctttccctacccaccacgtgctctgccctctttcttccctccctccctccttccttttctcttggtgcaagagaaaaccctttcccagtagtccacagattccctggttcctactcctcatgagcccctacagtggcacttgggatctgcatcctagtggctggatggacttggctctcctagctgccatccacctgggctaattttcagcccacagtggtgtcacaaagtggtcttatggcaggagtgtggtattcaggagcctgaagggggcttctgacgtggaattacaactctggaactgcttctgtttaaatcctttgctgaatatttgtcacccatagccttttaggtctgacccgttctaaactgctgggcctatcaaacaatttatcagggagggcccttctccaataggacagtttgcagcgtgacccaggggctctaaagccctggagccctgccctgggagcatctcctacaaagctagattggactttattgctatttttgagtttctcatcctggaagccactgcccagcacattctgaggagaatctgcctgggcgaccattgttattttaagagagctcttggggtaatatgaggaactgtgctttgaaatagggaatacagaatggggccagtaatgtgcccagagtgttgaatgtctgatttttaaattggcattattgatggctagcattttctagtttgctatggattttttgttttgaatttaactttttgaataggaaatgcatttgtgtgtttcagaatctaaaagatttaagtagtttccccagggaaaattctgtcaaccttccctgttctccatctgctcagtgttcccctgggtgatctctgttcctactttcctagggaccctctctctgcacatacaggccaaggcgcacgtagatccttgctggtcatctctcctcaaccttgttttcctcactcagcttggagatctttccatatcagtttgtaaagaactcattctacttctttgcgatagtgttctgttatatgtgcgttccataatttatttgacaggccccagtggaaggacatgagttgttttcaggttcctgctgcattgactaatcaggagcatatcccattttgtaggtgtgcaaatgcgtttgtaggctaggatgtcaaaagttcagatgtgggtaaaagggtgtgcacatttctaattttaataggtattgccaaatcgccctccatggaggttgtagcagtttgtactcccatcagcaaagaatgcctgcttacctgcagcctcaccaaggtgataagctaccaagctgcatttcagtgtgtctcatctgccattagctcctgatggatgaggtggagcatcttttcatgcatttgagagccatttgtagttccttttttatgaatgggctttgcccatttttctgttggatatttttctttttaaaattcctgtgagctctttctgtattggagattagccgtttgtgataggagctgcaaatattttttctctcagttttgtcagttatctcttgcctttgtttatggtgactttgttcatggagaagtatagtatactgttttgtgcagtcaaatagattgattgattgattgagactgagtctcactctgtcacccaggctggagttcagtggtgtgatctcagctcactgcaacctctgcctcccacgctcaagtgattctcctgtctcagcctcctgagtagctgggattacaggcgctcgccaccatgcccggctgattttgtatttttagtagagacggggtttcaccatgttggccaggttggtcttgaactcctgacctcaggtgatcctcctgcctcagcctcccaaagtgctgggattacaggcatgagccaccatgcccagcctttagtcttttcttttatggtttgtggactttgattcatagaaggaacttctgtcttacagttttctcctagaatgtttgtggttttatttttcacattagaatctttgacccatttagaatttatcctggtgtagggtgggaagaatgaacccagcctttccagatgctaccgaagtgtcctcataacatgtattgactgctccctgccctaggggttcgagatgtcactctgtcctttgcacagttaccactacctttcgttctaattctgccatttctgctgggcttcactggccagtgatcagcttacgaaactgttgaatcctggtggtctcgtttcccccacgtcattgttttgcaggattttttctggctattactgtgtgtttttctgtatgaatttttaggatcaagttatcctattcgaaaacaaagcaaagcaacaagaaaaatgcctactttaaaaaatatcttcgcaagcattgtagaaatgtggagccacacatttgcccaaggaggattctctcactgaagcagtgttgcctccgacactgtggcagcctccagccaggcttcagcaccctgccagctcttgcatgtgaagagtggatagtagtgtgtgatcagcggcactagaccagagcgcctgggacagggcacacctgccccccatgtctctttcactactgggcggctcacaaacatgcttcccggggccccttggcccataggtgataacattgttatctcctccaagcaccactgtgcagcaggcatgtgccccacgtattctcccacttaaccctcacagtgactgagaaacaggctggatgacaatccctgaggcatcaacaaaggagtggaggtagagcaggctgcttccttgccccaggcaggttccagctgcggctctagctctggcgccagccagctgaatgacagctcactctctcctcctgggcctcacttcccttacctgctcagtgggtgggtaagagcttccaacctggacttcctgcgaagccatgtgcatgtcagctccatgtggcttaataaaccactaacatttctagagacgagcaggacagtcaaatggcctcctaaggagttaggaagtccaccccccaccacagaggccaggcctttctgctacccctgaggctgtatgcctgagtttcattggaggccagcagttgatcagcccctgtgtttggccatgccgacctgctccagaacaggagggtgaacagtcttactggagtgaaaaacattgcagtcttgaggttgggagctagaagtggccccaaaccagtgcccacagggcagagctgtccatcagtgaatgacagcccactcactggtggggaatacctggagactggggacagtggcctgggagcctgagggcaagcaatttctctttggaagcctctccctgtgcctccctttgagtctgaccagcgctgcccctgccattgcctccagatacacacccacatggacccttgcgctccagaggtctgttgtatccaagacatccctgtgagggtgatggctcatttgcctttccaggacctcccggtaggagttgcatttcttcccttctcccttccatgaaggggagctcagcgaggcttcctagagaagacccagcaggaggccggcagaagaggcccttgcggcagacgctgctctggccccagcttggtaccgggcattggaaacattgcaaaaatgaccactcaacaggcttcccacaggaggttcgcagacagaaagatctgcagtgtggtttatacaggtgcagctggagccgggtggggtgggggggcccactcacctgtggggggttgggggggagtttggctaaggctggattgcaggagataacttggagcgtgccctttgcgcaggagggcagagcagagtggagtccatgccacagcccgagtctgagctcaggctttgagctggagcacgcacactcctgagctggctgcatttgcatgtggctgctgtgggggagaggggagggcctgggacttgggtgttgaggcggattgggggctcagctgaaggagagagagcccctgcgccccccttccggctggctctctgagagaacacgttgtccccgcctgggcctgcggcttgggcaagagcagcatgtgggacgctgtgttcctgataagatgaggcaattgctctcactcggggcgctgctccgctcgcggcctcgctgtggcgccagggaacatttatgtaacgcgcagccctgagcagctgccccgcccaaccatactccaatccccacccaccccactctccccgcaactgcatgcggtcccctaccctgcatcacccggccatgcagcctggtacccgaagagtcccccactgcttggcacctgtaggacccccaaaccccagcatggcttagcccctctcccagctccccacagttcccccaaccctcctacagcctcccttcagggctccagggcacctagtgcccctccaggcttgaccccagcccccttcctctcaccaagtcttctcacaaggcctaaccccgccttgtcccacggcccccaccccatgcacaggcacaggcacacatagccagaacccctggggccctcccacctggggagctggagtgactctgagatccggcaggaaggctaggagctcctctgcaggagtctggaatctcctactggttctcttgtcattttggagctagagggagctcctgtcctggtgagtccctgtcttgctgttgctgtctgtgtaccccatgcccgggtggaggcagatgcagggtttgagcccagcaaggagggtgcttggatttgtttaggccattgggctccctttgccttagaatgggaggcgggctcactccctgaagggccgggcctggctggcccctcacctcactgtgtgcccccctgtgctcactgtgtgcccccctgtgctcactgtactcggctgcacgcagccccgcctggagtctgtccccataacagcagtttttagagtgaagcttgaggacactcgcaggtgcctcagacccttcagaggggccatgagatcaaaactgttttcataacaatagcactgtttgcctcattctcccaaaagagtacagtaggctattgcagatgctacaggatgtgtgacagcaccacgacgactggaatgcgtgcttgggttgaagaccttttttccattttaatttgtaatttctaatacgatgaaagcagtggctcccgcccacatacaggaaagctcctggggctccctgcggatcatgtgggtgaaagtggcctggggcatgttgctccctgttcccgcctccacccgttctcccttctctgggctgctccttgtcagcctcctgggtgctgcctgagtgtcactaccaggggacccagccagacccagtgttgctccttgctagcctgagccataactcctgttgtgggccagttcattggccgtcacctctctgcagcaggctgagggaggagcagagaatggagccgtgggggccgcgtctgcctgggtcaggaccatgtctctgggccaggcacccagtatgtgccctgtcaaagcataaagctcctgatatatagggaggccaagagctgtgctggtggagtggctgcacccaacacccaccttcctccactccaggctgcctggcaccaacgtcccatccattggatgctgcatttctctgcggccccaacaccatgtggtccacctgtagctctgtgtacctcacatgcttccccagcctgcaggcagaagaagctaaaggacaaggctcctcacaagggctattaggaagcaaggctgagtctgaatttgggttggcttccccccacaccaacaggcccaaatcagaggagacccagttgacagggctaatgactaagagcaacaataacagctgagatttcaggagtggacctttggaacgtgccaggcgctgtgctgaggccggtcgtgcgcagccccatgggatcactgtatggaccccccgcatgaggacggggcagtgtgctcacttcctgtggctgctgtcacacattaccgcaaactgggtggctgaaaagcaaccgaaacttactctctcacagttccagaaatcaaggtgttggcagggttaattccttccagaggctctgagggagaatccactccatacctccccttccttcccctgccccctttctcccccttctcacttgctcccttccccgtctccctcactcccctcccctcttctccatgctccacacttgggagctcatctccagatcctgacctgattacatctgcaaagaccctttttccagataagatcacatgcacaggttctggagggttatcacttggctatatcttttgggggaccattatctgccctactgctggcagcacggagctttttcgaggccatagcgtcacaactcagggcaaacagggtctgaacctcatctgtcagacctgacatggttaatgctaaaccatttaatgctggactttcccaagcttttaatgactagtgtgcgttgtgaatctccaagagtggaattatcatgcaacattttcactctttagttgacaaaattttttttctggaaacgataaacagttttatacaatgataacatttctttgaacatgttttgggaaatattggactagatatttaaggaactatatttaaacacttcttcttcttgttatggaagaaacaaatacataggatttttttaaaaggcccaagccaggcgtgtggctcatacctgtaatcccagcactttgggaggctgaggaagacagatcacttgaggtcaggagttcaagaccagcctagccaacatggtgaaactctgtctctactaaaaatataaaaactagccgagcgtgggtaggcgcctgtaatcccagctagtcgagaggctgaggcagaagaatcacttgaacctgggaggtggaggctgcagtgacagagcaagactctatctcagattagatagatagatagatagatagataggtagatagatagatacccataacacagaggagcttgcaacaaaaaaaatcctctcaccagtccagccccactcccttagacagcaacacttcttttctgattttagttgtcttgatggttactgccataaatgaactgtattttactgctgtttcttgatttatcaaatttagatattttctgttatcctcctgccatgaaatttaaggatttacctgactcctatccctcccctccaactcttcctaaattgatggatgtattattttacttattttgttgactatctttgtaattttaaatctctgtgtttcatttagatacgttctttgcacactgtgtgcattccaacttttcccttaaatccatgttctctgctgggcccacaggtcagttgtatggcctttgtttataggattggttctgaaacattgacaactagtgctaaggttagcatgaccacaactgtgtaaagtttgcttccatcagcagggcctgtgctgggattacatttcctgccaccacctcatggagttgttgtgaagaataaataatagagcataggaaaaacccctagaaccgagcttggcttggagctcttgacccataatcatgaggcattttcgtttacatctaatttgaaccacaatttttttgtatgtcttttatttttcctggagtttctaattgcctcttttttcttttaaacaaagaagagtggtgtgtctttactgggtcctgaagtttacccagccttttgatggtactctctggtgcacaaaactcactttcctcctggaattttcccccgtgagtcttggtcctgtgctccagtgacctcccggggtctctgcctcactcttgtcatgcaatggccctttactattcagtcatgtctctagctccttggttttatctcattttagctggagtgtgtgagacattaacttggaaggccctgttcctttgtcttcaggatccagtgtgacttaggaaaagtctgatgtctatcccagccttgttcctttgtggatgacctggtgtttgtttcttccccctctctctattaagctgtgagagctcctgtttttactcagtgttctgacattgcagagcttctcgcagcagaggtcttaactcatttacctggtccacctctgtgcagcctgtctcatgttagtttcctgtctcctttttcttttttttttttttttttttttactctttgacagagactgttctattatttcttttgtaatttcttctccatgttttctgttttctcacttgattgtaattgtcgtgtatttgggaaatcgtggtggctacttgattttgaatccccccaacaccctttcccccaacatgtaaaatcaataaagagagcaagtgtacccacacacggcccctgcttcagcagtaccaggagacggaacatcgtgacatccacatattttccagaactgttttttggttctttttttctcatatatttgctttgagtatatttccagcttttatatgaaagttttatatgcacacaatgctgttttcaattcctaaatgctgttgtttttgctttttttttttgagacagacccttgctctcttgcccaggctggagtgcagtgacacaatcttgactcactgcaacctccacctcccaggttcaagtgattctcctgcttcagcctgccgagtagctgggattgcaggtgcacaccaccacacctggctaatttttgtatttttagtagagacggggtttcaccatgttggccaggctggtctcaaacccctgatctcaagtgatccacccgcctcagcctcccaaagtgctgagattataggcatgagccaccgcgcctggccgtttttgctctctgaacttctttgtatggtatcctctttgcttttgcatcaaatttcatctcaaattcctcagagaatactaatcagaaatttcaagttaaaattttcttctctttcctggcttcactcttttcctctagagttggtggttgcattgcgcttggcctttcttttccatgctgctggttctccctggctgtctggccatccctgggtatctgcttgtgtttaaggtgggtgggtgagtgggtttcctctgttgaacatgggtagaccagcttcagtgactggcagtcactttagggtctgtatgggggtgagaggggatgagaccgtgtaggaagggcagccctgcggccacccctaatacaagaagggctcgtttctggggtgccagagccccccaccctggttcttcctgagcagttgatgtcatttttgtgattcagagttttgtgtgttgagtttgcctgggtaaatgctggcctgtctcccgctccgagtgagggatgggaaggagggagcagcatcctgaccgtagccaaccttcattacctcccaccccactgtgttctgcctcctccctaccggcacaggcccctataatggggtgctctgggttgctgcccttgtctgtcaccacacttgggtctgcaagaggctgtttcattctcctgctctgccagccgtccctggttggtcactttgggacttttgtgagagaaggagcagcagactggttgtagaattccaggccccggaactcacctacgctgaccctctcatgtgacagactagactgaggagggtcagaatgggaattgccttcctgccctgcaggggtgcagagtgtggctcccatggagcagcatgggcggctggactccgggaggcctgtgaagccagggcatgggcctgcaacccccaggcgttggagaccactggcccggcatgggtgtgtagtgcagcctgctttgtggtgtacttagggggtccactgccaggagcctggggccctgacctgtacctacccatgggccctgcagcttcagcacctgaaatgctgttttatcctaggccgtgtcctctgcctccatcccaggcgtgggcgggagggcaggggcccaccttcatctctgccttgatggatttgtcacagaagctcttggaggtggggcatgtgggaggggtgttgagagaccagggtgttgggtgttgcgggcccttccccagagagggtgtgaaggcggggccaggtgcggatactgatgctctgcccctgtgcccacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaacaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcagcgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcacgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttacccactgtgtgtcagctgggattggccgacagcgtggtggtgacttctaggtagaccgatggaccctaaattgggcagtggcattgtttctgctgtggtgggaactggcagggagagggtcacctcccactctggttggatgcggagctggtccctctggctgccatgctgtgttggggctctctgacctccctgcttgcattgggtctgggagagagagtggaatatttggtagggaccttgacagaaga

SEQ ID NO: 16297 - DNA, 421118 bp, Human
  misc_feature (1)...(421118): n = A,T,C or G
ctttccctattgcttatttttgtaggctttgttgaagatcaaatggctgtagttgtgcaagcagctttatttctgggttctctattctgttccatgagtgtttatgtctgtttttgtatcgattccatgctgttttgattattgtatccttacagtatagtttgaagttggataatgtgatgcctccagctttgttctttttgcttaggattactttggctatttgggctcttttttgattccatatgaattttagttttttctagtttgtgacaaataacattggtagtttgataggaatagcattgaatctctggattgcattgggcagtgtggccattttaatgatattgattcttccaacctgtgagcatggaatgttttttatttgtgtggtctctgatttctttcagcagtgttttgtagttctccttgtagagatctttcatctccttggttaaccacattcctaggtatttcattttctttgtggctattgtaaatgggattatattcttgatttggctttcagctggagtgttattggtgtgtagaaatgctactgatttttgtacatcgatttttgtgtcttgaaactttactgaagttatcggttccaggatcctttttgcagtctttagggttttctagatacagaatcatattatttatgaagtgagatagtttgacttcttcttttcctatttagatgccttttatttctttctcttggttgattgctctggccaacacttccagtactatgttgaatataagtggtgagagtggacatccttgccttgtttcagttctcaagaggaatgcttccagtttttggccattcagtatattaggtgtgagttaggctcttattattttgtgatatattcctttgatgcctactttcttgagggttttccttgtaaagggatgttgggttttattgaaaactttttccgcatctattgagatgattgtgtggtttttgcttttaattctgtttgtgtggtgaatcatatgcccaaccaaccttgtatcccaagaatgaagtatacttaattgtggttaatttactttttgatgtgctgttggatttggtttggtggcctgagaataaaatgcctacactgccatgagctgggtcaccagagaatggctgactttattaatgtgcccagcttaaaaatggcatcctgctagttaatatttgcttagtttggtcacaagtatgtcctcatatatttttttcaagaacaacaccagaaatataatttcatatatgtagttaattttttcttagtatttatgttaaaggggtaaaaagaaatgtgtgaaattaattttaacatgttttatttaagctagtatgtcaaaaatttccatttcaacatgtattcagaggaaaaattattaatgagatagcttacatttttaattttggtgctaagtcttacctggtgtgtatttcgtacttatagcacatcttaactcagttgagccacatttcaaggactcactagccacatgtgtctagcagctaccagagagcggctggtagtggctatcagacagcacagatctagttttatagttttcgattttagtttaggtctaggtctgttatatattttgagttagtttttatataaagtgcatggtatgggttgaaattcatttgttttacatgtggttgcccatgagaatctttgactaaaagttgttcttggtaattagagatcatcctgggtatcaaagctcaaaatttaaatatactttcttttcctgctttattgtctttttttcagagcaatgtaaatttactttgtaattaacaatgttcacaccatatatgtaaaatgcttagaagtgttaaacttttagtgttttggctttattcatatacctatttgaatttaaattacatattatgctatttacatttttaagtctgatttacctccctatttctaaaattatatgtaaaatgcttatttactttctttccaggcatgtactggcattgaaaacattgacgaagctattacattgcttgaacaaaataattgggacttagtggtaagtacttttttctttctctgatgagtaatcaaattttatgaattcttgaatgtctttaattattttttatagatgggttcagcataccatagctcatctataactctaagctgagttaataaagtctaaatgccatatctttaatatgaagtttatatttagctcagtattaagttattatgaatacttagataatttaattgacttttaaagtttttctcttattttactgtgtgttatggttcatcttcccacgtaattttttggtggagatgctcggaaggagagaagagtcagagttgtctgtctgaataacatatttgatgtttccccctcacttctggggccttcactgataattaatcttttctaaagctgttaaagtagttgcattctgctatggttttccttagaaacttcaggcagtatattatagaggtggcttagttttttcttttttggcagtaatcaaaaggcgaggcacagcatagcactaaacattcacctattacaaagcaaaccaaaaatggattgtataatggcattggagcagtattggttgtgtcaggatgacacagatgtctcttaatgccttagaaatgctaaaaaaaaaagtttaaattataattttgaagaagtgctaattttcaaaagtcaaaacttaagatgtgtacttatagaagtgagtttagatatgtaggtatatgcacacatatgttatgtggacttacataattaactcttggtgtctgtgtgctttatgtagacttaatacttttttaaactcaaaatatgaaaagcttttcttttcagattaaaagtaatgatgcttaatgtaatgaaatgagatgaaaaatttacaaagaaaatattaattacctttaatcccatcactcagataataattgtttcacatttttaaggtatattattccagattatcttctataattatgtgattaaatttaaaaaatagacaactgagattgttttataccttctgttctgtaatctgcatttttcacttaattgtggctgttcatcattctttttaatgtttgcatagtatttcatagtgtcactgtaacataattaaccaactagtcctatgctgttgggtatttaagatttttgcagcattttgctattatgaacattactgtagagaacattcctgcatatacatgttacatatttaacctatttttttcagaagaaattgaataaattcaattcataattgaatttctgaggcaaattacatgcatatttttggagttttgaatacttttaaccaaatggacttccagattggttttactaatttaaaattctaccaactatgtatatttttgatatttccatttcattaaaccaatgcttccttatcttttttgtgttttggtacttgtcaaaatttacaaatatttgtatagcttgactctaaattcatgcttttaaccattgttgctatactccaacaaagcatgatataggtgacagctccatgattgccatgtagaggaagggagaaagagcagtggcttaatcgaaacgatgctcccaagtttcttgtcttgagtcttcttttgcaataataagtgctttgctttatttagttgtatattttgggagtgtctattagagaggctgatggaagttattggggtggttaaaaattcctccaagcccctcttgcatgatacttgtaagagggatatggaatagaggaaagggtgatggtgggctgggagtacaagtctttaatggaggaattaccagttttggggatggatatatgttctttccttatctgcttcctattggttcgtgtccactaattttgaaggttaaaacacttactggtagtgaatatttttatcagtacagcctatgcagaatattgtaaaaggagaattttcccagataatgttgaataattgaatggtaaggtactcttccactatttctgagttattttattttggagaatattctaacaacacttggggttaaaacactggtgttatatttgtgcagaaatgcaatcatacactgtatcaggcccaagcaaaaacatcaggctatctttcagaaccttaaattttggctttcttttgagatatgtctatctcctagctggcttttcttcacaaataattcacttttattcacagtaaagatttattgtgctttgtaactatcttgctgtttacattttatcatttatcctgttttcatgcagcattcactttgttgtttttaaaaatgaaacaaatattttgaataatccatcactagtttaaacttttcagtagcatcatggaactttatgtgatgtcctctatattttgcctgtgtgttatagtttgtgtttataaattatgactatcactgatctgcattttctagggtttacagaacagtttgcattaattgagttgtaacctcggatatgtctgtattttatatttcctgcacatatcacttggacctcttctccagtgtttttgtgcacatttttgctagggaaatgtaaaggaatctgagttaggcactacaatctggaattgtgatgaacttaaaaaaaatctaataaaaaaacacattcagtgagcactgagtgcttacagtgcatccagatttttgctagataaagagtgggggcttaaaaaatataacaagatgtagtctctaactttgagaattgtgctaaaaaatcaataagacacatgatctctgatctgtgtgtattacacaggtcaagtattccttatccgaaatgcttgggaccaaaagaatgtccagattttggattttttcagattttggtatatttacattatactgttgaatattagtatcgctaatccaaaaatctaaaatccaaaatgttcaatcgaggatttcctttcaaacatcatccaaaatgttccatcgagcatttcctttcaaacatcatccaaaatgttccatcgagcatttcctttcaaacatcatccaaaatgttccatcgagcatttccttttgaacatcatgttggcactcaaaagatttaggattttggagcactttggattttggatttttggattagggatgctcaaagtaacttcctaaaaaaacggtgattgcaaatattttagctattttgtagatctaaacacactgataacagctattctataggaaaatagagcccagtcctaggagttctgattattagtcactttcccagacctggcacattatttttgttatgtgggctgctgtctgcaaaagaggtattccaaactctatgttttaagtactctacacttggctccacttattttggggtaactgcaggttagattatatatgtcaaaattctgaaaacaaagttacatgtactaatacttttaggaaatgtctcagcctactgttttacttgacaggaaccctgtaggtctgtcccaaggttatctccctctgactgttaccatttttcacattgtcctgcgcttagagttaagagaagatgaatgtcattacagctgagattcctcccttgagatgagtattttccatttatacccagaaaggtaagtacataaggaagaactagtgacagtgagttagaatcttttaccaaagggctgtctttttccgtggaagtgtgctacatgaacattataaattctaatctgggccccagaattgacccacgtctcactttctgttttcactatagaagaatttgggtcaggggagaataaaaatctatatggcttgtgtaattttgactaatcaaaatgttagctatagtggtaaacacactgcattaattgaatgaagagccctggcttttcagacctcttagtaatttattgagtatggccttggctaagttacttctctctaacttctgaattcctcatataaaatgaagggtttgtaccctagattatactcaagcttccatgatatatgaagtatttctgaaggatctattttgtcctaattttttgttaaaattcaatgaatagcagtcaattataaatagtagtacagatttttaatagatcttcataagtttgaaacatttgtatacatactattaaaaattattttgacaactttatagtgtagatgatggcaggagaagatgctctgccacttattttacacacggtctctagatatgaaactccttcaataaattaaaatttccaataatctgtagcagatccagggaaagatatctgacatatacttgataacccaatgttaagtgaaataaagtgaaagtaaacattaacctagccatactacgttttaagtacttgatactcttaggaaatgatttttgaactttgcactcaatttctgctgtagtttgctgcctgtgctgacattgctgttttgctgaagaaagactctattcagagtgcttatatttgtctttaactacatgtttcaacctacaagagtgaaacaaatccgcatatgtgtttctatattgtcatggaatttttagtcctcgaagataattttgtactaatagaagcttatagtacagtcatatacactgaagagtcaaaactaaggaaaattgtactgcacataatctgcctcattttaagatccattgaggtactttgagaaatttcctccaattttcacttttgaaggaacatatcttaatgtttgccctaaaatttcatgtagcagttccactactctgctcaggatgtggctgtagaggtcctcaaatgtgcactgcttttctactttatacagtgttatgaacacctgcagttttatgaatgaatagactaaccattgataataatgagtctctgtcctcatccgaaagcagccaagcattgagcactgcccttcatcagtggctatcagacactggtttatatttgcacagatgcttgctacaacaaaagataagttactgtgaaagaatagctcatcatatcaatttctgcttctttgctacagcccattatttacaaaatttttcaatttctctgttttttaacctgacaaccattccatcttctattgtctcttctttaattgagggtttattttgtgttaggcatcatatccagtgatacacttacattatttcacttaatcctcacagcagtccccaaaagtaaataggtaaatgttagttttattatatagatgagaaactgagggctaatgaagttaagtaaactgtccaagctcacatagctgttaaggggtaaagttttgaacccaggcctgtcagttcatgaggaattgtcatagcggtaaaccacattttaagattacttatcacattttccctacctagtatgcttttcttctctgtactggcttttttcttcctaccacttataaataatatcatattgagctttggctgtaatcacatagtagtgctttactctaaatacatttctgctttgttttcaaatagattctcagttctagaggaagggaattgtgtttcttattaattttgtctgtgacatatagtaattgcctaatgaatacttgactgattgagttattagcaagcttacttttaggtctgttctttctctattgtttggatatttgaacgtctttgctgttaagacttctgactcttactgatattactttttcttgtctggcaaacataaggtttgaggaaagagcgggacaacccagacacccaaggaataagaaagggttagttttgatatctaactagtaaaattacatgatttctacctattgtggctttttttgagaaatacttttcatgaatcttttctttgcattttttttctaagcatgtcatacaaatctttttttctttcctgtttatatttggttgtgccattctatataaggaaagctcattatatagcctaacctatttgaaagtttttatcggttctgattctcaggagaaaacttggggtgataaaacactgctaaactataattaaatagttatgaaagaattttttttttttacctttccgaggaaaatctcagtttttagaaacatgaaattttcagttcactaaactcacattggtttacctgatcaaattgaaaccttttgaggttcacagtttttcttgatggcaattttaccttctgcttatttttacattggatcttgctctacctgttgtatcacttttcctataatctagttctagaattactttattgcatgaaagaaacatctgttttataaaatctatggtagacaacagttcagaggctttaggacccagtaaaaatgtgctgtgttaatcatctagcagaacacgctggtgcccatggttgaatgcaatttggaaatgtggctaatatgtactgttttttgatatctagtactacttatgtaaattggcagtataaatatatgttttagaaaataaactaaatgaaatagggattcagctcacagcgggaaaaccaatttagaggcttcatgctaattctgaaagaagtagcatatgctgcttaacgacttggatatttaaaagaaaataaaaatttagacttggtgcagtggctcacgcctataggcccagcactttgggaagccaatgcgagtgggtcacttagtttgagaccagcctggtcaacaaggcaaaacctcgtctctaccaaaaaatacaaaaattagccccgcttggtggcgcatgcctgtggtcccagctactcaggaggctgagataggaggatcacttgaacctggaaagcagaagttgtagtgagctgagatcgcaccattgcatgacagcctgggtgacagagtgagactgtctcaaaaaaaaaaaaaaaaaaatgtaaattgctccatttttaggattgttcatatcaatcagatgcactgtgtactgatattttttaaagcttactaacctacaatttagcttgatttaatttctattactggaagtttaaacaaaatatcattgtagcaaagtcagtggtttagcacacctgtaaatatgatgccttggcaattcttcttgctagtttcaaaaatcagctgacataaatcagtgtgtacttggaaaagaaaaaataatatgacagttaaaattcctgttcatactgtcagttttttaaaaatttgctatttaatgataatataatttcttaaaatttctagttatacttctctatctttaagtaaaatattaattaaagtgttcatgtacaaaatttctgtttcctacttatacctgccaggtactcatttttttatcttttaataagatgtttttggatttgatttaatttgatgctttagttattttttaatattttatatttttatattatgctcatctaaatacttcatctcttgtgcatgtactcagtttctctcaaacacatacttgctctatatcttaaaaagccaagtttaaaatttatctatgtggtaaatataattcttcagattccaaggttttctgagattaatctttgtgtacatacatctgctttagttacaggaaactgaataatggaattgttctttaaaggcctctgttactggatttgggctttcctctttagcttaatgttgaaagttctagcatttaacccctcctcttcatcatgaatgagtttccataactcctggagtatgtatagcttcgtaatccagctagttagcctatattctcagacatgccgtatgtatttctacctctaagttttttgctattatagatctcccttggatgttttcctctatttcttgttgaccattcaatttttttttttttttcgtagctcctaacccttcaggaactatccaaatttcatctttcctttaaagctgacccgaagttttatcccttttattccttaacagactattctttcagtagggacacctgacactattttgttgcctctttccctcacacacacaattctgcatttaaagagaatgtgtattgttgaaaggatttaaatgatttccagctagggtgtgtaaggaagagctgtattgataaatgtacactttgattcatagatatagcaggggaaatgcattatatgatacctttaataaagccatgactagtggctgtgtagatgtctttgaagatatttaagtagctctaatgtaatgctatgttgttaccaacatgttggcattttgactcttttttttacaaggatatttattatgttttacttatgccaaaactgacgtatagttctagaggttagtagtctatatagtctagaggttagtagcctatatagtcagtcattctgtatagtacactatagtctatatagtctgtatagactaaaatatagtctatattttaggagtgtggcaagtccaatagcactctcacaaattctatgcttgaattttgggacttatttttttcttagtaattgatttactgcacagaggattaatattttaaaatgtataatgagtgatagcagtgtgtttagaatgcaaggatatctaaaaatgtaaaggaactacagaaaaattgcaaaatagtgtagagctctaaataccctttttcaaacttctgctaatgttaacatcttataaatacagtacacaacaattggcatagtgctactggtaattttcttttttcttttttttttttttgagacggagtctcactctgtcgcctaggctatagtgcagtgctgtgatcttggctcactgcaacctccacttcccgggttcaagcgattctcctgcctcagcctcctgagtagctgggattacaggcatgtgccaccactcctggataatttttttttgtgtgtgtatttttagtagaggcggggtttcaccatattggccaggctagtctcgaactcctgaccttgtgatccacccaccctggcctcccaaagttctgggattataggcatgagccactgcgcctggcttagtacaatattattgactaaactactgaccttatctgactattactagattttctactagtgtgctttttctggttcaagatcacatttaatgtctacaatacatttagttttcacgtctctgtagcctctcccaacttgtgctgattcttcagccattccttgttccatgaccttgacactttgagagattactgatcaggtattttggagcatgttcctcagtttgggtttgtctgatgttttttcatgagagagtgagtttatgcattcttggaaagaatatcacaggtgtgattttttatttttcatagtgtaacaggaggtatatgatgtcaatatgtgttattactggtgctgttaactttgacatgtggttaagatagcgtctcccagttttctccaatggagagttaccatgcttccctttgtaattagtaagtatcttgtgggaaatattttgagactatgcaaatatcctgtttcttattaaacttttgccaatgaattttttattctccattgacataattatacctcttaaaattatttttagtagttatcctaggtttcacaatataatcagacagattctacagttaggtaataatactgcttcatttaacagccctatacggcattgtatttccaattcttctcgcacttttttggtattatttttgtcatgcaatttacttttgcatatgccaggaacataatattttgctactgtttttacttctggtagtcagttatctgtttgagcaattaaatgtggggggaaagttaatttaattatcatttgttttatttccattgttttttttaaattattttttggtataagtttaagtttttgtctggcatattctttctgggtgaactactttagcatttcttgtagagtacatttgttggcaataaattctcagttttttgtttggggaagtttttatttcttcatttttgaaagatgctttcactggatatggaattctgtgttgacagccttttttaagatgtttctttgtgtttgtttttcatagtttgaatatgatatgcctagaggggtgtgtgtgtgtgtgtgtatatgtgtgcatttgtttgtgtgtttctaaagccttacagccttgggtgctgttggtgctcttggatctgtgattttgaaatatttttcttttttattgaggagaaatttatataatatacagttaaccattttaaaacatacaattcagggatatttagtgtattcacaatgttgtgagcccaccagctccctctagttggttttgaaaattcatgattaattttttcttttctttctctctcctctttctaagattctgactatgcatatattaaatagtttgttttttgttctacagcttttgtttgttcttttcagtgtgtttcagtttgagtaatttctgtagctctagtaatttctatagatctatcttcaatttcacttattctttccttgactgtgtcagttctactgatgagactgttgtggacattcttcatctctgttactgttttttttttttttttaatttcaggcatagtttatctttttttgctgtaattacccatctggcttaggtattgtctgtttttctatttgagcctttagcatattaatcatagtcatctaaaatttcctgttctaacatctgtgtcctatctcagtctgtttttttttaatttctaaaatcacgtttattatcaaagccaaaattgcccatataattaatacattagtcttcaatttttatttctgcatgattatgcagtctgaatgactaactcacaatcccaggtggtattacaagttttgctcttcagaatggtgttactgttgtaaggggaaaagtcctcactgacaaagaaatgaaaacaaaatcaagaatgatccgcttgtatcacagattacagagaagctgtcagtgagcagttcctcacctcttgcagcaaaggggatcaagggctaaaaatatctcagaaaaatcaaacagcacctgcaatacactcttatatataaaaggccaagcttgtaaactatttcttctcatccatgctgctcaaatatgaagggattaaatataaggctaattcctggtgaatcttctcacttcttcctcttctttgtgtaatataattttcctttaagtgggattgggacaatcccttcacattcttttagttcctgggtcagagggtgtttgacaatattcggtctaatcacatctacgtttggagaagtgctccatcatgctttcaacagttgtggttggtgcataaaaattcaccaggaaatacccgcctctgttgtgccactgattgtgggtggagatcttacaaggaagcgctcactcacccaggttttccaagttcctcactattgctcctttttccatcagaacctctatcgtatgtttcaaagcagcagcagtctggccgcggcatggctttcaggattaaagccagcttatagcggggcatgcctggaggctcgatgcgtgcggctcggaagcgagctggttcccaggacgcgaaggggcgggatggcagggatggcggggacctggaggtggccgggcctgacgtctcctgggcggcaaaagcatgcttcagctgcatgagcctgggccccctcatgcatgagtctgtttctgatgacagcttgtcacttgcaaatgtactttttcttttcttttttttttttgtatgcattgtaatttttattgaaagctgtacatcgtatgtagcatagtatagacaaaggcaaatagattttatgcctggaaacgagtctccctttctttcctttttcgtttcttttcctttctcacttttgttcttgttgcccaggctggaatgcagtagtggcacaatcttggctcactgcaacctccatctcctgggttcaagtgattctcctacctcagcctcctgagtagctgggattacaggcgtgccccaccacgcccagctaattttttgtatttttagtagagacggggtttcctcatgttggccaggttgttctcgaactcctgacctcaggtgatccacccgtcttgacctcccaaagtgcagggattacaggcatgagccaccacgcctggccacgagtcttcctttatttatgctaagagtttgagtataattttgagttaggtttcgtttgaggtttatttctcccaggaaatttctcccaagaaattgtcccaaggaagggcaaacttagaagggattcacatattgttgaagatgtagttcagcctactgaatagaaaagatgcttactggtttggctacaccaggctagggctggttcgtagtcactggacaagcagttagcatcttctgtgcaggtgggggagcaaatcagcaagcagaagagtgggtacacagtgggcttgcaaagagtgtggggtccctctgtgcatggacagactgtacatggtggtgggcaatttgcaggagcagcagcctggtgcgaaccctctaaccacaggcaggctgtgtacaaggttttacagaggaagtcagagtcctagtgggtggacaggaggcctttgaacactcgtttgcatgttgagaaggccatggaaaggttattggtaggctaagactgcaaggttgcagagagagagtgttctggacccatggctgagaatactgggtatccttacgctcatattgctggttcccaagttgcagccagaaactgcaggcgtacatcttccttctgcagtgtccttccagtgccttttacagagaaaggttaatatcatgcttactttaaaggagagagatatctaaagagatttttcttttttttcttaaatcacagaacataattgaaggatgcttttggatctgagagtcaataaattgataactgagacagatggagatattggatgacagatagtaagcagtcagtgttgacttaagttagctggaagtcccaccacattttacatttctgtaccttttattttattaaacctttatttttcttttattgaacctttatttggaatcgctgttccttggtacttaaaatcttttcttccacacagcctttcaaacatttatcttgctcagggcaccctctgctataatcttgaccataactttatgattaccaatcactgacagcccctttataatcttattttcaggtacctctcttttctcacaccatctcatacccataacgtgacttggaaaatacttgaagcacagtagcatctctaatttattgatactgctaccttcacattatcttccagattctttgtattcatttttcccgaatcagtttcttggctccatcattatgttgacactgctgtgggatgaaaactcgaagcccaggtcttcagactctagattcagattccggtatactagatatgacaaacagttttaacacttaagccaattctgttcagttatattttgctgtgcgcaaaggccattgatagtgtctgcctcaagcaatatattaagtttatggaattatgtacaggtttagcaagaaaaagtgaatatctaagtatctgccacgtacacatatttctccctgtagccatgtttgtttcaaagcatcttaaaaatcagttgtgattgacagcctgtagaatgggagaaaatatctgcaaactattcacctgacgggattaaaaaccaggctatataaggaattcaactcaactgcagaaaaacaaatactatgatttaaaaaatgggcaaatgatctgaatagacatttctcaaaagatgacatacagatggtcaacaggtacatgaaaaaatgctaagcatcactaatcatcagggaaatgctaaccaaaaccataatgagatatcatctcaccctggttaaagtggctactataaaaaagacagaaaatgacaaatgctggtggatgcagagaaaggggaacacttgaaccctgttggtgggaatgtaaattagtacagccattatggaaaacagtatggaggttcctcaaaaaattaaaagagctgccatatacccagcaattctcacagctgggtatatattcaaaatatgggaaatcagtattttgaagtgatatctgcacccctatgcttattgcagtactgttcacagtagccaagatatggaatcaacctaagtgttcatcaaaggatgaatgaattaaagaaaatgcaatacacacacacacacaatggaatatcattcagccataaaaagaatgaaatcctattatttacagcaacatgggtagaacgggaggacattatgttaaataaaacatcaggcacagaaagacaaatattgtatgttcttatatgtgagagcttaaaaaggttgatctcattgaggtagtgaacagaatggtggtaaccagaggctggaagggtggtagggagcgggggatgaagagaggttggtttatgtgtacaaaagtagatagaaggaataagttctgatgttctgtagcacaatagactgactatgattaacaataatttattgtatatttttaaatagctagatttggagtgtccccaacacaaataaatgataaatgtttgaggtgatggttatcccaattacccagattttatcattgtacattgtatgcttgtatcaaaatatcccatgtactccataaatatatacggctattatatatccataaaatgaagaaaaagaattaggtcggaaaccataggcaaaccctcttatcacatatgtgacacacggccctcaatattaaaaaaatatcagttgtgatcactagtagaatgttgaagtagcaaatttaggttttggttttagacaaaggtaattggcattcgataacatctctatttccatcacctgctgtgatattttataaagctagtaaataattccaaaatgaatttatctcattctcttattatgaatgaattcaaatattatgttgagtcccttactgtgtgctagcactgttttaggcacaggggatgtggcagtgaacaagacaaagaaaatccacagtcttattggattttatatttttgagtagatgggagtcagataatctgcagaagtaaatttataaatatacagtgtaattttataatatgataaatgccacgaagaaaaccaaatagaataatagaatagcatgactaaagatatagagggggttattttatattgtagagtcaggtagggttattttatggggtagcattttagctgaaatgtgagaacgaggagccagccaggtgaaaacagaaggaaaagcaaacacaaaggccctgaggtgagagcaaatgtgttggaaaaagagatagaaatctaatgtggctagaatatagtgagcaaaggagtgtgcttagaggagaagaccaagcagaggtaggggtctggttttataggactttgtagacaagaattttgtgtgtggcaagaatattttagtttgataattcataatccaaaaatgattttttcagtaatgcatgtagtattaaaatatatgcttaagaatgatctaaaattatactggtttggattacaaaatggttttctcttaatatagacctcaaatggcaagctaaaagctaattattgtttcaaggaaataattacccagacccttgactctttttcttggtatctacctacctcccttacaccatttgggctgcatcaacctaggaactcaaaatctagagtttttacatgagaatgaaagtattggttttagttagtcaacatgaaagggtcagtactcctagttagtgaggatccaacactcctgcttagggtaatgactcttaatatacttacagtataacagagtcttaaagtttttgttcagtaaggagaaataaagttcagaattccaagtaagttagaaagtataatgaggcccttgcattcctggtcagtcaggaagtgtaacagagtccaaaactcttagtttggaaatgtaatgatccagcattcttagtcaggaagtataacagtccagcacttaggcagctattgcttagcaactggtatgaaggtttatggaaaggaaacaaactgatggttaaagtgaagttttggaatcattaatttattcaggccatgcttttaattgatctccttaaaattttatgccccatatgtgggtttttctttttaccttaataacttaaaaaaaattttactatctggctttttattttttacaattatcttcatttcttgccatgttaacagattggctacttcaaaatgttgtttttcagataacttcatatctttcttttctttgctagtcaaaggcctaggcctttatcttcctttttgctacaaccctaaaggcaaagaaagaaagggaaaaaaaagcttggtttatcctgtatttcttctgagtttactaatattaattattttttcaatgtattttgttttaatgcatgaatatacatggatattattgaaaaatttaaaactatatggaaacacaaaggagaaagtcaccatcttacactacaacttttggcactttggtatgtttccttctagtcttttttttcttcctgggatctatatataagcatgtgtacatacataccaatttttcttaaactcttttgggtcacaaatatcttaaaaattttgaagcctatagatgagagaaaatacgtaaatgttgaagacaaaattttatatatatgtgtcaagggcatttaggaatcagtcatcagcaaggatctttttcattcgttatcatgtgctgttgttgaaacttcttttaaatctttttcttactgctgtagtggagccattgctgcgccacatctttggccatagtagtgctatagttgggatgtaagattactgttaccactcttacagtttgtgttcactattaactatttttatcaaataatagcattcatgtgtgaagtggctgggtcctgatggacttccagactcagtagtatgtggcatcagtaccagtcttaacttcagtaacccatatgatcatttttttcttgaccgagtggtatttcattataggatataatttatttaattaatcatctattaatataaatttaggctctgtaatttttctttaccataagtaaaacaatgatgtaataaatacccttatatttacttgtctgacaattttcttgggataaattcctaaaagtgaaattgcttagtcaaatttgatatcaattgcctgattgggcctgagaagtataccaatttatagataacagtgtggtctttgctaacactaggcattatggaatacttttattagttatagtgtttataaagtgaaatacataaatctaaagtatatagttagatgtattttgacagttctatatgtctgtgtatttaatacctttagcagtgtatagaacatttccattgtcacagaaagattccttataaatcttcctgtgttcttattggccatctatttttttcctttggtgaagtatctattaaaatcttttgtgcattatatttggattttcttcttattattgagttatagaagttctttatatattgtgggtactagtcttttgtcacgtatttgtagaataaacacatttttggtatgtggccggccatttcattttcttagtggggtcttttgacagtcaaaggttttaacttgaataaaattcaatttatgaattattttattgtttatgctttcgtatcctctgtgggaaatcctttccttaaccaaggccataaagattttttcctatgttttcttctagaaattttacagtttttagcttttatgttaaggtatatgatacattttgaggtaatttttgtgtatggtgtgagtgtaggtttgaagtttttttattttatttttttctgccaaatggatactcacttgttttagcaccagttttgaaaagcttattccttccttattaaattgccttgtcccttattgaacatcagttagatttacagagatattatgctatggctttgaggaatgggtttgttcatagtattgaagtataagcagtcaggatctaggctttgtatgtttggaagttgattaaatttgaaaagccttagctttttgaaattctttttcttttattcttgttcaagtatcttgggatggctgtagtagaatgtgatttgtaatgtatttgttttcagtgtggcatgtccagatatttttctttcttctttttcaattactagtttttgtccaactgttttctggtattgaagattaaacaggttcgttagccatcttgatacaagtattataaggacctgacaggtcataagtctccttgtgtagaacacctcactcttgcttcctgtgaaagcataaaatgttagaattagcaaaatctgatcaacagtatttaggccctttctttattgcttttacttactgacatctttttctcttgtcaggctattattagtgatcatggccttatgaaattctggttgaataaagcacctggagaaatagtaatttataaatatgaaatgcgactaaagtctattaataccagacttctttgcatatcaaacaaatattgtgaatttttagcgggagtatgtgaacttggagtgtgtgaccatttgcttggtgttggggtcattgtaaactaatgcaaccaaatgcatctcataagtaggcagtagcttgatttttttcttgtttgtaaaaataatagtagaaatgaaatgaactccttttttttcctgcttttcttgcacagttgccaacaaaatatgcagtcattaagcaagcagcagggtaataaatataataaacatatatttatttttatgaagaaaacttctctgcttcttgcagtagaattctttgtgctctgatcacatcaaaaaaagcagtacctgaggtcataggtgtgcctggtagcacagttaagttggatattttcccccttgtgtttttgtcacaaacattgatcttaggggtttataatttggtagtgaatactggaaacatatattcagcttccagtgttagtgtataaagaacaccatctgatggattggccagagttgaatttgaatctgatttggatacttttattgttacaattttgaaagagttattactaaatctgatagtaatagtgatgtgttctttatagttatcacatttaaggagttttcaaaataaaatcctctgcatgttatttctctgagagaaaattacattatttagaatgtttatatttgcaaaacccagtaacatctgtgggagcagctggttgtcacagatattttctatagaaattgcagaataatgtgtatttataatttataatttaatttttataattatataaaatatatatatttttaatttataattctacatgtaaaattatgttaatgtaaaattatatatataacaaaacatagcttatatttatatataattatatatttgtaatttacaattttacattaacatgtaaaattatatttacattaacatgtaaaattaaaagtaatgtaaaattttatattaacatgtaaaattataagttaatgtaatatatgttaatactatagtttacatgagtttcataggataaaattttttgttaaacaattcagagctttgaaaatatcagttgatgaatatcctcaagtatagattcttcattttattttattttttaaagaaacatccaccatctgatggtatctgcaggctttaccccagatggttcagcccataaaaccatcctgttgtgatataccaaaatatgtttaaaaagctgtgcatgcctttatgatttgatttttttttaagggatgatagaggtgctttatgtttttaagggacacattgtataaaggagcatccagccaggcgcggtggctcacgcctgtaatcccagcactttgggaggccgaggcgggccgatcacaaggtcaggagatggagaccatcctggctaacacggtgaaaccccgtctctgctaaaaatacaaaaaattagctgggcatggtgtcacacgcctgtagtcccagctgctcaggaggctgaggcaggagaatcacttgaactcaggaggcagaggttgcagtgagctgaggtcacgccactgcactccagcctgggtgacagagtgagactctgtctcaaaaaaaaaaaaaaggagcttcccctttcccaaccctatcttttactattttcataaagttgaggtctgaatttactttccagattgggtatgtatttggtacaaactttataggtcaatgttagatctagtaattatccttcaattgttgtctttgagtttatacaatagaagttacttgactagcgttttactctttttgtagaaaacatataatccatattcaaatcaacatttaaaaatatttgtaaagaaagaaatcccttatgtagtattcttgccaaaaatatttaactgaatctaatcatgaggaagcaaccaggcacgtcgaaattggaggttattctataaaatagtttaaaattgttagtggcatgtaaagcaaacaaaaaggtggggaagttgttccagattcaagaagaccaagagaaaagacaactaaatacaacaatgcgtgatccccaagtagatctagatccaaaacaagaacaagaaacataacatatggccgggcacggtggctcacgcctgtaatcccagcactttgggaggccaagatgggcagatcacgaggtcaggagatcaagaccatcctggctaacacagtgaaacccatctttactaaaaatacaaaaaattagctgggcatggtggcgggtgcctgtagtcccagctactcgggaggctgaggcaggagaatggcgtgaacctgggatgcagagcttgcagtgagccgagatcacaccactgcactccagcctgggcgacagagcaagactccatctcaaaaaaaaaaaaaaaaaaaaaaaagaaacataacatacacttgtaagagacaattggaagagttggaagaattcaaatatgtactattttgtagttgcaatatagagtcaatattaatttttttgactttgataatgatattgtggttataaagagaatatccttattcttaagattaaatgctgggacagagtgtcataatgcttgcaatttactttcttttaaaattgttttatttttaattgacacataataattgtgtatgtttataaggttgcaatttaccttcaaatgtgaaagaaatggtatatgtatttggccagaaaggatgaaagtaaacttgtcagagtattaacaattattgaatccatgtgaaaggtacattgatgttcattgtacttttctttcaagttttctctagatggaaatttttttaaaaagctggggacaaaatctccacaaagaataaactgtaatattaggacagtgcaacttactattttggtccaatttttgtccctaacattaccatttgtaagagattattgaatatatgttcaatacttatttattattttgtttcctacagtttaataatgctactccatgattttagaatgttttacagtttacaaaacatggctgggcatggtgactcatgctattatacccagcactttgggaggctgaggtgggaggattgcctgagcccaggagttcaaagttaaagtgagctatgatcacatcactgcactccagcctggacaacagaatgagaccctgtctaaaaaaaaaaaaaaaaaaacagaaacaaaaaacaaaaacacacacacacaaaatccccaaaaaactacatacagagagagtatttatgtacatcctatttctgttttgtgaaatagatgagataggtggtattttcctcactttacaaatgaacagtgtgttttagagaaatattcccaagatcatagccagctacttttgtgcccagacttccctcctaagccttgcagtcttccctgtatcaaccttgatgtcccacagattattttaaatgcagtgtaccacaaaattgttccttttttcctctttagattattccttggtaatggtgccttgatctacccaaatagaccagtcgcatatctggaagccatcctacaattactatactcttacctaattggctctagggggagaagaaatggggaagagaagtaatgtttttcaagtacatatttaatatctggttctatgtgttcgatgattttcatgaatcttattaaattctttcagcagctaccgtgtttagatggtgtctccaattttacagtttcataatagagatttggaaataggcttaacaaggttaagtgatttttttttttttttttttttttttgagatggagtcttgctttgtcatccaggctggagtgcagtggcgcaatgtcggctcactgcaacccccgcctcctgggttcaagcgattctcctgcctcagcctcctgttaaatgatttgttctaagttgcaaagctcatagacagtgactaggggatttgaatttaggtcttaaactttctaaagtctgcattctttacaatgtacataagcaaatttctcttaaatctttctcttaactttttataacactaccattgcttaagtctcagtttggattactggaagagcctacctactcagtttttcagtattcaaccttatttcctttagttaagcttctgtgctgttgacagagtgatctttctaaaatcccactctggtcgtagtgcttctcttcattgatagaatgaaaatggcaaataaagcacttcatataatccagttcttgccttcttttctcatcttcacatacttcctcacatctgtgctactcttcagccacactgaaaaatggaattaaagctttagtctgtcataactgcttgcccttattattgttactaccctagtctttctttctttgctgtgttatctgttgcattcattattcaagactccaaagagtaagttcctataggaagtctttataatgccttcactggctgtattaggtattttttctttgccgtgtgcatacatctgttatagaactacattataactatttgttttcatgccttttgctgtaatactgtgaattccttgaaagtcacacctcacagattttcagtgttcagtaaatgtttattactgaatggagattagtgaacctccttctaatccccacactatgaatatacttttccttagggaggctaacatatatcagtttttccatagaggttgttgtgacttttatatttatttgctttgttcatcctgagtattggaatagtaattaggggacctgatttctagttttggctctgccacttatttgccatactttcttaggcaagttactgtaatttggccttggtctcttggcctcaattatctcatccatttaatagcaggttgaattaagtgtttcctgacctcttacctgtctttcccaatgactctgattttcttgggaagggttttgagcagagagatgacatgttggtagtggtcttacgagtttcactttgacagaatgtgtaggatgtgttggaagggtgtattagtccattcttgcattgctataaagaactaactgagatggggtaatttataaagaaacgaaatttaattggcttacagttctgcaggccgtacaggaaacatggctggggaggcctcaggaaacttacagtcatggtggaaggaaaacaaaggggaagcaggcacgtcctacatggctggcgccaggaggaagagggcgaagcgggggtgctacacccttttaaacaaccagatctcctgagaactcactatcatgagaacagcaagggggaaatccgcccgatgatccagtcgcctgccaccaggcccttcctctaacattgtggattacaatttgacatgagatttgggcaaggacataaatccaaaccatatcaaaggggataaaccagatgaatgcagagagaccagttaagagagtaatgtggtttcatgagcgcctggaatgtgatcaatatttggaaaaggagaaataattgtgaaagaaactttacaatttgagatggtaagggcagatgtggtatcacagaaagatatctggtctttgtccctgagttttggcacagaggtcttaaaacccttggaatttcctgagccataagggtaataaaagtgtcttttgttctaatgagtctactcttggtgggcctctagatagcttcaggatgggggctagttgccaggaagaacaagccttgattagaagcttggaactttcagcatgacctccccaacctctggggagaggacaggggatagagattaagttgatcaccagtggctaatgataatcaattgtgcctatgtaatgaaacctccataaaacccctaaacaacaggatttggagagcttccagattggtgaatgcagtgaggtgctgagatgttggcatacctggagagtgcatagaagcactgtctcccacacacccgcccccacacaccttaccaccctgtgtatcttttccatttggctgttcctgagttcttttttttttttataataagcctgtaatggtaaggaaaaagcattttcctgagttctgtgagtactagccaaatatcagacctcaggagggggttgtggagacttcaaatttgtagccaagatggactgcattgtgggtaaccaggggacctaatacttgcaattggcatttgaagtgagggcaatcttgtggacttttaaacctacggagtctgacactaactctgggtagttagtgtcagaatagaattgaattgttggagacccagttggtgttcagaggattggagaattttaaagttgatgtcagaattggttggtgtaagggggaaaaaaaggccataacagcatggtagagtgattgtcttctctgcagatcctgtcttcgctgcaaaaaaggactccaagatttgaagcctatgttgacttaaacagagaattaggtattctattttgagagaaataaatagcttaatttttttttatttctgccttagcttcaaaagaggatgcaaagaaatggaactttataactagagacatagttattttcagatttacacagaaaatgttattttcccacatggggaaacagctccctaaaacacacagaaagaggattatcagtcagaaacagcataaagacagggaaaagaggtggagaaccttcagtaaaaacaaataactatccttacttgctcatcattttccaaggttgtaaagttttggttttgaggattttcttcacttggacttaacactgtgaggaaggtggtcttcttaatattattgaaattgcacactttaaatttagtgtttgtcaaactctcatatatgttaaacagggagctttagaaaacatctttactgtactctgagggtgctattggcacttactagcccaggcaatcaagagagctagaaatctttctttatcaaagttgatactaagtctgggaagtgctgagtgaccaatttgttcctgttgctactgctggattctgtgccagtactggacagtggtaacaactgttgaggctgctggtgctaatgtcttttctgctagtagtcctctaaatcagcagtccccaacctttttagcacctgggactggttttatagacaacagtttttctgcggactggagtagaggatggttttgggatgattcaagctcattacatttattctccactttatttctgttattgcattgtaatgtataatgaaataattatacaactcaccatgatgtagaatcagtgggaaccctgaacttattttcctgcaactagatggtcccatctgggggtgataggagacagtgacagatcatcaggcattagattctcataaggagcacacagcctagatccctcgcatgcacagttcataatagggttcatgctcttgtgaaactctattgctcctgctcatctgacgagaggcggagctcaggtggtaatatgagtgatggggagtggctcacattaccacccttcacagggccttctctgtgtctcagtcctttttttttttttttttttgtctctgataaggatactcttatgggttctaggatctaccataatccaacattatgtaatcccaatccttactttaattccatctgcaaagatcctgtttccaagtaaggctcacatttttagaaaaagacatgaattttttagacacactattcaacccactataggaagctactagcaattagataaaactcttattagtaggggtcttgttttctcttgatcatattcattcatttgctcaacagacatttaaagaaacccaacactgtacaaggggacggtgtagagaaagacggcagatatattctttgctcttaaggagctcccagtgtcactggaaggcagatgtagacaccagtatctgcagtacaatatgacaggctgggcatggtgctgtaggaatacagaagacagattctatatttgttctggaggggcctaaagttgcacatttaaatcttgaggaaagacagggaatttgctgaaaaagctaatatcaagtgtaaagacactgggtcaaaagagagtagcttaggaagtcataggttcttaagtgctgctggatcacggagtgcacttaaagagtgcattaaagatctattactgtgtaaatagtgatttaaattctcagctaattatttgttaattaggaactttaaaaaaaaaatccctgctttgtctactgactcaattcacctttagcatatgttgaatttttctatatactatggtttctttggggctattcctttgttgtttttgtgatttttaaaaatctgtttttgaactagattcaaatggttttccttaatgtagctttataatgtttacttacaaatgatgggtcaagtatattttcattatactcttttacaaaaatgttttggtggttttcaagtttttttcttccaaatgggtttaggttacaaaaaagattctgttgatattacttctagaatttctttattcttataagttcatttgggatcagttggcatcatttcagtagtctttgcagtctggaataacttctcatttttttcaacattcctttttatgttcttcagtaaagttttaaatgtgtttattttttattttaaaatgagatgggaagccattggagttggtaaaaaaaaaaaaaaaattgagcactggaggaagccacagtatacactggctaatctatttgataaactaataacaaattctattcagattacaaaatataggttggtaaaacttggaaatgtttatagaagatgtattagttgctgagatggtcagtctgtattgatctaatggtcaatttgaattaactctaataactatcatagaaagtttataagaacaacctttttcccaatgtctctgtatcttaaatgataccctgtggtgctgggcgcaatggctcacgcctgtaatcccagcactttgggaggctgaggtgggcagatcacttgaggtcaggagtttgagaccagcctggccaacatggtgaaactccatctctaccaaaaattagttggacatggtggcacgtgcctgtagtcccagctacactggaggctgaggcagcagaatcgcttgaatccaggaggtggaggttgcagtgagccaagatcatgccactgcactccaccttgggcaacacagcaagactctgtctcaaaaaaaccaaaaagacccaaaaaacaaaaacaaaaagaagcaagaatgataccttgggggtcatgaagagagagttagacatactgtgttaatctagatgtctctgatgtagatgcagttctcttccatcagcccacctgaacctaaaagggacatagcaagacaacaaggtttaggtggtacctgcatgccagattctaattaccaaaccattatttcttttgtaacctcacaatttctttcaaactagtagtgctttttgatttacaatgatatttttcttattcttctcacttgcaaaagcagtttggctcatgacgtttaaacaactggaatgctggctcttgatttgtcaataattggcaactcagttacaggatataatgtcagctgtccagatttagaagaaacaagtggaataggaaaaaagagaagggtgtgtaggtagtttcttgttttcctgatgtttccactaagtacagaaagctctgaaagagaaatggacttttgggaaggggtgttacctttgactgcctttaatcctgagttgcagtctcagcttcctactttggcacacatgcctgttttccttttgtggaatgtgttaaggaaggcagcagatggttgtcaacactgttgaggttagactctaatgagaggtcactttgttgggggtgaattgatttatagtttacagtacattctgtattcatagtaggtgatactgtgaaagcaaaactgtgagatctcattaaaaaagaaatggaaggataatgccttttttgtttattttaccccaccacacaacagacccttcaatttggcctggtaccatcatctgctttgattttaaaatacagctcctcacaggaatgcctctcccttacccacccctcaccacactatgattatatcacattactgctttcatgaaagtggttgtcagtacaacctatctcctactctctactggcagagtttgagagttccagttgctctacattcttgccactcactacctgtcagcctttttagcttttaatccattattttgagcttagaggcatttcattgtggttttaaattatacttcccagattattaatagccatttggggatgctgtcttgtgagtgcctattcaaatctttttcttttctgttgaactgtgtgtctttttcctgttgatttacaagagttttttatattttctggatagaagctttttgttgtgtgttgcagagatcatcatctattctgtggcttgtgtttttgcccttttaatgagtctttaataagcaagaataactaattttagtgtagttcagtttattctttcctttattgattttgttcttttggatcctgttttcaaagaaacctgtccaccttcagctcatgaagatgttttcctgcgtttcttttagaagcattgtttttaccttttatatttaatgtcgtaatttatcgaaagttaattttgtgttggtataagagagcctgaagtttgttttgtttttctcatggggtatccatttaaccatcatttattgaaaagacccttcttggccgggcgcggtggctcaggcctgtaatcccagcactttggaaggccaaggtgggcagatcacgaggtcaggagatcgaaaacatcctggttaacacagtgaaaccccgtctctactaaaaaatacaaaaaattagccggacgtggtggcgggcgcctgtagtcccaactgcttgggaggctgaggcaggagaatggcgtgaacccaggaggtggagcttgcagtgagccaagatcgtgccactgcactccagcctgggtgacagactgagactccgtctcaaaaaaagaaagaaaaaaaaaaaaaaagaaaagacccttttttccctacttctctgcagtgccatctttgtcataaatcaagtattcctacctgtatgggactgtttctgaattctctagtcttttatatttgtttatttgtctatacttgcttcattcagtactaccctgttttatttattaaaagtcttgataacctggtagtgtaggtctttgaactttttctttactaagatggtcttggatattcttgggtctttgtatcttcacatatatttacagtcaagttatcaatttcctcaaaaaatattccaggattgtaattgagatcatatcagatttgaagatgaatctgggaagaattaacatatttacagtataaagtcttcaaatctatgaacatagaatatccttccatttattgaacttgtctttgtttatctcttagtactcttttaggctctctgtcgtaattatgtacatttttcttttgatattggtttaggtatttttaagatattcgttagatatttttattcagatattttatttacgtatttaggtattctttaaataatctttaggtatgtttggtggaattcattagtgaagctgtgtctggaatttatttatttatttatttatttattttttagtatttattgatcattcttgggtgtttctcggagagggggatgtggcagggtcataggataatagtggagagaaggtcagcagataaacacgtgaacaaaggtctctggttttcctaggcagaggtccctgcggccttccgcagtgtttgtgaccctgggtacttgagattagggagtggtgatgactcttaaggagcatgctgccttcaagcatctgtttaacaaagcacatcttgcaccacccttaatccatttaaccctgagttgacacagcacatgtttcagagggcacggagttgggggtaaggttatagattaacagcctcccaaggcagaagaatttttcttagtacagaacaaaatggagtctcctatgtctacttctttctacacagacaaagtaacaatctgatctctctttcttttccccacatttcccccttttctttttgacaaaaccgccatcgtcatcatggcccattctcgatggttgctgtctctttggagctgttgggtacacctcccagatggggtggccgggcagaggcgctcctcacctcccagacggggtggctgggcagaggcgctcctcacctcccagacggggcggccgggcagaggcactcctcacatcccagacgatgggcggccgggcagaggcactcctcacctcccagacggggcggccgggcacaggcgctcctcacttcccagacggggcggctgggcagaggcgctcctcacttcccagacggtgtctggaatttttttgtgagaaggtttttaattaaagatttggtatctttagtagatataagactaaactgatttttctattttttcttatgtcttcacaggttgtattttgttaagagtttgtctatctaaattttcatatttattggcataaagttcataatattcttttatgatcttttaaatatctgtgggatttgtacagactttcctcttttatttctaatactgaacatgtggatccactgcctctttttcttgactatggccaagggtgtattaattttagtagtcttaataaagatccattttttttttttttttgagacggagtctcactctctcccaggtggctccagtgcagtggcacgatcttagctcactgcaatctctgcctcccaggtgcaagtgattctcctgccttggcctcctgagtagctgggatgacaggtgtgtgccactgtgcccagctaatttttgtattttagtagagacggggtttcaccatgttggctaagctggtcttgaactccagatctcaagtgatccacccgcttcagcctccaaaagtgctgggattacaggcatgagccactgtgcccagcttaaagatccagtttttactggattcttttttatggacttttgagaatatttgtggctttctccacacaagaaagagtatttgtttactctttttaaaatttttcgtatttatctttacatttaaattcttctttctttggttttaatttgctttcatttttgtaatttattgatatgagtgcttagatcatttcttgaagtcttcatacttaatatgtatcattaaggctatacatttccactcaaacatggctttagatgcatatcgtatgttttgccatcatgtattttcattattaaacattaatttaaatatggaatttgttttaatttcttttttgaccctgagagttattttgaggtatactgcttgattttcaagtatagaagcattctctatttaactttttagtactgttttctagcttaactccactttgtttagaaaatgtactatgtgatttcagtcctttgaaattcattgatatttgctttattggtcaatacatactgaaattttggtaaatgttttttgtacacatgaaaagaatgcctagtctggatttgttagatccagttatctttgttattatgtcgggttttttttgtgttcaggtattctatattctttagtaagaattttgtttttttccccttctctatcaattactggtagatatacgttaaaatctcccctatgattatggagttttctatttatttttttaattctgttttgatcatgtgctcattaggtatctacagatttagagatgatacatattctgggtagagtgacccttttatcattatgaaaaagacctccctcttgccttaaaagtcctatgtcttgtattacataggactttgtaatatttgttgcatagttagtagatacaaaacttttgttagtattttcatgatatttatttttctagttttgcaaacttcattttaacatttttaggtttttatatttaaggtttgtctcagaaatatttttgggcttttcctccccaattaaagaaattgacacataatgtacatatttatgggttgcatgtggtattttgatacgtgtgtacagtgtgtaatgatacaatcagtaatcaggatatccatcacctcaaacacttatcatttctttgtgttgggagcattccaaatcttctcttctagctattttgaaatacacactaaattattgttaactatagtcactctgttgtgttattgaatactagaaattactgcttctgtctaactgtatttttatactaattaactaaactctcttatctcccctttctcctacccttcccaacctcccctatccctcccatcattctactctctactttcatgagataaaattttttttagctctgacatatgaatgagaacatgtaatttgtctccttgtacctggcttatttcacttaatataatgttcttcatttctatccatgttgcttcaaatgacatgatttcattctcttttaaggctgaatcatattccattgtgtatatgcaccatatgtttttaaatctcttcatccactgataggcatttaggttgatttcatatcttggctgttgtgaatagtgctgcaataaacataggagtgcaactatctcttctttggatgtataccctgcagtggaattgctacatcatacagtaaatctgtctttagttttttgaggaacctctatattgttttccatagtagttgtactaatttatattcccacccacaatgtacaagtgttcctttttttttcgcattaatcagtcaactttaagtgctatggttgatgcaaagaagaaatataggcgagaaaaaggattaacattattataaggcagactatagtatgtgctaaatgaatgatcagtataataactatcttcaaataggttttggcagtaaaaattgagagaggatgagaatgattgagaaagctcacgtaatggaggagagacttgaattgggcttggtgcctactggaatggataagcctagatgcttttaaaataaattaacttgaatgtataaacttttaagctagtagaagaaatagttattgtatttagcttgttaaaatagtcatacatgcatatttaaaagtatatattactttagaaaattttttatacttgttttatgaaatgacattatttacactcttcatatgcattttaaaattagcctttctctttaccagatttagtctcctttataattttccagaacacatgattttaatttttacttacatggttttaaataaagcattttttaaaaatctaagtataataccttccctgggaatttttatctcctgtcacaagtaatcatttgctattcatgagctttccaaggaaaccctttcaattgatcattaatgggactatttatattgggatctaaaagttttaattgtgagtctgtaccccccaaataattatgaaatctgtttttaatttctttgccattctttttaactgttttcgctgggtaatctcttttcagtgtcccaaaccgatattccttgaagttgtttttcaggatgtatgtcttttccagtttttttttttattgttttcaaaaataaagtaagtagaacaactcattggtaaggtagttttctcttttctttggaacatttttgggaaaagaactttaccttatgttcactgttatgatctaaaatgatgataatgagatgaagagggagtcaaggataactgtgagatttttgacctggccagatggaagaatggaattgctatttaatgaggtatagacacttgctgtattctgcttaatattgtagatattttatgtgcttatgttattccttctgtgcttatcttattcctccttctagttccccagggtttggggctgtgttgtccatgtattattcacaatacccagcacagttctttgtaccgagtaattgccacctactttcctgaattaaattgattttaaatgtacaacaacctcaaaatgtaggcagctatattcagggttgctgttaacaaggaagagtgttttccttctgctgctgcttgtaatataaagcagatatagctttatggctttgttcaaccatccgatccaaaaatcttcccttgcatactgcgggatgtctaactcataaacccttaaaactgctagccttggccgggcacggtgcctcaagcctgcaatcccaacactttgggaggccgaggcgggcagatcacctgaggtcggaagttggagaccagcctcaccaacgtggagaaaccctgtctctactaaaaatacaaaattagctgggtgttgtggtgcacacctgtaaccccagcttctcaggaggctgaggtaggagaatcgcttgaacccgagaggcagaggttgcagtgagctgagatcgtgccattgcactccagcctgggcaacaagagcgaaactgcgtctcaaaaaaaaaaaaaaaaagaaagaaagaaagaaagaaagaaagaaaaaacaccaaaaaaactactagcctttagacatttctgttgcttttaggttttagctcgcaaattcaatctgggaaaggactattagttgacaatcttcctttcctctccacatttcattgaatagagaaggcagttatacagtgagcagaaggaagagaggtgagtgggtgtttatgtgaggctgactaaagtctaatcactgtgttacccagagtggggcaaagacctgtgaaggagaagtaggtgactgtcacacaaaacacctttcttttattttggtttcagtaaatgaaatcttggttgtcaaatccttttgttcctagccctgtagtttttccagtctgctatttggttttcactcatagatgttaatttgacaagaggtgaattgtttaaggtaccattagttttaggatctgcctcatattcccttgtgtttaatttcgtctggaccagtcttgattctgcctgttgggctattttgatagtgatatctacttggaagagttcagtgaacattctttacatttgactaaaaacagattgtggaatggttacatttcttacattgttctgcattctggtttctttttttctcctggaaaaaaaatcaaattagaacttattaaaacaaaatatttggctgttaggatctgatctaggattgccggttggaattcttttctactgcaaaaatatacagcagggttaataaaaagaaatttaaaatttaagttgtagggctgttaacctacccacttttcttctgctttggtctcctcatcttatctgtaatcaatagagcatttcggtgaccgtaggccatttaacaaatgaagaggaaacatctgagaaataagttgtctgcaatctacttctttatagtgttttcattctttgccttcaaaaattttgattgaaaaccatttgtgattttaaaaaagggtatcaatatgacaataattactgtaaaagcagttcatctttattgagtacttttctgtgtatcaagcattatttaagcacttttgatgtattagcaagtttcataaaaacctgataaacaggtattgttatccacttccgttttaccaggagaaaactgaagcagagagaaactaagtaactttctcaaaattatgctcctagtaagtgctggagctggtatacaatagctttctggctccagagcccgagtactttgagcatatttaataatatatgagtttatgaaggctctatgcctttagacattaacttctgaaataataaagggcccatgggaaataagaatggtatggcatagtaaaagtttttttatgttcctttaatatgtatgctaaaaactatctgaatttttctcaaatgtggctgtgcctcagaatcatttgaggagcctgtaaaaaaatatgatttctggcactcattccatactacctcactggaagcaggagtttgatataactgaatttctagcccagtgtgaggcagatatttatgctccactggcatataacacacaacaaaatagattttttttaaagttgcatattgatgttagctaattatggcagctaacacagagtactttatctgtattatttcatttgattcttataacaaccttgtggtgtcaggcagcattatttcctccattttatagatgaagaaactattaggttggtgcagaaataattgtggttcttgccattgaaagtaatggcaaaaaccgcaattacttttgcaccaaccacaaatcttagagtagtaacatgaccaagccctgtgctcattgcaacattattcacattagctaacatacggaaacaacctaaatgttcatcaatgaatgaatggataaagaaaatctggtatgtgtacacacacacacacacacattattattcagccattaaaagaaggaaatcctgccaaatacaaaatggaagaagctggaagacattatgctaagtgaaataaaccagacacaaaaagaccaacatctgtgtgacctcacttacatgtagaacctaaaagtgtcaaactcatagcaacagagaggttagaatggtggttaccaggggctgggaaatggggagatgttggtcaaagggtacaaactttcagttgtaacatgaataaattctgaggatctaaggtacagcatagtgaccatagctaataatactatattgtttacgtctcgaaatttgctaagagaggagatcttaagtgtccttgtcacacatggacacacacacacatgcacacaaaaggtaactaagtgtagttatggatgtgttgcttaatttgattatggtaatcattacacagtgtatacatatatcaaatcatcacattgtacaccttgaatatacacaacttttatttgtcagttataccccattaagcctggggagaaaaacatcaccaacatcacatgggtaataaatacatgctagaaccaggatttgaaaacaggtctatcagaatacgaatacttgacattaactatgttcacattgttgtgaaaaaaatctccagaactttttcatcttgcaaaactgcaactccatattcattaagcaacaattccctcttccctaccctctccaccccatcccctagtaaccaccattgtgctttctgtgtctgtgaattcaactactttaagtacctcatataaaaaggcatggggaggagaaaggatgccgtgcacgtacaaacgacatatggattgctatactagctaatggggcaacacatgcatctgagattgcatttttctagcattccatgaaattgtcaattaaagtggaaaaatatttatttatatttaataaatatataaatatatttacatatataaataaataaatttcctagtaagtgctgaagctgatatacaatagctggtatacaatactatatatatatatatatgtatatatatatatgtatatatatgtatatatatatacgtatatatatatgtatatatatatgtatatatatatacagagagagagtgtgtgtgtgtgtgtgtgtgtgtgtgtgtgagtgagtcagtcagtcggtcagtcttgctctgttgaccaggctggagtatggtggtgtgattatagctattgcagtctcgaactcctgggctcaagtgatccttctgcctcagcctttcaagtagctgggattacaggtgtgtaccaccatgcctagctaattttttttttttaatttttaaattttctacagacagagtcttgctgtattgcccaggctggtctcaaacccctaggctcactcgatctcccttcctcaatctcccaaagtgctgggattacaggcgtgcgctactgcaatttacatatagtaaaacatacggattttaaatgtagatagccctatgaattttggcacacatatatatcatgtggccaatcccccctccctcaatcaagatttctatcatgtcagaaaatttcttttttggttagtaacccccagctctactctaggcaagcacggatctaatttttattaccacatgttagtagtcttgtctattctagaactctatacgggttgagcatccctagtctggatatctgaaatccaaaatgctccacaatctgaaactttttgaatgccaacatgatgccacaagtagaaaattttgcccttgaccttatgtgatgggtcacagtctaaatgaagccaaaaatttgtttaatgcaaaaaattatttaaaatattgtatgaaattaacttcagactatgtgtataagatatatatgaagcataaatgaatttgtatttagactggggtcccatctccaagatttcttttttttttttggtggggggatggagtctcgctctgtcgcccaggctggagtgcagtggcgcgatctcagctcactgcaagctctgcctcccggcccccgcctggcctccaagatttcttattgtgggtctgcgcatattccaaaatctgaaaaaatccaaaatccaaaatgattctggtcccaagcattttagataagggagactcaagctgtatgaaggaaatcatacagtatgcactcttatacctggcattgttcactcaacataatgtctgagagatttatccatattgttgcatgtataagaaattcattttgattattgaatggcattcttttgtgtgaatattcttcaatctgtttattcattggttgatggacattttggttgtatccggtacgaatatttgtatactggtctttggtagacattttttcttttgggtaaattcttaagagtggaattgtgggaatacagcttaactttatatgagagttttatttagctttatatgaaactgccatgctgtttccaaagtagctgcaccattttacattcccaccagtaatgtatgagagttccacttgttccaaatccttgccattatttggtgttgatagtctttttaatttcacgcactttagtgtgtttaagatggaattttttgtggttcttctttaaaaattaacttcattgaggtataatttatgtataaactcatttccactgtaaaatttgataagttttgacagatacgtgcacctgtgtaactaacaccatagttatccttaaattttcttgctgtccattctctgcccacctcaagcaatttttgatctgttttgtttaactatagattagatttttgttttctagagttttcatatatgtggaatcatatagtatttacctttttcgagccttttattattgcagaatatgtactattgaaaatattttgtgaattaaagataaaatattctttgtttacagctttattgagatataattcatgtatcatggaattcacctatttaaagagtaaattgtactctttaaatatattcacagggttatgcaaccaacactataatctaattttaggacatttcatccccagcaaaagaaaccctgtgcctgttagtagtgaatctctatttctgtttaaattttttaaaatcttttttattgtgacaaaatacacataacataaaacttaccatcttaaccaattttaagtttgcagttcagtgtcattaaatatattcataattttatgcaaccatcactaccacccatctaactcttttcatcttttaaaactgaaaccctgtacccattaaacagtaactccccattaacttgtatagccagcctctggcaaccaacattttgctgtctgtctctataattttgactactctcattacctcatgtaaatggaatcatagagtatttgtcttttgtgacaggcttatttcacttagtataatatcttcaggggtcatccatattgtagcacgtcagaatttccttcctttttaacgctgaataatattccattgtatggatatattacattttgcttatccgtctgttgattgacacttgggttgcttccatgttttatctatcgtaaataatgctcctatgaacatacaaacatgggtgtaagattatctcttttatgaatagccaaagccatcctgagcaaaaagaacaaagttggaggcatcacattacccgacttcaaaatatactgtaagactaaagtaaccgtaacgccatggtactagtacaaaaacagacacatagacctagggagcagagtgaagaacccagaaataatgctgcacacctacagccatctaatcttcaaccagttaacaaaaataagcaacgaagaaaggactccttagtcaataaatggtgctaggatagctggttagccgtattcagaaaaaaatgaaagtagacccctaccattcaccatacacaaaaactaaattaggatggatgaaagaattaaatgtaagaccccaaactataagaatctagaagaaaacctaggaaatgccattctaaacatcggtcttggcaaagaattatgactaagtcctcaaaagcatttgcaaccgaaacaaaaattgacaagtgaaacctaattaaactaaagagcttctgccgagcaaaagaagctatcaatatagtaaacaaacaacctacagaatgggagaaaaatattcgcaacatatgcacctgacaaaggcctaatatccaggatttacaaaggacttaaaaatttgaacaagctaaaaaacaaatagccccgttaaaaagtgggcaaaagccaggcgtggtggctcacgcctgtaatcccagcactttgggaggccgaggcggaaggatcacgaggtcaggagattgaaaccatcctggctaacacggtgaaaccccatctctactagaaatacaaaaaattagccgggcatagtggcaggcgcctgtactcccagctactcgggaggctgaggcaggagaatggcgtgaacacgggaggtggagcttgcagtgagccgagatcgcgcctctgcactccagcctgggcgacagagcaagactccgtctcaaaaaaaaannnnnnnnnnnnnnnnnnnnaaaaaaaaaaaaaaagtaaaaaggaaaaaaaaagtgggcaaaagacgtgaatgaccgcttctcaaaataagacgtataatggccaacaacatgaaaaaaaaatcactaatattcagagaaatgcaaatcaaaactaggagattccatctcacaccaggaagaatggcttttttaaaatttttttttttttttttaagacggaatctcactctatcgcctaggctggagtgctgtaccttgatctcagctcactgcaacctctacctcccaggttcaagcgattctcctgcctcagcccccagagtagctggggctacaggcatgcaccaccatgcctggctaacttctttggtatttttagtagagacagggtttcaccatgttggccaggctggtctcgaactcctaacctcaagtgatccgcccgtctcggcctcccaaagtgctgggattacaggcatgagccaccgtgcccagccagaatggctattactaaaagtaaaaaaataacagatgctgatgaagctatagggaaaaggaaacacttataccctgttggtagaaatgtaaattagtttatccactgtggaacgcagtttagagatttctcaaagaacttaaaaagaactgccgttctacccagcaatgctattactaggtatatatccagaggaaaatacatctttctaccaaaatgtgttcatcacagcagtattcaccatagcgaagacatggaatcaatctaggtgtccatcaacagagtggataatgaaaatatggtacatatacaccatgggatattatgcagccataaaaaagaatgaaattatgtcctttacagtaacatggatgcagctggaggccataatcctaagcgaattaactcaggaccaaagcacattctcacgtaagcaggagctaaacactgggtactcagggacataaagatggcaacaatagacacgggattactagaggggagagaggggaggtggacaggggttgaaaaagtacctattaggtactctgctcacgacctgggatcagtcatacaccaaacctcagcatcatgcaatatagccatgtaacaaatcggcagatgtacccccggaatctaaaataattattgaaattattaaaaataattttaaaatatctttttaagagactgcttttaattctttttattgtatacccagaagtggaattgctgcaccatatgataattctctttttaactttttgaggaaatgtcatattgtttgcgacagcagcgataccattttacattcccatcagcagtacaaaagggttttaatttctccacatcttgccaacacttatcttctggttttgtgtgtgtatgtgtgtgtgatagtagccatcctaatgggtgtgaggtggtatctcattgtagttttgatttgcttttctctaatgatttgtggagctcagcatctttaatgattagtgatgttgggcatctttccatgtacttattggccatttgtatgtctttggagaaatgtctattcaagtcctttgcccattttttaaataaggttgttggtttttgtttgttttgagttagtatttactcttacgtatctaactattcgcttagcataatgtttttgagatacatacatgtagttgaatatatctataattggcttgttttttgaatatctataatgtttttgagatacagccatgtagatgaatgtatctgtagttggtttgtttttttgaatttatctgtagtcggtttgttttttattttattgtacccacacaatatgatatatccaaaacaacatttgtctgtagttgggcatctggtttgcttctaattattgggtataatattagtaatatgatgcctaatgttattttgcaatatagcatacactaatatgcatacttactatgtatactgtacatataatatgcagctataatattaggctaatattatacctagtattactttgcctaggcatattatgccttatatgcagctatgcatattagtatagagttgtcttcccttattggtggtttcagttacctgcagtatagtacagtgagatatttagggagggaaagaccacattcacataacttttattacaatatattgttacagttgttctatattattattgctgttaatatcttactgtacctaatttataaattaaagtttatcataactatatgtataggtaaaaaacatagtatatatatatggtgtggtactatctgtagtttcagacatcttctgagtgtcttgtaatgtattccctgaagacaaagaggaactatagtatgaatctttggagcatatgttttcattttcttcaggataaatacttaagagtggaattgctaggtcattttttttttttaaatgaagctgtggatttattctgagtggtatggagagatgccgacaatacagtgttaaatgaaaagcataaagcatccagcactttgggaggtcaaggcgagagagtcacttgagcctaggaatttgagacaagcctcaacaacatggtgaaactccgtctctacaaaaaaatttttaaaattagttgggcatggtggtgcttgcctgtagtccgagctactcaggaggctgaggtgggaggattgcttcagccatggaggttgaggctgcagtgagctatgattgtgccactacactccaacatgggcaacagagggagaccttgtctcaaaaaaaaatttttttaaaaggaaagcataaaatagcacatatagtaagatctcatttttggaaaaatgtgtatgcaggaggaaaaaagactggaaggatatacactaaaatattagcaatggttttcctctcagtgaaattttcttctttatacttttctctattttctgatttcttctgcaataagtatgtataagtttaataatttaaaaaatgaaattttttttcaatttttcccctgtgcttttcttttttttaaaatttattttacattcaagagtacatgtgcaggtttcttatataggaaaattgtgtgtcacagaggtgtggagtacagattaattaatcactaataagcatagtacctgataggtagttttctgtcctcaccttcctcccacccgccactctcaaggaggccccagtgtctgttgctcccttctttgtatctatgtaactgagtatttacctcctacttataagtgagaacacactatgtttggttttctgtacctgcgttagtttgggataatggcctccagcaccatccgtgttgctgcaaaggacatattgttgctcatttttatggctgggtagttattctgtggtctaaatgtaccatattttcttttccagtccacccttgatgagcatttaggttgattccatgtctttgctatggtgaatagtgctgtgatgaacagatacacgcatgtatctttatggtagaacaatttatatgcctttgggtatatacgcagtaatgatggtggggtcgaatggtaattctttcttaagttctttgagaaattgccgaactggtttccagaatggctgaactaagttacattgccaccaacagcatgtaagcactcccttttctctgctacctcaccagcaccttttatttttagagatttaaataatagccattctgactgatatgagatggtttctcttgtggttttgatttgcatttctctaatgattagtgatattgagcattttttcgtatgctttctggctgcatgtatgtcttcttttgaaaagtgtttgatcatgtcatttgcccactttttaatggggttgtttgttttttgctcattaagttgtttaagtttcttatagattctggatattagaccttttttggatacgtatatcttctcccattctgtaggttgcaaatattttctcccattccattggttgtgtgattactctgttaatagtttcttttgctgtgcagaagctctctagtttaaatatgtctcattggtcattttttgtttttgttgcagttgcttttggcgtgtttgtcatgaaatctttgccaggacttaggtccagaatggtatctcctaggttatctttgaggttttaggttttacatttgagtctttaattcatcttgagttgatttttgtatatgctgtatggaaggggcccagtttcagtcttctgtatatgactaaccagctaccccaacaccatttattgaacagggagtcctttccccattgcttatttttgttacctttatcaaagatctggtggttgttggagtgtggcattgtttcttggctctctattctgttccatgggtctatgtgtttttgtatcagtaccatgctgtaatggttactgcagctttatggtatagtttgaagtcaggtaatgtggtgcctccagttttttgcttaggctctttttgcttaggattgtcttggctactcaggctcctttttggttccatatgaattttaaaatagtcttttctaattatgtgaagaatgtccttggtagtttgatacgaatagcactgaatctgtaaattgctttaggcagtgtggccattttcacaatattgattcttcctattgatgagcatgaaatgttttttcctttctttgtgtcatgtgtgatacctttgagcaatcttttgtaattctcattacagagatctttcacctcccctagttagctgtattcctagggtatttcattttctttgtggctattgtaagtggaattgcattcttgtattgactctcagcttggacattgtaggtatatagaaatgctactaatttttgtatattggttttgttgttcttgttgtttttgctgttgttgtttttgttgtttgacccctctgttactcaagctggagtgcagtaattcgatcttggctcactgcaacctctgcctcctgggcccaagtgatcttcccatgtcagtctcctgagtagttgggactacagatgcacactcccttgcctggctaattatttctgtatttttttatagagacggggttatgccatgttgctcacactggtcttgaactcctgagctcaagcaatcctcttgcctcagcctcccaaagtgctggaattacagccatgagccaccatgcctggtccatgttttttgagacagagtctcactctgtcacccaggctggaacagtggcacgatctcacctctctgcaacctctgccatccaggcttaagcgattctcctgcctcagcctcctgaatggctgggaccacaggtgccaccatgccaggctaatttttgtgttttcagtagagacggggtctcaccatgttggccacgctggcctcaaactcttggactcaagtgatacacccatctcggcctcccagagtgctgggattacaggtgtgaatcaccgtgcctggcctgaccatttttgtaccttaattttatattctgaaatgttgctggagttgtttatcagagttagtagcttttggacagaaactatgaggttttctaggtttgcaatcatatcatctgcaaacagagatagtttgacttcctctctttctatttggatgccttttatttctttctcttgcctgattgctctggataggacttccagtgccatgttgaatagagtagtgagagagggcatccttttcttgttcaggttttcaaggggaatgcttccatcttttgcccattcagtgtgatgttggctatggatttgtcatagatgggtttgtattattttgaagtgtgctccttcagtgcctagtttgttgagggttttttaacatgaaggatggtgaattttattgaaagccttttctgtatcttgagatgatcatgttgttttgtttttagttctgtttatgtggtaaatcacattaattgatttgtgtattttttttaatttttttagttttgagacagagtctcgctcttgttgcccaggctggagtgcaatggtgcaatcttggttcactgcaacctctgtctcccaggttcaagcatttctcctgcatcagcctcccaagtagctgggactacaggcatgcaccaccactcctggctaattttgtattttcagtagagatggggtttcaccatgctggtcaggctggtctcgaactgctgacctcatgtgatccacgggcctcagcctcccaaagtgctgggattacaggcatgagccactgcgccaagccaattgatttgtgtgtattaaaccaaccttgtatcccagggcccacttgatcataaagcattagcttttggatatgctgctgaatttggtttgctagtattttgtcaaggatatttgcatctgtgttcatcaatgatattggcctgaagctttcatattttgttgaaatatgccaggttttggtgtcaggatgatgctggcctcaaacagtgagttagggaggagtctttctttcttaaatatttggaatagtttcactaagaatggtatcagatcttctatatacatctgggtagaatttggctgtgaatgactgtgtctggtcctggcctttttttcattggtaggcttattattagtcattcaatttcataatttattattggtctgttcagagattcagtttcttcatgatccaatcttgggaggttgtatgtttccagagatttattcattttttctacgttttctagcctttgtgcatagagagatgttcatagcagtctctgagtgttctttgtatttctctggatttggtggtaatgttccctttgttattttttattgtgttcatttggagcttttatcttttttttcttcattagtctagctagttattatgtcagttttatttattctttcaaggaactaactcttgaccttattgatcttttatatgctgttttcatgtctcagtttccttcatttcagctttgattttggttattctgctagctttgtggttggtttcctcttgtttctttaattcaaggtgtgatgttaggttgttaatttgaggtctttctaactttttgctgtgggtgttcagcgctataaacttttctcctaacattgctttagctatgtcccagagtttctgatatattgtatctttgatgatctgtctaataatgtcagtagagtgttgaagtctcctatatattattgtgtggttactaagtctcttcattgatctctaagtatttgctgtttgaatctgggtgcttctgtgtttggtgcatatatatttaggatagttaggtcttcttgttgaattaaacccttcagcattatgtaatgcccttactggatgtgctgctggatttgttttgctagtattttgaatgatccaaaaatcactcaaaaacatacaatttaatggaagttaacctgctcctgattgactttgggtaaacaataaaatagaggcagaattcaagaaattctttgaaactaatgagatcagatatacaatatatcagaaactctgggatatagctaaagcagtgttagggagaaaagtttttttttttttttgcaaatctttattgatataaagtgtgttttatctgaatatcagaacatccacctctgctttgttgagtttttgttcgcttggtagatttttctctgtttactttgagcctgtgggtgtgataggtctcttgcatttatatgtgtgatgggtctcttgatgacagcatacagttaggtcttgcttccttatccaacttgccagtctgtgccttttaattagggcattaacccatttacatacgaggttaatattaataggtgaggatttatcctgtcatcttgttgttacctggttgttacgcatcttaattgtgcggttgctttatattatcagtgatctatgtacttaagtgtgtttttatgatggcctgtattagtctttcttttccatatttagcactcccttaaggagttctggtaagtcaggtctagtggtaacaaattcccttagcatttgcttgtctgaaaaggatcttatttatccttttcttatgaagcttattttagtttggctgtatatggaattcttggttggaattttttttctttaagaatgctgaatataatccctcaatctcttctggcttgtagggtttctgctgaaagttccactgttaacctgaggaagtttcttttttggtgacctccttcttcctagctgcctttaatattttatctttcactttgatcttagagaatctgattactctgtcttgggcaaggtcgtcttttatagtaccttgcaggggttctgtgcatttcctgaatttgaatgttggcatgtttagcaaggttggaaaaaatttcatgaatgacactctaaaacatgttttccatgtttcttgctttctcttttagggatgccaatgagatgtagatttggtctctttagataatcccatatttcttggaggctttgtttattcttgaatctctttttttaatttttgtctgactgaattattttggagaactggtcttcagactctgagattctttcctctctttggttgatttcctgctgttaatatttgttcatattgtttgcctctgtgtccccacccaaatcccatgttgaattgtaattcccaatgttgggggagggacctggtgggaggtgattggaccatgggggtggatttacccccagtgttctcatgataatgagttctcatgagatctgatagtttaaaagtgtgtggcacttcccccttgagtctctctgtctctcctgctgccatgtgaagatgtgcttgcttccccttcgccctaccggcattactgtaagtttcctgaggacttcccagccatgccttctatacagcctgtggaactgtgagtcaattaaacctcttttctttataaattacccagtctgaagtaattctttatatcagtgtgagaatgaactaatacacctgtgaccgtgttttaaaattgttggagtctttcagctctatcagattctttcttacaattgccatttgtcttttatctcctgtattattttattgtattccttagaatccttttattgggtttcaacattctcttgaatccagatgatttttgtttctatttatactttcaattctgtttctttcgtttcagccattcagtctggttaagacccagtactggggaattagtgtggttgtttttaggtgagaagacactgtgcttttttgagttgccagagttcttgctgcactggtaccttctcatcattgtgggtgatattccttcaatctttgaaaatgctaatcctttgaatgtgtttgtttgtttgtttttttgcttttgtcttctttgatgcatttggaggtttaattgtagtataaggtgagttcagtgaagtcacttcctttgtgaaagattttagggagctagggctaagctcatccctcctaggcttcatgctctcactttaggggcctgacaccaggcccccggcattcttgtctggactcttgaggttaggaacatgctgtactggagcttctgagatgttcccaatcctctggccatgacacctccatgggtggtgctagccaatgccctttgtctcagcgggttagtgggctctgcgttcatttgtgtttcagcagctgtggtagtgtggcagggtgcacatacataaaatggagtggggtagtggtggaagcagggctgtggtatgtgcttccactggtgtcggctgcctccgtcacatgtttacctgtatatcaaactatcacacagttttgaaagttgtttgtacagtgtatgagatgttctgttgcttgatattattgctaatacttgtattatctgatttaatttaaccattgggtgtgtggtggtatcttattgtggttttagcttgtatttgtttgatgactaatttgaatatctttttatgtgcttttcatcattcacataccttcttttgagaagtgtctgtctcccccattttcttattgactttcccccattttcttattgacttgtcttgttaagtctccagaatttttataaatttttaatataaatctatctcagatacatgtattataaatactttttcctagtctgcagcttgtctttttattttcttaatggtatctttcaaagggcaaacactatgaattttaatgtccaatttagcaattctttatttttcatcatttgcctacccattgttgtgacagttttcttctttgttttcttggtgtccttctctgtaaaattgaggtaatgtgagagttaaatgaattgatatatgtaatgtactttgaaaatgcctcacatttaataaaaatggtacagtgttagctgccattattgttaccacaactcctttactcataagttatttttgaggcttttggatgctgtctctacatccctgtctcatcttcattcctcttaaaaatttgtcattgccattttctttaagggtcttttgtttacaaaaaaggactaaagttaagattttctgtatattagagaaaggatatcctagcattccatgtagggtatgatttatattacatgccactgttttgtaatctaccaatttaccagtgacttggtttcctttcatatgtgatgttacaatgagatttatagaaatttttgccatttccttcccccaaaaggtctaaagcccaccatgaatgtcatgattttccccttttgttaaggctcctttggtcatctctgacattggcttccactgtattttatgcataccttacatgccttttagtgtgctatggaagatggcattttagagggtattgttttcgttgtcagttttgctaaacagaatttaggggctggattttgattgaggtacattaattggattaaaaatatgaacataattagcatgaaggcagtaatagttataccaaaatggagtttcaaatgagtataaactaggtcaaggcaagatgttcttcttaaaatacattacagtatgataatgatccaccatagttgtttgagtcagtctcagaaatggagatattgtcctgattctgttctctattattttgaccaaatatttaatcagtctatcattttcctattatagagtgagagatataatatcttcctagcaaaaataatattaagcaatgagatagttagtatttagcaagtgatatagttcttataataaactcagtataatttttagtctacagtccagatcttattgatctcttttctaaaagtatcccctccatctgagcccctctcctgagccctagatcaggtactgggctatccacaaagtagtgcgtagtgcttggcaatgaataggcaattggtaagagtgttgtatttaaccaaactttcaattttatccctgtttcttgtggctttttttgtctctctttcctgtggattctataaactcaagaaatcaatattcttatggagggaaaaaaagcaaacaaaaacttactgcagctgttcttcttacagtttctgtctttatgcttttcacacaaatgttttaagagagtcaattattcttagtttcccatgtatctttttagcttttataatttagttattgttaaactgttttaaactatgtctaataaccttaggcctcataattttagtgtattttcagattttctagcttttgtgtaatagctccttatagtttcttctttgcctcctctgtaacactttcccagtctttttcctcctgtctgtcctttacatttttatttttatttgttttgtttttaatgaattactccagattttatcttcatctcctttttcttcaacaaagaagatagctgagtgagggagtgaattaaaatatttctagggcttcgtttatttgcctttaagcagatgttgctttcttgaacgtagctgtgatttttcagttactttttggacatctccattttggtattagctgaatttttcatagtaaaactaattgttgaatatacttggtcctacgtagaaggcaagctgtcttatgttcatcactatgtcttaattgtctagcatagtgcttggtacatagttggcaattaatacacatttattatatgaacaattgatattctcctgtgacctgaaagttaacatgttcaaaattgaacatgttggaatctggaattttcctttgcttctgtatcttcccattgtttgaagcatagatcaaatgttccctcttccctaaagttttccttaatcatcacagtcaaaaatctgtttccctattctctattcctttaccaaattatacttttattgtacctttattctggattacattttatttatttatgtacagagtttgctgtacataagattgaggtcacttgctaacttctccaagataaattaactatttaataatctaaggttttgggaaaggaaagggttgaaaagtggatttgtatcactgttccttctgtatagaatcccctccccatcttgctacttttcactcattcttcagcctcaggtgaggcattattttatccaggtgtttctgagcctgctttaagtcttgaataggtgacttttctttgtattcctctattattaattcctttaataaataattattgagtgcctttattgtgcagacactatgccagacaggcctttgagaaacaaaaaggtaggacttttgtggctgagtatgtaatgtttagctcattatacaattacgtattacacagataaggaaactgaggctcagataagttcagtgaatatactaaggttacaaaattaataaatgggagagcctggtttcagactttagactttctgagtccttagtattcttcccattatactttggcattcctcagtgaaaatgttttttgaaagatttgaaccaaatctttctaagctctggtattttgtttcttttccagcaccacagagcattctcttaaccatttactgttacttagtaaaggagatacatgtacatggaaccaatgctgttgaccaaaagaggatagttaacttgatactgggcagaaatacttccactgaatttgtgtctttgaaaactgattttagcatttgctttactcaaaggatttacaagcctccagagtcgtcagggttctgtggtatctattgtctatgttaatctatggatttgttttatttttccactggaacattacagctctcaaaattcatagcaaacaccctacactctatttatttccattcaacagtacgatggtgtgaatttgacaaaactgtggcaaatacttaagttagtatttcacaaaatacccaaactccttttggcagttgatttccaggcagctgataaaacattgaattggtaggtgttttttgtttttgtgggttattcattttgatgtggatacggaagggtagggaaggagaagttgttatggtataaagacagagttggaaaagttgggcttatgttgttgtttgtttgtttttgttttgttttcctgagaatattctctgttaccctgcagtaagctgtctacattccaggattcgacagcctgcttgcttaatagccttcaaaaacatacatgtcctgtcatacctgtgctatgttctgactacttggtaacttgttagctcagagattaattttagggatgttttatataaggaaacctctcctctaatgctacctccttttgttacctgttaatagtcatggtgttaggtttattgaatgacttttgcctctatattattttcttctcaatgttcttttcattaggaatataatggccgggcgcggtggctcatgcctgtaatcccagcactttgggaggccgaggcgggtggatcacctgaggttgggagttcgagacccgcctgaccaacatggagaaaccctgtctctactaaaaatacatagttagctgggcgtagtggcacatgcctgtaatcctagctattcaggaggctgaggcaggagaattgcttgaacctgggaggcggaggttgtggtgagttgagattgcaccattgcactccagcctgggcaacaagagtgaaactccatctcaaaaaaaaaaaagaatagtaatcataacatgaaataatacattcatttgtgattttacatcttgctcttctgagtttgacaaaggaaataatgtttataagatgaagttactgatttttcctgttttgacatccttaaactttgggttctgtgagtgttttgcctgaatcagaactgtggaactagactttatgactcaaggtttggggatattacatgtcaaatgcatgtttttaaattttctaaaatacaattttataactgagaaatatagaaacatttaatagacaacattttgcatcactaaaaaaattagtattatgtttaaatacatttttaaaaatatacttatttccttttaaagtgttctccaccacacttgggcatttatctgtttctttaaatggccttctctgtttcttgtttgcaggcagctatcaatggtgtaataccacaggaaaatggcattctacaaaggtatgttataaagtgcttaccagttaagatgacttagcagaacaaagaacagagctagctgttaatttttttgttttattttttaatagagcattgatttggggtatataagttcattaacattgttctttcagatatttctatgtgttatattaattccccaaagtctccaacttttaactgtataaaattattgcatatttggtaacaccatcttttaaggtggttttaatttttaagaaagcttttcaagcttatcctttgatttataagatgaaaggaactgaattttttaaactattagcactggctattggtttactaaccccagaatatggttatcaaacttaactatacaggctttatctccaggcttactacagactttttctccttcccttttgggttctaaatcaagtatatgataatttgcaacaatttgaggcagttcttaataatgcaactcttcagagtactgaactattttacttgaagtatccagtgttaacaagtggaatggttttagaggttttgtgttatggccagaaggtaaaactggaagatgtggccaagagaattataatagttgcaatgtaattgcttgagttaaaaataaattcataacttttgtctccttaaaattggagactctggttctgaattaaagaacactttataaagtcttaggaggtaaaaccattctcccttccaagtgtagtttaattacttgattttcccccctttcctctcaattcaaacattggcttgaattttggtggctgggatttctaagtcactgaagcatgatctggtaagtgcggatgaggcgaacagaaacagcagattaggaatgaggtcgttttggagagcaagaaaagtactcttgcagaaacatcaggaagttcaccatgaactgcaagacatgctgttcttgataagaaaccatatatttaggatggaagcaaaatttgtttgatacctgtaccacctttaatggttgatggtttttagatgaaagcaatgataaaatagacctatacccccgttcctctcttctaaactgtcagaaagattttcatccagagtaaatgtggcagatttctagagtttctaccaacttctgtttgtttaatctttagtttgttgttgtttgttccagagcattcaattctatcgaagcccttgtctagaaagcaaaccagatgaacttcctttatggctatttttttcttagtttagaaagtttcacactgctaaatatcactccagttttatttttgagtaaatgttattgccactttttgtgccaaaatttttgctatgcaaaatctgtgggttcagctactggattctgagtacatattggatatatcatccaattaatagcatttgccataggtgaactgtagaaacttcttctcccctggaaacattccatctttcctgtcacagattatactttttatttaatatattttatgactagaaattcagtattaaactgatttctcataaagttactataatatttggggttgaactgtgatcagagtaggattttgttggttttgtttgctttttttgaaggaatgaaacatatgtctacatgagaaaatcagttgtatctagtaatattcttcaactatttccttcctaaccttgttctttagctttgaaatcattgtggatttaacataactgaaaattcctcttgtatgtctactgaccagaggaaaacaaaagagggctctttgtgtactttcttataagctgaacactgaaagtagaaggcacgatgctggaaatggtatatgcaggcagttaaaaggatctttgttttgtatgtttggtttttataataaagtcgaatatatgcagtctgtgtatacatctgactgttaaattgttagtccatcccttaacaaagaaaggaggtatcaaatactatagtttaaataaattactatataaagcaatattctcatgagataatgaacttttggtaggaaataaatacccacctcactgatacatgtgttgatactaaattcctttgaccagagattattcaaaacaaaaaactgtactaattatctgcaatctaaagaagtttctttttttttttaagagaaagaagagccagtgtgtgccttatagcttttcttgaaatcaggtttttgtgtgaatccaagagggtatatgatttttaatgtaaccataaactccaagggaaagaaacttttttttgaatgcttaaggcagtgtgctgggcaattgacatatttttcttcatttaatactcactacaacctgtaagaggtaaatgtttacattttacatatgaggaaattcaaagttagagagtttacatagacttgcccaagttcacaagcatagaagcaggtagtgaagtctagattgtcttattttaaaagccatgctctatcctctctattactctgtcttcttcaagatcagtcagtgaggtatttccaaacttttaagatttttcctttgagagctgggcgtggtagctcacgcctataattccagcactttgggaggccgaggctggcagatcactcgcggtcaggagttcaagaccagcctggccaacatggtaaaaccctgtctctactaaaaatacaacttgaacctgggaggccaaggttgcagtgagccaagattgcaccactgcactccagcctaggtgacagagtgagactccatcttaaaaaaaacacgaacagaaaaagatttttattttgggtaaagaaggtgaaatccaatacatgtacataatgtctgtcttccacagcttggttttttatagttattattttagtcgtaagctattaaaggcagatattattcttcctcattttacaggtagataggataagtcataaagtgacttggcccagatgatacagcctgatgttgatggagtcaggaatataagcaagtcttctgactctttctccaaggcttatttcatgagacagtatattgctaacacagcatactatgtgtaacttatgcagtcataaatgtaaactattcattcagtcataaacagacactgagtctgtgtatttacatggtccagtatattatttatttaacatattgtccagagcctctttaaaaattgtttttggagatatttttaggaagaaatgttagtgaattacttgtataactggagagctgatgctatgttttctaaaagtaaactttataaattaatagcataattttagccactcactaagtggatggtatttattaactcatatttgttttattacccagacaggtgtacaatttgttcatttgtccattgtttaattcattgagaacacctagagaagatgtttattttcaaaccttgaccattaggctttcagaatatgtaaatgcccaggttttgtacttaaaaaatagccattatagccagttagtttctatgtattgctttgtctaatttccatttaaaaaatctgatttgattcacaagtttatctctaaaataaatgcggagtttttttttttttttaaggaggtgcctaaaaattttgccatggcatggactttaaagaattgaaataataaacaagtgcagagttcctgtttagttttctttctgttcattgccttccaagagcctgagttgtttgtagaggaaagttgagtaaggataaaaacacttatttggttgaagttttagaactaaaatagatttctacatagagcttccaaatcggtgttatttttatatttatttatttttaaggtcttgctatgctgcttaggctggacttgaactcctcctgagctcaagcaatctttctgactcagcctcctgagtaactgggtctacaggcacgtgacaccttgcccagtttcccattagtatctttttttgttgttgtttgtttttttggagacaggctcttgctctgtagcccaggcacaatcacagcctcctgcagcctcgacttcctggactgaagtgatcctcccacctcagccccctgagtagctgggactgtaggcgcttgccaccacacctagctaatttttgtattctttgtagagatggggtctcatgatgttgcccaggagttctagactactgggttcaagccatcctcccaccatggcctcacaaagtgctaggattacaggcatgagccactacacctggcattcaatcaatatctttttttaaaaaaggtatttatagattagtaaatctataatgattacatggttagatgattaaatagaaaagaatagcaaggtcagattataagatggtggttttcacagctgggaagtgttaaaaatacatttactcttttttgattcaataattttggatgcttttgtattctttgggtctcattaaatgttagtgaaaactgatgggatccttcattgactggtaagatctctctcttcctctcatttttttggattgcctttttttgagatgaggtctcactctgtcacccaggctgaagtgcagtggcatgatctcagctcactgcaacctctacctccctgactcaattgatcctcccacatcagcctcctgagtagctgggactacaggcatgtgccaccaagcccggctaatttttttattttttgtagagatggagtttcgccccagccatgttgctcaggttagtcttgaactcctgagcacaagtgatcctcctgcctcggcctcccaaagtgttgggattacaggtgtgagccacctcacctggtctacccaagaaattttaccagagggaattttatatagggagtcagttacacagatgtggagaaggttgaaagatcagaaaagggatactgagacaacctagatagagtgactgcaggaggcagctggaccaccaagtccaggtatgggtggttccttctgcttgacgaggaaaggagcccagggaaagagcagactcatagcttcagtgagaagggtagggatgtagaggtcatgattcccattccaggccaagaagcagcagctagaacacatctaccagggaaagccccctgctgaccaccaatgggcacaaaggaaagtgatagaggaacaaaggaaagaggctgatggaggttgaggttaacagaactttatttgtagctcagcggaagagccctaggaacttggcaccagacatatgagaaggaagtcctgttcagctgataatggtagctttggcaggatgtggagagacttatggaaaaggtgccgtaaaaaaaaagctagaagctaacatcagtggttgatgctaaaacaaaatgagtgccagtgttggggtgatatgtcactgctagggtgatgttgataggatcagtgtgcaaactgcaagaagataggggtgtgtgtgtgtgtgtttgtgtgtttgctgccaaagtttttgtttctgttactggtcataaggccatagttgatactgtgagtttcttctttcactatttattctgtattccctgttttcagccagcacctcaaatggtcagggtttttttttgtttttgtttttttttgttgttgttgtttttttacctggtgaagcatctttcaccttcatttttgaagagtcagaatcctcagtttacctgctttttgattagttgtaattttccattcttactagacatgccccagaaaatctcctgggctccagtcatagtccatagtgtagcagcagcccaatttttttcttggtaatcaggaccagtcactctatccggtactccttccctaggtggtaattcagtgccatgaggagtacaaaatggccaagcaacattctcaagttccaattcaatggaagtgttgtggaaatgttacatctttgggaaccatgatttctgaaccatcagcacccaaagttgtaggaggcaaaagtttagtaagctgttaggcatgtaagaggaatcactgtcaacacttaattcccatacatgtgttttctggcagtatgaaaaatagtgtggtgttttggacactgatataaagcatttataccacatactttaaggaggacccccaagctttgaggttgtctcctaaccagtgtcataactgaatctttagtaagtcattctgttgttctgccaagctagctgctcctaggtaatggcatacacgatgatcccagtgctgcacttcttttgctgtgaaacaagttccttagttagaaccaaggttgtgtgggaagccatcaatatggtattcgcaaagtccatgaatggtggtcctgacagatgcattgctgtcaggcaagtcaagttcctatttagaaaagtgtctttttcagagaagatagatcactgccccctccatgatggaaatattttattaccaggtccctgggaaatggcaccttattggggactcaatattagtctgtgtcatttgcagtttaggcactccatagtttctctagctagatgcagccttggtgaggggcagtccatgttgtggtgtccatgcttaacctccatctctgttgacatggccacattgtacattaatgcatcaagcagcctcagtagcaagggaaaaaaagctgactgaacaatgtcttcttatctatgttattaagatcctttttttaaattgcttagcctttagagaatattcacttaagaaacaaatatatttagccaggtacggtggctcacgcctgtaatcccagcactttgggaggccaaggcgggtggatcgcctgaggtcaggagttcaagaccagcctggccaacatagtgaaaccctgtctctactcaaaatacaaaaaaaaaaaaaaaaaaatagctgggtgaggtggtgggcacctgtaatcccagctacttgggtggctgaggcaggagaatcgcttgaacctgggaggcagaggttgcagtgaggcaagattgcaccatttcactccagcctgggcaacaagagtgaaactctgtctccaaacaaacaaacaaaaccaaatatgtttatattctgtgtgcattctaaaggatctgttttcatatctcttctctagactttcttgtcacccagttttccaattttattcttttcaggacctgaacagctggccaacccaccatctattgcctatgattcaatgtagatttatacctcaggctatctctccttccagatgaagtggtgaacgtagtacaacattaagttctccccagtggggggcttttctttcactgctgtctttcagggttatcattgattgtggtcgtagtactacagcagtgtaattttggctggtgccagcatattttacataatcattttttctcttcccagtccaaatttttttttcctcagttaacttagttatttcttatttattgttgggaaatacaaagtacagctttcaccttcatgtgctttcaaccactgcattctagaaactttaccaaggtggcagcccttgtatttttgtggtgtgtgtctgctaatccctaacatgcatgcgtcctaccaaagtatcaaagtataggtttagttttccttatttgaagtgcataggaccagaagtatttcacatttcagtttttttcagatttgagaatatttgcattatacgtactggttggttgagcattcctaatctaaaaatctgatatccaaaatgttccagtaaacatttcctttgagtgttaatgtcagtgctcaaaaagtttcagattttggaacatttcagatttcagacttatggattagggagacttaacctatacttgctgcttatgcaattcaggaccaatctatgttgtcatcagtgtagtatcgttctttggaatgtcaagttaatcaagatctctatagactattattatgacaaagagcgggagagttgatgtaatctttaggaagacaatgaaggtattagtctaccctgctgtgtgaaagcaaaatgcacgtcccagtgcttacaaattagtatagaaaataaaacacgtatgcaagatcatttgtttccagtggtcccttcttacgttacagtcctaactccatggatcaggaaagcaatatggaatatctaccagttaccgagtgtgtttttttctattatacctccagggcctagggaaataactgcaggatagactgactgactgatcaaatttactgtgagttgatttgggccaaaacttcacttccaattctaatttttcacttttgtaaattccccagtaattagcatcattttagagttagcatctagtaatctcctaaaaatctggatattttctttttattggcacacagatactctagtaaacagctgcaagtgtcttaatggaaatcttagaggaaaatttacaataagtacctgtggcactgttgtgttttaggggaccatgcctcatttaatccaggggctttatgtctgtgaaccaacttgtgtttggaaaccggaagtgactgtggttctccacagtggtcactgaagtcaggatttaggctaccaagtctggggtttctactgtttatagatcaagtagtattttagtagactgacctttaattttgttccttaaaaataccatgctcagttcgagactccgccataaaaaaaaagaaaacaaacaaaaacaaacaaaaaaacccatgctcagttaagtacttctaaaggtctctgcaggtcttgtacatcacaaccttctgattgccactttctgtccatgctgtgcattaacatgattgttcttaccttttctctgtcaaattttgccatttgacctctgccattctggaatctgattagcttgttcaggagtctttctcaatcgtgtcatctccccatgtcattcccaactcacagaaaacagtcaccacagagtttttcaaatacagattcccttactaatgtattttaaaatgctttaatgcagtatcctccaggacctcatggatgatgtataggatggtatgtatatattcaggttatacatggtaaatctacttcagcattcctgtttctttaagcatctatatttcttctgcattatgctaggaaggttcaggcatctcatcctcatgaaatgtggactcttttgagagttttcatttagccaatagtaaactattaagagtttaagctaagagctttcacagaagtggaggctagccttctcagtcatgggagaaggagctgttcacccaggtatcctcattccatatcttagggcctcactccttccaaaacaaaggaaacttagaaagtatgtttattcaactttcaccataattctacaatctgcaaaattaaattttggacccaattcttggcagagttgtacctatggttacaagtaagaaacttttaaaaaggctatttttaaaattttgtagctatcttgtcatgacctgagctgaaagttaaaaacttacaaactctgtatcattttcttttttaagtctccgagtcagaagcagccatcctcgagtccttggtgtcattattaccatcaaaatagtcaagtcagacagtcatatggttgtcttagacacttgtttcaataggcatatcatcgtaattagctatgggtgataatgcaaaaatcattatgccaatgcatggaatggatcactagtatcccatttattattgacaaggagctagcagtgaattgaaggtcaaggacacataatcaagccaattcttgaatcttgtccttgaaagtatgtttcctgggaactcttcactgtatcaggatccaatcaggaaaatgaaacatgctagatatttcagcagaggaaatttaaggtaggattggttacataggtatagaagactgaaagagcaaaaagtggtaacatggatatgataaatgccagaggaagctaccactgttaggtttagggaacagaggggttaacagaatcatgaagcgcagaggagactcatgaagctggggatcagacctctgtgaatgtacactgtccagctgctgctcatgtctaagggaatatcaagaagctggttataagaatgctgaaaagagcagaagacctacagggtgatactgatggaaatgaatgcaagcaggaaaaaagaagtctctcctcccctctttactaatctctactaatctcctcccctctttaactactaatctctagatagtgtctcctcttggtagaatctaacaggaaaccatctagcagaagaaaatacagttttgcagaatactggccccagcatcacagagtagactatatagaaaggtggatttgaagtcaaaaaacagtaagtcagtgactagctttttcttaggtttttcttcagttctgagaagttatgacaagctttagatgtgaaatgtcatcgcacagattctgttcatagatatttaagagctcactttggatttcagctgtggcattctttcctgcctttggacattttcttggttcccatgtttttttgtacaagattactttctttgaatttaacaactaggagaaagggtagatttttgtcttggatcagtgattactggagtatctgagctctgttgattgaaaaactaactgtttttgaactttttggagtatgatttacaatgagaaatacttggagtcccaaacacacatatacatctatgtaacagaataaaaagttttatggaacaatagttggtcctgttaagtgacacatactgataatttctattctaatctttaaaagactgatcacaactcaccaagtcgactatgtaatctatagtttgatgaacactgttcaaagcaatagtatgaaggaaattaaatataaaataaatataaatataaatatttttctgcttaattgtatgaacaattgaacattgttcttaaattcaggttgagaggaaagatgttttagagctggtcttgagttctagtggtcgtggaagatacatacaatactgatgttacaactgaaacactcctatggttctctctctccccaccaccttctctcagagagttaaaaaaaaaaagaagtggcaatacataagataaattaagtcagagaaaagtcaaattttaaaataattattcctctactcgttagtttggcaaatatttgagtgcctcctatgtataaaatcttaagctcagggcagaggatacagccattaaaaacacaaataaagccgggtgcggtggctcacgcctgtaatccctgcactttgggaggccgaggcaggcggatcatgaggtcaggagttcgagcccagcctggccaatacagtgaaagcccgtgtctactaaaaatacaaaaattagccaggcgtggtggcgcacacctgtagtcccagctactcaggaggctgaggtaggagaatcacttgaacccaggaggtggaggctgcagtgagccaagatcatcccactgcactccagcccaggcaacagtgtctcaaaaaaacaaacaaaaaacaaaacatacaaataagagctttattcttgtggtacttatattccagtggagacatagatgtcaaatcattaatcatactactaactttatagttagtagtgtggaattagacctagtgccctgagttgaaaaacattcaatctgagatatgaaaggttgagtataatttgttagaagaaagatagaagtggatgggtaatggaggaaaggatattcttagagggaatagcctgtgttcctctgtgaaacgggaatgattaaggtgagagaagaaatgaaagaccatgcgcctgttagcatagagggctggagatagtgtagcacaagaagatggaaagctaggtaggattcagatcatacagggcctcatacgccactttaagtatgtatctgaagagtaaaggagagtagggttgagaaagagaatgatatgaagacatttgtgtctttaatttcactctaggggcatgatggaatggaattcagtgttgcaggagtacatataaagggattagttaggaggcaattgcattagttcatacaggaggtaattgtggcttggactagagtggcagcatcagagggtaaaggtggatgacttatacaaaacatacttaggagatataatttaaaggactgattaggtatgtgggatgaaagagaagaagggatcaaggataacaccacaggtttctggattgagttgatactaggagtaatggaggagggtcagacttgaggaaatactaatgaactaagctgtggacatactgagttgggggtccgggatcttactaagtaccagatgttgtgcaaatataattattgttcccattttacaaacgggacagctattaagtgggtagagccaggatttcatttttactttttaagaagggagagatttgaacatttttaagtgttactcaaaagaatccagaagagaaagagatgtcaaagatactggatataaaagggataatacttagtgtagagctaatgaggagattattttagcctgggtacagtggctcatgcctgtaatcccagcactttgggagtcagaagtgagaggatcacttgaggccacgagttgaagactagcccgggcaacattaacaagactccgtttctacaaaaaaatacaaaaatgagctggggcttggtggcatgcatgtgtagtcccagctacttgggaggctggggtggattgattgctggagtccaggagtttgaggctgcaatgagccaagattgtgccactgctgtccagcctggataacagagagagaccccatctcaaacaaacaaacaaaaagaattgttttagattttgaacagattaaaaaaatgatatcccctctattttataggaagtgagaaagagagagtgcttatgtgggcttgtttgtggatttgatgttaagaagataagggaaatttctcttgatggcttttgttttcttggcaaaatggaaaaagataccttttaacactgagatgtgagatagggagaattggggagaattgaggtttaaggactgtaaagtttcaaaataatccgtggaaagcagagttaatgagtcaaataatgatccagtgagtaaatgagagtgagtgaagaagacactgttcttaatttaccgagttaaaaatgatgttttaccaatattataacaacacaaggtaaaaatctgattaaatgctaaatgatatgatactgctaataaacatagaaaggcaaggatgggaaggagagtaatgtggccttcagtcaatgggaaagattttatggaggaagtagaactcaagtctggccttgacacacatgtaggtaaacttacttgataggaagaacaacacaagccaagtatggagagggtccctagtagtattctgtaatgatttagttgacaataatccttcttttatgtcaacattttagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggtaaggtttttcctgccataaagccttcacaaataaataattaggtaaacattcaggttatattttttttatttctagttgactaccagtgcaagaagggaaaaaaagcaagttgaaactggtaactttccaatactgattattatgctttatttttaaatactgtgttgagattgaggtaagtttgagaataattttttttgttccatgcaagtagaatggtatacaatgctgttttagggctgatgcaaatcaaacatctaagagctttaaaaaaataccctaatcaagtacattgcatatcacactttacaactgagacttactcatttttcataggatatatcttgatcctttttgtgctgctataacaatacctgagactgggtaatttataaggaacagaaatttattttctcacatttctggaggctaagaagtctaagattaaggcttagaaggtttgatgtctggtgagggctgctcactgtttacaatatggcacgttgatgctgtatccgcctaagtggggaacattgtgtcctcacatgacagaaaccagaagggcaaaagggacagactcccttcatcaaactctttttataagggcatctaatcccattaacaaagctctcattgcctaatcaccttttaaaggacctgcgtcttaatactaccacatagacaatacctgaatttgggtggggatacattcaaaccatcacactatgtttaatgagaaatcagacatgagacatgtttccatcacttttctctctgccagttgaaaaaatgctgtttttcaaaaggaggtgaaagtatatgcctgccatttctggacagactttaccaagttactatagtttaactatgttgaacttacatttgattcagattatctgatccattttcattgtagaaccacatattaattttctcttaatgtggtttaccttaaatctgaattctagatgtttctggaaatttccctgttttccttttaggggagatccttgtagaattttatttcattaattgagtcttggaaagcaaagctgttaaactcttaacagttcattcccaaacactactcagattatgttattccttttcttaaagccattcaaaagctttccattgattttaggatataattcaaatctttaacatggcctataagtccctgtttgatcaagcccctacctgcatttctagtttcatctatcaccactctcctagttcactatgcctatgccataatggacttatttcagtttaccaaataggtctgggcctttatacttgtttcttcttctatgtagattattcttctagataaaccccttcaccctgtacccatttgcatgcccccaaatattctcctgtagattgttttttatttaaaaaaattttggtaaaaaacacataatatgagatttagcctgtcaatatatttctaagtgtacagcacaagattgtttatgcactttttcatcttacataactgaaactctgtacccattggatagcaactttccattttcccctccctcaaactcctggcaactgccattctatcttctgtttctgtaagtttgactataaatacctcatagaagtggaataatgcagtatttgcccgctgtgatggcttatttcacttagcataatgtcctcaatgcttatatatgttgtagcatatagcaggattttcttcttcttaaaaactgaataatattccattgtgtgtatatatcacattttttttagtcattaacatcataaatggacatttaggttgtttataccttttggctgttgtgaataacgctgcaatgaacatgagaatgtgatttttttttttttttgagacagggtctcacactgtcacccaggctggagtgcagtggcgtgatcgcggctcactgtagcctcaaactctgggctcaagcagtccccctgccttggcctcctgagtagcaggactataggcgtgtgccaccatgactggctaattttttttttttctttgtagagaaggagtctcacttactttctttcccaggctggtcttgaactcttgggctcaagtgatcctcctgcctcagactcccaaagtgttgggattataggcatgagtcactgtgcccagccatgggagtgtggatatttcatagaaatcctgttttcaattctgttggcagtatgttcaaaagtgggattgctggattagatggtagtttaatttataattttttgaggaacttccatactgtttcctatagcagctacaccattttacattccaaccccaactttgttaacacttattattttctgtttttcttttctcttttctttcccttttcttttctttccttttttttttgtatagtagccatcctaaaagatgtgaagtggtagctcattgtgggtttgatttatatttgtctgattagtgatgttgagtatcttttcatatacctgttggccatttgtatgtcttttttggagaaatgtctattcaagtcctttgtccatttttttaaatgggttatttgatattttattgttgagttatagaagtttttctgtattttgtattttaaccccttattagatatatggttcacacatgtttcctctcattctgtaggttgcctttttactctgttgtttacttttctgtgcagaagctttttaatttgataaagtcccacttgtctattttttctttcattgcctctgcttttggagtcatttccaaaaaaccattgccaagatcagtgttataaagcatttcctctcttctgctttcttctacaagttttatagtttcaagtctttttttttttttttttttttttgagatagggtcttgctctgtcacccaggctggaggacagtagcaaggtctttgctcgtatagtttcaagtcttatgtttatgtctttaattcacacaataccatgagatgatgtttgtgtatgttatgaggttatgaggttccaagttcttttgcatgtggatatccagttttcccagtaccattttttgaagaaactatcctttccacattgtggggtcttggcactctagtcaaagatcatttgactgtatacgtgtgggtttatttttgggatttcagttttgttctattagttggtgtgtctgtctttatgccactaacaaactgatctaattactctagctttgtaatatgttttggagttaggaagtaggaggcctccagctttgttcttctttctcacaattgtgtttggagttccttgtggttacttatgatatttaggattatttccttatttctgcaaaaaataccattgggcttttgatagagattgcattgaatctgcagatcactttggatagtatggacattttaacaatgttaaatttttcagtccatgaccatgggaagcttttccagtgtcgtctttaatttctttcagcaatgttttgtagtttttagtggacaagtcttttgtctctggataagtttattcataagcattttattctttttgaagctattgtaaatgggactgttttcttaattttcttttcagattgttcagtgttagtatatagaaatgcagctgatttttatgtgttgattttgcatcttataaaagattgatgaattttgtattatttattagttctaagttttttttttctttggtagaatccttagtgttttctacatataatatcatgttgtctgtaaacaaagatagttgtatttcttcctttccaatttggatgtcttttgtttttcttgcttaattgttctatctaggctttccagtactacgttgaatagaagtggtgagaaggtatcctagcttgttcctgatgttagaagaaaaccttttagttcttaacccttgaatatgatgttagctgtgggactttcatatatggcatttattatgtagaggttatttccttttatttctagtttgttcagtattatgaaaatatgttgacttctgtcaaaagctttttgtttattgagatgattgtgtgacatttatccttcttgcttttaatgtggtgtatcacattgattgattttcatatgttgttgttgttgtttttgagatggagtctcactctgtcacccaggctggagtgcagtggtgtgatcttggttcactgcaacctccgcctcctaggttcaagtgattctcatgcctcggccccctcagtagctgtgattacaggcacacagccaccatgcctggctaatttttgtatttttagtagagatggggtttcgtcatgttggccaggctgttctcaaactcctgatctcaagtgatccgcccacctcagcctcccagagtgctgggattacaggcgtgaaccaccgcgcctggccgatttttttatgttaaataatcctttcatcccagggataaatctcactttgccatggtgtgtaatccttttaatgtgctgttgaatttagtttcactttcaatgtgctgttgaatttagtttcgctaatattttgttgaggatctttgcatctgtatttatcagggatattggactgtagttttcttttcgtctgatagcttctttggctttggtattgatgtaatgctggcctcgtgaaagaagttaggaagtattccctccttcagtttttcggaagagtgtgagaaggcttggcagtaattctttaaatgttcggtaacatgccctaatgttaccatctgcatgtttctttgttgggagatttttgattactgattcactctctataacagactagttgtatgtctgttcagattttctgtttcttcacgattcagtcttggtaggttgtatgtttctaggaatttatccatttcttctatgttatctaatttgttggcatatgatttttcatagtagtctgttataattatttttaatttaatttttctgtttttttcttactctagataaaggttgatgaacttggttgatctttaaaaaaaacactcagtattgttgatttttttcctattatttctgtatattaaaatatggtataaaaagtaacaccttaatgggatgcttactatgaatggagtgtgcagtactggaagttgctctcaatgagtgagcagtgagtgaatgtgaagacttaggacattactgtacattgatgcagactttataagcactgtactcctaggctaccctaaatttattaaaaaatatatttctttaataagaattaaccttagcttactgtaacttttctactttataaattttaaaacttttaaaactttttgaggatgggcacagtagctcatgccagtaatcccagcattttgggaggcctaggtgggaggattgctggagctcaggaatttgagaccagcctgggtaacataacgagaccttgtctctactttaaaaaataaaaataaaaaattttttgacatttttataacaccttgctgagaacacacattgtacagttgtacaaatgtttttttctttatatcctttttctgtaagcttttttgttttgaaattttttaattattattttttaacttttaaaacttttctgttaaaaactaagacacgaacacacacattacctaggcctaccacagggtcaggatcatcaatatcactgttttccacttccacatcttgtcctactggaaggttttcagaggcagtaacagacatagaggtgtcatctgctatgggtaatgatacctttagaatacttcctgaaggactagcctgagcctgttttaccgttaacttaaaaaaaacaaaaagaaagtgtatactttaaaataacaataaaaagtatagtatagtgaatacataaaccagtaacatatgtattatcattatcaagtattatgtactatatacgattctatgtgctatacttttatattactggcagtgcagtaggtttgtttataccagcatcaccaaaaatttatgaataatgtattgtgctacaatgttacagtggctaagatgtcactagatgataggagttattcagctcaggaccaccttggtataatatatgtggtcattgttgatggaaacattgttatgaggagcatgactgtatctgtgacttttccagttttccttctgttattgtttagtttttgcttcattttattttggttgcgaaggacacttaatatgatttcagtcatcttaagtttaagacttttttatggagtaatatgtgctatatcatagaatattctctgcacttgagaagagtgtgtattctgctgtgatagaatggatgttcagtatatgtctgttagatctgtttggttgatagcattgttcaagtcctcagtttccatattgatcatctggtctggatatttctattcattattgaaaatggggtgttgaaatctcccactataagtatgttggtgtctgtttttcccttcagttttgtcagtgtttgcttcatatatttgggtacttcagtattggatgcatatatatttatggatatcttcctggtgaattgaccattttatcattatataatgtctttctttatctcctgtgacagttttttacttaaactctatttcgtttgatataaatatgacaccccctactttctttttattaccattcccatggagtatctttttttttttctttttgaagtgattttacttttatttacttcactttaagccaatcatgaaatttcacagtgatttctggggtggaggcagaaagaaggtggtggtaagaatcactgaggctctggcctagttggccaaagaggtgcaggcagggtagaccctcaccggggcacccggaggagtattgactgccctggcagcaggtaaatgatgtcctgagagtgtgagagctggtactcaatgtcctctgtgacttccatcttgcacagttcaatcaggctgtcacccacagtggccagtgagttggcaatcagctaagctgccttggagtcacccttggcagagatgatgacctcctgttcctgctgctcagccttttccaccacaattctggccctgtctgcttcctgctgagccatgtgtttggcttccaccacttctgtgactcctcctgaaggtaagatgcatcaaggacacgttatccaggataaacccaaaggtggctgctcactccgtaagtccatcactcacctgtgtggagaccagctccctcggggtgatttgttctccagcatcagagcaagtcaccactgacttgaggatttctgtgatgataggtggcagcacatgctcatcatagtcctctctgatactgatgaagatgtgaggaagctggctagagacaggctggaagaggatgtgcagttacactgacattctgtaaatttttgctaccagtgatgattggcatgttgtgtggtcaagagtgaaagtcaaagatcattggtttccgtacccaggggatgagaaagtgagtccctgtctctaccggtgttgtgtgctccatgggatcggtcaaagatgatagctctgtacccagcatccacattatatgaggcagagttcaccacactttctggtatggctaaggccaggtcaaacttggtgatggactaaaaccctttggcagctatatttccttctgctggaccctctcacacctgcttccactctgacctccacatgaattccccagctatacattggggtatctttttgtatcttttcattttcagactttgcatgtccataaatctaaagtgagtctattgtaatcagcatataattgggtcttgtttttatatccattcacctactttatgtcttttggttgggaagtttaatccatttaaatttaaagcaattactgataggaaaggacttactgtcaacattttcttatatgttttctgtcttgtagatccccctacacttcctcttttacttcctctgtgtgtgtgtgtgtgtgtgtgtgtgtgtgtctgtctgtctgtgcatgtgtgcttgtagtgatatgctttgattccttttttttctttttctttttctttttttaagagacaggctctcactaagcggcccaggctggtcttgaattccctggttcaagtgatccttctgccttagcctcctgagtagctgggatgacaggtgtgcaccactgcacccagctcttttctaatttttaaaaaatgtattatctatggtttccataagacatcttatagttatatgaatctattttaagctggtaacaatctaacttcagtcacatacaaatactcttttacttccctccacccccaaacgtttttttgttattggtgtcacaaattatattttttaaaattttgtattcatttacatattttatagagtattttatatataattttctatatttatctcatatctaaatatatatttagatatcaatatatacagggagattgatagtatcttcccgcctgctaacacagtatcagttctgcagcccatggatcatggagtaatttcaaatttcaagtcttgttattcaagaaatacatttcataaggctgtagctgccatatgtagtgattcttctgatggattttggcaaagtacattgaaaaccatctggaaaggactcaccattctaagataccatgaagaacactcatgattcatgggaggaggtcaagatatcaacattaataggagtttggaagaagctgatttcaaccttcatggatgactttgaggagttcaggactttagtggaggaagtaactgcagatctggtagaaatagcaaaagaattagaagaggagcctgaagacgtgactgaattgctgcagtctcataaaacttggatggaagagcaaacaaaatggtttcttgagatgtaatctattgctgatgaagacgctatgcataaacatggttgaaatgacaaaaaaaggatttagaatgtgacataaacttaattgataaaacagtggcagggtttgagagaattgactccaactgtaaaagaaattctagtgtgggtaaaatactatcaaacagcatcatatgttacagcaaaacttttcatgaaaggaagttaatcgatgcagcaagctctatttgtgtgtgtgtgtgtgtgtgtgtctgtgtgttttgtttttttaagggatggtcttgctctgtcactcaggctgaagtgcagtggcacactcttagtttactgtggccttgaactcctgggcacaagcaaattttctactgtctctgccagccctgagatagcaagaccaacccctccccttcctccttctcttcagtttgttcaacatgaagacagtgaggaagatgatccactttcacttaatgaatagtaaatatattttggatttcttaataacattttcttttctctagtttattgtgggaaatgtatatataatgcacataatgtaccaaagatttgttaatcagtggtttatgttatcagtaaggtttctggtcaacagtaggctattagtaagtttttggagagtcaaaagctatacctagatttttgactgtgtggaaggattggtaccctaacctccccacccccattattcaagagtcaattatatgtaaatattaaatttatacccttggaaccaccaccacccagatccagatagagaatatttattgcacgttagaagcctctctcattcctcctactagcaatttaatctcccctctgaaaccactgttttgacctttgtcaccttggattgcatttgtgtattttgaccttcgtataattgaaatcatacattgtatactgtgtttaacttctttcactcaatattatgtctttgagattcaataattcattcattctaattgctatgtagaattctattatatgaaaataccataaattacccattctactggtgatagatatttgggttctttctagcgttaccaagctgctgtgaacattcttgtacatgtttttggcatacataaacattcttcttttgaccttcaagtggagctgctgaatcatagcgtgaagatatatgtttgtttagagttagcaggtgtagcaaaacatttttataaaatggtcgaaccaatttacttccaccagtagaacagggttccagttactccctatccttgccatcacttaatctggttaatcttttcaattttagtcatattcctgatcctttctgaatttcctttttttttttttttcttaaaatgaattcaggttccaaagttcattttgaatttagccctcataacaggctggaaatcttttttctaacttggtagccatctgcattcttatttcagattgattgtccaaacttatcaaattttcttagctgcattgaggatacctctggtatagtttaccgtatctgtgttttttcatttttttccagtttaaggtccccttgaaaaaatatttttatagtgttgacttaggaaatatataataatgaaatgcagttacaaattcactatggcatttttgaattcatgtgacttgaaatgatttttttctcttaagtgacagagtcttgctgtgtcacccaggttggaatgcagtgatatgaccatagctcactgttgagcttgaactcctaggctcaagtgatcctcccacccacctcagcttcccgagtgctgggactacaggcgcacgccaccatgtttggcaaatttttttttttttcactttttgaagaaatggggtctcattttgttgcccaggctgttcttgaactcctggcctcatgtgattctcctgccttggcctcctaaaggactgggattacaggtgtgagccaacttgacagcctatattatttattttattttttattattatcatttttgtagatggggtctcactatgtgcccagactggtcttgaactcttgggctcaagcaatccccccacctcagtctcccaaagtgctaggattagaggtatgagctacttaccctggctgattctgtatatttttttttaaatcaccaaacttcctctgttgacgttttaaaagtaatgttatttatctttacaatatcagttggtcagaattgatgatgcttcttgtttgtatggatttttagtagtattgctaaggcatctcgggtttattagttgggaaccactgaaagggatatgatttagcctttactttcttagtttaatgacaaatatttctattatccaagggggcaaattcagtgccacatcacactttttcttttaaatcttaaaattacctcagatttttttttttgttttaagaaaactggaatgcaattatatattaaataaattttaactgccatcttgttgcatgtgtctgtttcatgtgagtgaatagtgtatcacttcagaaaaaccttgttcttttttttgatggactattaagtattttttcaactaaaaaaaatcctctgcttatttcgagtgtggtgatcagaaatggctggcttctctggattatgtatgttaatgttacactttaaatatattagagagaaaccatataacatgattctctgcctgccatatgattcataataaggtaaaactataatccagaacaaataaaactggaagagctagaagcaggagtagatacatattggtttaaaattcattttgagtccagttgtatttataatgtgtctgtagctgtcttaattgtatttgttttcaaaccgaatgacagcttggctgttcctactctatcatacttgagcataagttagcttttacagtggatgataaagccaaaagtttacgaaaagtgatccctggaagttctttcatatacttctgtgataaagctttaaaatatttccagtcatattcttcatagttatggacatactataaacacagtttgactcaaaatgaattttaaatcagatattgttattatatgatatctacctgctcctgcttcttctagctgttccagttttatttgttctggattatagttattgccttatgagtattatggcaggcagagaatcatgttatatactttctctgttttccctgttggcatgtttgtatgtgtaactagggaaggcatacttaaggataatacttagacttgatagaatttttttctgacttcactgcacttagtcaataaagttttgtgaattctatcacattatgactgaatctctcctttttttttcgtccccctttgttacagttcaaggatttctttgattaattaagataattcccctgatttccatatgttcgtttctttcttcctttagtccatcttttctatatagttgccctgtggtgatttttctaaaacacgcatctcctcatgtgcctttcagtggctctgtatttcctctattctgtttgataaaccttttcttgctttagctttccagaaaactcctacacagcttccaagatcccatgtaaatatttcctcttctatgaagcctttcctaacctttctggacatacagttaagttgaatcatccgctatgatcccataaaattttgtatatgctttaaacatggattttaacacatcttaccctttgtgtttcagattttccttatgaatgttaactcctcacacttagagagcaggtcttattcctctctagattctttattctagcacagtgtttggcacagagtagtgcttgttgaggaaacaaatggctcaataaatgagtatatgaatatatgtgtatatattaattcatccatcacaggaaattttaaaaatgtacactcattaaagtttatgtgaccagcaatagaattattatagatataactcatttcagtgttactgaaattatataaataatattttttctgtagctgtatacatataaataatacaatgcaaagagatgctcaatcagattatgcaccttttccacgttattaccaggaagatgcaacaaggtttgaaagcgagcccaaaggcagctaagaactttgtatcacagtgacacctagtggtaatttcactgggttgttaatgtttttagggtccttattgcagtttcatttcaatacccaaaaccttctgaattctgttttcttatcttgaataaatttaaagaattattttaaagcatttgtcctcctataaaatggtgtctgatgtgaagtattgtgatctctttgagggtagggattattgtatattgttagatctctaagatctagcaatggatttaacctaacatgcagctatttgtttaataaagtttgttaaatcagtgctgttaacaaacctaatttactggagcctagtaggcatagctttaattttgtttttgagatatagcagaaaaataggtctgttattatttgaaccatttatcttattttttctctttttgatctttcttaaagctacttttactatattggatactattttagtttttaagaactcaggttgaatatggaaagatttaaaacatttagcaggtgcattttcagtctgaaaaagtagttcaggttgtttcaaaccaggttttgtcctgaatctataaattcagattctgatctcgactctgtgactcttattagctgtatagtgtttggcaaatgccttatccctcccccacatgcctcagccatgctttatgagtaataaatactagttaaatgttcttctgttattagtacatgtgaaaagaaggaaagagtgacaattttgtgtgtcttgaaagatgctatcagcatgaaatgacaatgaaattgattatagcttgtattttgggggaagaaagacagcaaatgttgtgtgttagtagtattgtttagtctacctgcaaactgatgtctgttgcctccgtgccatcaattgtgtactccccaaataatttattattgggtcattttaaaagctgaataaagtagcatctcaaactgtggtctcaatgtgcatagtttatttatgcgttagaaatattctttaattcagcttcagatttttaaattgatgtttaataagtgtgtatgtttatgaggtacaatatgatgtttcaatacatgtgtacattttagaatgagtaaatacgtatccgtcatctcatatacttaccatttctttgtggtaagacttaaaatccacccttttagcaattttgagtgatacattatttcttaactgtattcaccttactgtgcattagatcaccagaatattttccttctgtctaactgatcaaagagaccctctgattgatattttctctttatccacggagctcactgtatgcctttgcctctggtaactaccattataccctctacttcatatgtggattcagatgtttagattccatatgtaagtgagagcatgtgtgtgatatttgtctttctgtgcctgtcttatttcacttagcagaatgttctctagactcattcatgttgttgcaaatgacagaattttgttcttttttaaggctgaatagtatgccattgtgtatataccacatttttgtatctgttcatctattgacgggcacatagattgttcccatctcttggctatcgtgaataatcctgcaacgaacagggaagtgcagacatctcttcaacacattttaattactttggctgcagactcagaagtgggatggctggatctgatgtcacatttttaaatgtcatacttaaagtaaaaacagagtctcactctgtcacctaggctagaatgcagtgatgcagtcatgccccactgaagcctcaaactcctaggctcaaacaattttccccagctgagcttcctggaatcctttgtccagaacctcaaaatactcacatatttataatccttttttaattgtaggtgttatgttaaagcattttaaatgtaaacttatgtctataagtagcaagatatacaggagttacatctttcaattaatgataccagaatagtacatagggaaaggcagtgggcattgtcttgtagtctttgccattaaatcatttcttgttcttgagtagccttatcccaaagtgcttttgttttttattttaaaaattttattaattagatgttaatgggtgtctaatgatatttattttatttaaagttattttaggttcaggggtacatgagcaggtttgttatataggtaaattgtgtgtcactggggtatggtgtgcagattatttcatcacccaggtaataagcatagtacctgataggtagtttttttgatcttcaccctcctcccactctccactctcaagtagtccccagtgtctgttgttcttttctttgtgtccatgtatgctcagtgtttagctcccacttgtaagtgaaaacatgcaatatttggttttctgttcctgtgttagttcgtttagaataatgccctccagctccatccatattgctgcagaggacatgatctcattctttttttatggctgtggtgtattccatggtgtaaatgtacgatattttcttcatccagtctaccattgatgagtatttaggttaattccatgtcttagctattgtgaatactgttgcaatgaacatatgagtacatgtgtcttttatggtgtgatgattgatgttcctttgtgtatatacccaataatgggattgtggggtaggacggtaattctttcttaagttctttgagagattgccaaactgctttccacaaaggctgaactaatttacattcccaccaacagtgtataagcattcccttttcttagcaaccttgccagcatctattatttatttatttatttatttttcagaatattgtttttactaaggacttttatggtattatacattaaaagacactgattaacttgagaaaaaaatgtttcttgcagttgagcaacatctacaatttttcactattatacttacctacacgtaatctttttctgtatttccctacaacttatccataatctctgctttttcccaagggctctacttctgtcaattttttttgcatttagaagagaaatttcaaaattaaacatagttggcattttgtttgtttgtttgttttttggagacggagtttcactcttatcacccaggctagcgtgcaatggcacgatcttggctcactgcaacctccgcctcccaggttcaagcaattcccctgcctcagcctcttgagtagctgggattacaggcgcccaccaccacgcccagctgatttttgtatttttactagagaaggggtttcaccatgttggccaggctggtcttgaactcctgacctcaggtgatctgcccacctcggcctcccaaagtgctgggattacaggtgtgagccagtgtgctgggcccattattttttgtttttaataatagccattctgactggtataacatggtatctcattgtggttttgacttgcatttctctgataattagtgatactaagcattttgtgtatgcttttttggccaaatatatggcttctttcaaaaagtatctgatcgtgtcctttgcctactttttaatggggttgtttgttttttgctcattaatttaagtttcttatagattctggatattagacctttattggatgcaaatatctcctcccattctgtaggttgcaaatattttctcccattctgtaggttgtgtgattactctgttgatagtttcttttgctgtgcagaagctctttagtttaattgggtctcatttgtcaatttttgtttttattggaattgcttttgatgtctttgttatgaaatctttgccagggcctatgtccagaatggtatcttctaggttgtcttctagggtttttgtagttttaggttttacatttgagtctttaatccatcttaagttgatttttgtatatgctgtaaggaaggggtccagtttcagtcttctgcatatgactaaccagctaccccaacaccatttattgaatagggagcctttccccatttgtttttgtcaactttgtcgaagatcagatggttgtagatgtgcagcattatttctgggctctccattccatgagtctgtgtgtctgtttttataccagtaacgtgctgttatggttactgcagccttgtagtatagtttgaagttgggtaatgtggtgcctccagctttctgcttaggttctttttgcttaggattatcttggctattcaggctcctttttggttccatatgaattttaaaatagtcttttctaattgtgtgaagaatgtccttggtagtttggtagaaatagcattgaatctgtaaattgctctgggcagtatggccattttcataatattcatgcttcctattgagcatgaaatgttttttcatttctttgtgtcatatctaatatcttcatgcagtcttttgtaattctcattgtagagatctttcacctccctagttagctgtattcctaggtattgcatttccttgtggctactgtaaatgagattgtgttcttgaattgactctcagcttggacattgtaggtatgtagaaatggtactgattttcgtacattgattttgtatcctgaaacattgctggagttgtttatcagagctagtagcttttggacagatattgtggagtttcctaggtatactatcatatcatctgcaaacagagatagtttgacttcctctcttcctatttggatgccttttatttctttctcttgcctgattgctctggctaggacttccagtgctgtatatgttgaatagagtggtgagagagggcatccttttcttgttctggtttcaaggggaatgcttctaacttttgctcaattcagtatgatgttggctgtgggtttttcatagatggctcttaatattttgaagtatgtttcttcagggcctagtttgttgaaggttttttgtttgtttttttaatacagagtctcactttgttactcaggctggagtgcagtggcgtgatctcggctcactgcaacgtccgcctcccgggttcaagtgattctcttgccttagcctcccaagtagctgggactataggcatgggccaccacgcgcagctaatttttgtattttttgtagagatggggtttcaccatattggccaggctggtctcaaactcctgaccccaagtgatccacctgccttggcttcccaaagtgctgggatcatagacgtgagccaccacacccagcctgttgagggtttttaacgtgaagcatgttgaattttattgaaagccttttctgtatctgttgaaatgatcatgtggtttttgcttatagttctgtttatgtggtaaatcacattaattgatttgtatatattaaaccaaccttgcatcccagggataaagtccacttgatcatgaaggattagcttttggatgtgcagccggatttggtttgctagtattttgttaaggatttttgcatccatgttcatcattgatactggcctgaagctttcattttttgttgtgtctctgccaggttttggtgtcaggatgatgctggcctcataaaatgagttagggaggagtctctcttcctcaagcatttggaatggttttagtaggaacaataccagttcctctctatgcatctggtagaactcaactgtgagctcatctggtcctgggcattgtctggttggtaggctttttattattcattcaatttcactttactattggtctgttcagggattaaatttcttcctggtccaatcttgggaggttgtatgtttccagaaatttattcatttcttctatgttttctagtttgtgcatagaggtgttcatagtagtctctgagggttttttgtatttctgtgggtttggtggtaatgtcccctttgtcatttttgactgtgtttatttggagctatctctctctctttctctcctgttttttttttaagtctacttagtagtctatcagtcatattctttcaaggaactaattcctggactcagtcttttgtatatttttttatgtctcagtttccttcagttcagctttgattttggttatttcttgtcttctcctaactttgtaattggtttcttcttgtttctttagttcctctaggtgtgatgtgtgatgttagattgttaatttgaggtctttctaactttttgctgtggacatttagtgttataaacttttctcttaacactgcttaagctgtgtcccagagtttctgttacattgcatctttgatctcattagtttcaaagaattgctttaattctgcctttattttattatttaccccatagtcattcaggataggttgtttaatttccattaaattgtatgcttttgagtgattttcttactatcaatttctatttttattgcactggttcagtagtgtgattgctattgtttttatttttttttaatttgctaaggattgttttatggacaattatgtgatggaatttagagtatgtaccatgtacagatgagaagaatatatattttgttgtttttgggtgtagagttctgtagatatctgtcaggttcttttggtctaatattgagttcagattttatctttgttagtcttttgcctcagtgatctaattctatcagtggggtgttgaagtctactattattgtgtggttatcttaagtctctttgtagatctctaagaacttgctatatgaatccgggtgcttttatgtttggtgcatatatttaggatagttaggtcttcttgttgaattgaaccctttagcattatgtaatgcccttctttatctttttttaatctttttggtttaaggtgtgttttgtctgaagttagaatagcaacccctgttttgttctgttttctgttgacttggtagatttttctctgtccctttacttttagccagtgggtgtcattgcacatgtgatggttctctttttggcagcatacagttgggtctttcttctgtatctaacttgccactctgtgccttttaatgggggcttttagcccatttacattcaaagtttatattgataggtgtggatttgatccagtcatcggattgttacctggttattatgcagacttgattgtgtaattgtttgtagggctaatggcctatgtatttaagtgagtttttgtggtgtctagtaatggtctttcctttccatatttagcacacccttaaggagtgtctataaggcaggtctcgtggtgacaaattcctagcatttgctcatctgaaaaggattcatttatgaagcttaatctggcaggatatgaagctcttgattagaatttcttttccttaagaatgctgaatataaacccccaatctcttctggcttataggttttctgccaaaaggtacactgttagtctgtggggttccctttgtaggttacctgtcccttttctccagctgtcttttattttgtcttttatttcgacctttaagaatctgaagactatgtgtcttgggcatagttgtcttatatagtatctcagaggcattctctgcatttcttatatttgaatgttggcatgtctagtgaggctggggaaattttcgcgaattatatcctaaaatatgttttccacgttgcttgctttctctccctctttttcagggacaccagtgagatgtagatgtggtctcttaatgtaatgccaaattttttagaggttttgtttgttcttttttgagtctttttaattttagtctgagttattttggggaaccagtgtttgagctttgggtttcttttctccagttggctaattctgatgttaatactggattgtcttctgaaattcttaaagtgagtttctcagctctatcagatcactttggttctttcttacaatggccatttcatttttcatctcccaaatcattttattgtattccttagaatcctttattgggtttcagctttctcctgaatcttgatgatcttcattcttatccatattctgaattctgtttctgtcattttagtcatttcaacctggttaagacctattgctggggaactagtgtggttgtgtggaggtgagaagacactgtggctttttaaattggcagagttcttacactggttctttctcatctgtatgagctgagcattcagtctttgaagttgctgtcttttggatgtgtggtttttttttttttttttttttgcttgcttgcttgtttgtttgtttttatcttctttgatgcccttgggggtttgattgtggtataaggtgagtttagtcaactgactttgtttcccttcctttggagttgttgggggccaagaatgaatacctgtgcacggtagccctgtgctggatccccagcttcctacccctttggtccagcatctttgtcctcccttcatccactctgaatgccttccctccaaagatctgcttagaatgccccaggcttcctaatgtcccagtctcttggtggcagcagatgttcatcctggctgcagctagttggccatcttcagcacttccccagagtggttttaaacatcttcttggatgggtcctttctggccataagagtctgaattatctctacccatatagaatcttaatttgattttgctcaaagcaataactttcatagtttataaacaaaaagtattctagggggtaatggcttataatgtttaaaagaaagaaatgaatggaggcagtgaatgatttctcatattataaaacatgttaatagaacaaagaagaaatttgcttttgataattgtgcttgagaaaaatccaaatgatgtaatattattgcatgttttgttgcttctgggtaacaggtctgagttttttattgtttctactctgagatgggctaggtctcattttacttttttttttgagacagagtttcgttcttgtcgcccaggctggagtgcaatggcgcgatctcggctcactgcaccctgcgcctcccgggttcaagctattcttctgcctcagcctcccgactagctgggattacaggcacccgctaccacgcccagctaattttttgtgtttttagtagagacggggtttcaccatgttggccaggctggtcttgaactcctgacctcaggtcatccacctgcctcagccttccaaagtgctgggattacaggtgtgagtcaccatgcctagccctattttactctttttaatgttgatattttaaattttacaaagtggtaacaggcagtattaacatgaaatgtgtttagtagttttttcttttttaaatcatgtggaatttgaggtccagaagcccatagagggcctgtaatttggctcagtaatagtcatttagtcatatatagggattatgcttttcatcttagttattgtaagattgcagtaatgtgctacattctgattagaaatggttagtagagctacagtatccaactttcactacattttttttctctgaatggaaataattggactatattaatagccacttgttttataggagcagagtcccctatccttaatgtttagttgccttctagaaattatgaaggtttaatactataaattaaggaataaattccttccaaatgaccttgaaaaaaggtattaaattctgtagataatgtattggttaaaatttgagactctgaagaaaaataaaaacactattccaaatgatctattttttaggcatttaaatggcagatagagtgtgtgtaaagtgttttcagtttattggagtgtagccaactaaactgaatgaccttttgctaattatttctctcctgggcaggcaaatatccacttggaattattgcttacttaggtttgagttagaccttttttctttttgtagccttcttgtcactatgccctggaaaattctagagaaagattgctgttaaaaacataaagcaaagaattgtactcagagcagcatttgcaatatccatattaatctgtaagataaattgttaggtgaaatgatttatggtaataacttggtttgtgttaacatagagccacatgaatgtgaaccaccctagtttccaacgtaaagatagacattttcatgtaaaattgaattaatgtgtccaaaatatggaggaataagctcttgtaaattacatctctgacaggttagtttatctgaaactctaaatctgagaaaacattgaaatttttcttggcagtaatgaaccttagaaaattaacagaatttctacttttgcccttgaaggaataactgatatagtacctctcttcctgctgtacacacctggaaagctggagaaaatatatgaaacaactgcttgcaggcattgggcattaggcagcgtaggcctatgattcatgagaaatgggaaacaagcaaggtgagccctgtagatgcccctgatttctgcatggagaaaatttctatacaacagtccatgaaaaagggaatgtaagcagagcccaacggtcctgcagagttaaagagctaggagattccctgagactgagattggaatgtatagggctcagtactaagagaaagattgctacatagggaaacatgcaggtatctgaatgatgctttctgcaaatctttggctgaatagtaatctctacacgattgagtacgctgaacaattcctcgaccttatacgtaagactagaatactattgaattccttcccaccagaggaaaaagactttgtcgcacacagggtacagttagtactgagaccccagaataaatattttccatattagtaattaaaactgaggaagttaaaaatatttcttaattaataatagtaatgaactccttacatattaacataaataagactcttaatgaaaaataatttttcagaacaaaaaaagtaatgagaaagtggtattctcttaggtgcattgcaaactcttcaatatctgtccatataaaagctggattcttatatctcctcctccatttattctgttgcagtatgttacttctgttgaagtatataaagaaaatgccaccaaacagctatatagttggtgaagggagggatattttaatagtcagataattatggacattcttaattgatagtacactgaaatttgggaaatggtggtttcttaaaagtttattgcaatgtaaaacctgaaaccacttcaatgaaattttaatgttctgttatattaaaatccattggtcatttggaaaatattggttcactttgctatgatattaacaaaatgtcgatacattatgtgatatcaataatttactctgatggatttaacagtttaactgttgaaaaggtcagtgaatatgaagacatagcaataaaaacaatgcaaactgaagcacacacagcaaaaatactgggagctagaggctggagagggaaggatgttgtctgaacgacttctaggcaaatataaaatggtacaatgtatgtctgattagagcccctaaaatagaggagagagtggaaagggggaaattttaacgaataactcaatgctagccaaatttggtgagaactataaactcacaaatctaagaagtttcataacaacaagcaggagtaactcagaggaaaccgcatcaaggcacatcattatcaaattgttaaaaatcagtattagaaaagtcttgaaagcagccagagccagagaaacaaagatacattttatattttattttgttttattttatattttatgtatttattttttgagatggagcctaactctgtcacccaggttggagtgcagtggcgtcatctcggcttacagcaaccactacctcctgagttcaagtgattctcctgcctcagccacccgagtagctgggactacagacgcatgccaccatgccccagctaatttttttgtatttttagtagagacagggtttcagtatgttggctaggctggtcttgaactcctgacctcaggtgatcacctgccttggcctcccaaagtgctgggattacaggtatgagccaacgcgcctggcctacattctatattttaaaagagagatttatcagatgagtaggttgtgaaaattttctcccattttgtaggttgcctgttcactctgatggtagtatcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatctggaattaatttttgtataaggtgtaaggagggatccagtttcagctttctacatatggctagccagttttcccagcaccatttattaaatagggaatcctttctccattgcttgtttttctcaggtttgtcaaagatcagatagttgtagatatgtggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcagactcttttttggttccatatgaactttaaagtagttttttccaattctgtgaagaaagtcattggtagcttgatggggatggcattgaatctataaattatattgggcagtatggccattttcacaatattgattcttcctacccatgagcatggaatgttcttccatttgtttgtatcctcttttatttcactgagcagtggtttgtagttctccttgaagaggtccttcacgtcccttgtaagttggattcctaggtgttttattctctttgaagcaattgtgaatgggagttcactcatgatttggctctctgtttgtctgttattggtatataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaatacccattatttccttctcctgcctaattgccctggccagaacttccaacactatgttgaataggagcggtgagagagggcatccctgtcttgtgccagttttcaaagggaatgcttccagtttttgcccattcagtatgatattggttgtgggtttgtcatagatagctcttactattttgagatacgtcccatcaataccgaatttattgagagtttttagcatgaagcgttgttgaattttgtcaaaggctttttctgcatctactgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtatttgattgaggatttttgcatcaatgttcatcaaggatattggtctaaaattctcttttttggttgtgtctctgcctggctttggtatcaggatgatgctggcctcatcaaatgagttagggaggattccctctttttctattgattggaatagtttcagaaggaatggtaccagttcctccttatacctctggtagaattcggctgtgaattcatctggtcctggactcttttaggttggtaagctattgattattgcctcaatttcagagcctgttattggtctattcagagattcaacttcttcctggtttagtcttgggagggtgtatgtgttgaggaatttatccatttcttctagattttctagtttatttgcacagaggtgtttgtagtattctctgatggtagtttatatttctgtgtgatcggtggtgatatcccctttatcattttttattgcatttatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctgctggcttttgaatgtgtttgcttttgcttttctagttcttttaattgtgatgttagggtgtcaattttggatctttccagctttctcttgtgggcatttagtgctataaatttccctctacatactgctttgaatgtgtcccagagattctggtatgttgtgtctttgttctcgttggtttcaaacaacatctttatttctgccttcatttcgttaggtacccagtagtcattcaggagcaggttgttcagtttccatgtagttgagcagttttaaatgagtttcttaatcctgagttctagtttgattgcaccgtggtctgagagacagtttgttataatttctgttcttttacatttgcagaggagagctttacttccatctatgtggtcaattttggaataagtgtgttgtggtgctgaaaaaaatgtatgttctgttgatttggggtggagagttctgtagatgtctcttaggtctgcttggtgcagagctgagttcaattcctgggtatcgttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccagtatgcaacctactcatctgacaaagagcaacctactcatctgacaaagggcgagtatccagaatctacagtgaactcaaacaaatttacaagaaaaaaacaaacaaccccatcaaaaagtgggtgaagaacatgaacagacacttctcaaaagaagatatttatgcagccaaaaaacacatgaaaaaatgctcatcatcactggctaccagaaaaatgcaaatcaaaaccacaatgagttaccatctcacaccagttagaatgacgatcattaaaaagtcaggaaacaacaggtgctggagaggatgtggagaaataggaacacttttacactgttggtgtgactgtaaactagttcaaccattgtggaagtcagtgtggcaattcctcagggatctagaactagaaataccatttgacccagccatcccattactgggtatatatgcaaaggactataaatcatgctgctataaagacacatgcacacgtatgtttattgcggcactattcacaatagcaaagacttggaaccaacccaaatgtccaacaatgataaactggattaagaaaatgtggcacatatacaccatggaatactatgcagccataaaaaatgatgagttcatgtcctttgtagggacatggatgaaattggaaaccatcattctcagtaaactatcacaagaacaaaaaaccaaacactgcatattctcactcataggtgggaattgaacaatgagaacacttggacacaggaaggggaacatcacactctggggactgttgtggggtgggggggagggggggagggataactttaggagatatacctaatgctaaatgacgagttaatgggtgcagcacaccagcatggcacatgtatacatatgtaactaacctgcacattgtgcacatgtaccctaaaacttaaagtataataataattttaaaaaaattaaaataaaagagagatttaagaataataaatacacagcactttgggaggctgaggcgggcagatcatgaggtcgggagattgagaccatcctggctaacacagtgaaaccccgtctctactaaaatcacaaaaaattagctggacgtggtggctggtgcctgtagtcccagctactcggaaggctgaggcaggagaatggtgtgaacctacgaggcagagcttgcagagagccgagatcgcaccactgcactctagcctgggcaacagagcaagactccatctcaaaataataacaataataataataaaaaatacagacttctatcagaagcagcgcacaccaggaggcaatgcagtaagtgttgaagaaataaaattttcacctagaatgctatattgaacaaaataatctttcagaaatgaagactggagatagttttcagataaaagctataagagatgttaaagtaagcacccaggcagcctgaaagaaaacgataacagatggaagattaagttaatacagagaaatgaagagcactagaaattgtaaatatttggttacacattttttaaaaaccttttctgtatttttaaatttatttaaatgagaattgacatttaaaagtagaaattatagcaatgtattatagcatttgtaaaatgtgtacaagtacaggtatgacaacaataacatgaagaataggaaagggaactagaagtattctgtcgtaagacagatttctgtctgatttgaaggtagtctttgttgagttaaaaatgtatgttgtgctgggcgtggtggcttatgcctttaatcccagcattttgggaggccgaggcaggtggatcacttgaggtcaggagtttgagaccatccttgccaacatggtgaaaccctgtctctactaaaaatacaaaagttaggccagacatggtggctcactcttctaatcccagcactttgggaggccaaggtgggtagatcacttgaggtcaggagtttgagaccagcctggccaatatagcaaaacatcgtctctactaaaaatacaaaaattagctggacatggtagcatgtgctggtaatttcagctactcgggaggctgaggcacgagaatcagttgaatgtcagaggcagaggttgcagtgagctgagctcatgccactgcactccagcctgggtgtcagagtgagactacattaaaaaaaaaattatgttgtaaactttagagcaatcactgaaaccgtgaatacacataatggtcattaagctcagtgttgagatgaaatagagtacttaaaaaatactcaaaaatccccaatgaagaaaagaagatgataaatgaaatagataagaccaatagaaaagaaataagaccatataaataattataatacatataaatgatctcatgttataataaaaggtagagattgttacactgaataaaaaagggaaacccgtttgtatgatatatacaggaaacctgctttataaagtatagaaattgaataaaaactaaaaatgaaaagaactggaaaatatgtatgaaaattgtaatcataacctgaaggatctatgttagtatgggatgagctagactctggacaaagaatattatgaaggacagatggggacatttcataataatgaaactgtagattcatcaagaagacataagtatcctaactgtgtatatatctaataacagagtttgaaatatttaaaatcaaaaactggtagaattgaagtaagaaatggacaaatccaaactgacagaactgaagtaaggaatggataaattcacaattggagattataacactcctgtctcattataatgttcagaacaacagacaaaaaatctgaacagcatagaaaccaatttgacttacttaaaatgtatataatactcctcattataacagcaaaagacatgttcttttcttgggcagttgatcattaaggtagaacatatgctcagtcacaaaacaaatttaaaattgtttaaattaagtgacaagtgttctggcaacaatggaattaagttagaaatcacaagaatttggaatatccctgtatatttggaaattaaacaacatattcctaaataaaccataggtcaaagaagaaatcacaagggaaagtagaaaatattttgaactgaattgtgatgaaaacatgatgatatggtttggctgtgtcccttccaaatctcatcttgaattcccacagggagggacctgatgggaggtaattgagttatgggggcaggtctttcccatgctgttctcgtgatagtgaataagtctcatgagatctgatgattttataaggaggagtttccctgcacaagctctctctctttgcctgctgccatccatgtaagatgtgacttgctccaccttgccttccagcatgattgtgaggcctccccaaccatgtggaactataagtccgttaaaccctttcttctgtataaattacccagtctcaggtatgtctttatcagcagcgtgaaaatggactaatacagtaaattggtactgagagtggggcactgctgaaaagatacctgaaaatgtggaagtgactttggaactgggtaacacgcagagtttggaatagtttggagggctatgaagaagacagaaaaatgcaggaaagtttggaacctcctggagacttgttgaatggctttgctcaaaatgctgatagcgatatggacaataaagttcaggcttaggtggtcttagatggagatgaagaacttgttgggaaatggagcagaggtgactcttgttgtgttttagcaaagatgctggcagcattttgcctctgccctagagatttgtagaactttgaacttgaggagatgatttagggtatttggcagaagaaatttctaagcagcaaagtgttcaagaggtgacttgggtgctgttaaaggcattcagttttataagggaagcagagcatgtaagttcagaaaatttgtagcctgacaatgtgatagaaaagaaaatcccattttctgaggagaatttaagccagctgcagaaatttgcataagtaataaggagccaaatgttaatccccaagacaatggggaaaatgtctccagggcgtgtcagaggtcttcacagcaggccctcccatgacagacccagaggcctagaaagaaaaagtggtttcgtgggctggacccagggtccctgtgctgtgtgcagcctagggacttggtgccttgcatcccagctgctgcagctgtggctgaaaggagtcaatgcagagcttgggctgtggcttcagagggtacaagctccaagccttggcagcttccatgtggtgttgagcctgcaagtgcacagaagtcaagaattgaggtttgggaacctctgcctatatttcagaagatgtgtagaagtgcctggatgcccaggcagaagcttgctgtgggggtggggcactcctggagggcctctgctagggcagcgcaaaagggaaatgtggggtcagagcccccacacagagtccctactgggcaccgcttagtggagatgtgagaagacagccactgttctccagaccccagaatggtagatccacggacagcttgcaccgtgaacctggaaaagccacagacactcagtgccagcccttgaaagcagccaggaggtatgctataccctgcaaagccacaagggcggagctgcccaaggccatgggaggccacctcttgcatcaatgtgacctagatgtgagacttggagtcaaaggagatcattttggagctttaagatttgactgccctgctggattttggactttcatggagcctttagcccttcattttggccagtttcttccctttggaatgggtgtatttatccaatgccggtacccccattgtatctaggaagtaactaacttgcttttgattttacaggctcgtaggtcgaagggacttgccttgtctcagatttggactgtggacttttgagttaatggtgaaatgagttaagactttgggggactgttgggaaggcatgattggttggaaatgtgaggacatgagattttggaggggccaggggcagaatgatatggtttggctgtgtccccacccaaatctcatcttgaattcccacgtgttgtgggagggaccttgtgggaggtaattgagtcatgggggtgggtctttcccatgctgttctcatgatagtgagcaagtcttatcagatctgatggttttgtaaggaggagtttccctacacaacctctctctgcttgctgccattcatgtaagatgtgacttgctcctccttgccttccaccatgattatagggcctccccaaccatttggaactgtaagtccattaaacctctttcttttgtaaattgcccaatctcaggtatatctttatcagcagtgtgaaaatggactaatacacatggcatatcagcatttgtttgatactgagaaattggtattgagagggaaacttatggttcaaatgcttaattacagataaagaaagttgtaaaagcaaggactaaagcttccatctaagaagtaggaaaagtccatttcatttccagccagtatggaataacaggaatcagatttactgtcattcctattacaactaaaaaccacccaaaaggcttagtgggaacaaaattggtaatagtgtctgttcctaccagctagattggaaaacctcataattcatgtggctttggttacactactcagaaggatctttcctcagtggtggagagtactagtacaagattaaatactgcttgggcaatgctgactaacaaatcttaaaagcaaaacacaaaaggattaaattgtgtctaagtaacataactgcatcccaaaattaagctcaggaatatttataggattacaaaaatatccagcacttaacaagataaaatttacaatgtcaggcatccaataaaaaattaccaggcacgcaaagatgtagaaaaacctggcccataatgaggagagaaattgatcaatcataaccaacccaggtctaacctagatgttagaatgagcagataggctgggcacagtggttcacgtctgtaatcccagcagtttgggaggccaaggtgggcgtatcacgagatcaggagatcgagaccagcctggccaacgtgttgaaaccccgtctctgccaaaaatacaaaaattagctgagcatggtggcgtacccctgtaatcccagctactcaggagactgaggcaagagaattgcttgaatcctggaggcagaggttgcagtgagccgagatcgcaccactacactccaggctgggctactaagcgagactatgtctcaaaaaaaaaaaaaaaaaagaacagataatgacattagagcagttattattaactgtattacctgtgttcaaaaagagagagggaaggtttaaaataaggcattggaaatgtagaaatgacccagttgaacaactagagttgaagactgtgatgtctgaagtgaaaagccaccagatgagattaacagcagatctgacattgaagaaaatactggtaaacttgaagacattgcaatggaagccactttgtaaaacactttggtagtttctacataggttctcaagagaaatggaggcatatgtccaccaaagacgtgtacattattgtttatagcaactttctttgtaatagctccaaacaggaaacaaccccaaatgtacataaaccaaattgttgtatatgcatacagtggtatacttattaataaaaggagtgggctattgttacctgcaatgatatggaaaaatctcagttcattttgagtgaaagaatccagaatacattctgcaattccattatgtaaaattctagaaaattcaaactaaggcacagtcatagaaatcaaattagtggttctctagggaagaggttggggatggtatggtggaattaccaaggggcacatggaaaccattgagggtgatggataaattcataacattgattaaggtggtgatttcattgttggattcaattgtttaaacttattaaatttagatttcaaatatgtgcagtttattttacgttaaacacatcttaatgaagccgttaagaccttttgaagaggatgatggttgggtgcagtggctcacacctgtaatcccagcactttgggaggctgaggcaggtggaacacttcaggtcaggagttcgagaccagcctggccaacatggtgaaaccccatctctactgaaaaatacaaaaattagccaggtgtggcggtgtgtacctgtagtcccagctacactggaggctgaggcgggagaatcacttgaacccgggaggcggaggctgcagtgagttgagatcaccccactgcactccagcctgggtgacaaaatgagactgtctcaaaaaaacaaaacaaaaccaaaaaaatgagcaaatcaaacccaaagtaagtacagaagcataataatatgtataagagcagaaaacagtaagtggaaaatggataagtagtagagaaaatgaacaaaacctaaagctgttttttaaaaagattaataaaactgataattattttgctagtgtgaaaaacaagaacagaagagaaaacacaagttattcatattgggaatgaaagaagcgcctacgtacattacatggactataaggtgatattaagaacaaacttatgctggtaaatttacatgaaactctaaaaggttagaaaaattattttaaaggtacaagttaccacattcacagaagtaaaaaatttgaatagctgtacatcaaatatataaattgaattgtcaatcaaaaccttcccacaaaaagggcctggcatggtggctcacacctgtaatcctagcactttggggaggccaaggtgggcagctcccctgaggtcaggagttcgagaccagcctggccaacaggacgagacccccgtctctactaaaaatgcaaaagttagctgggtgtggtggcacgcgcctgtagtcccaactactcaagaggctgaggcaggagaatcgcttgaacctgggaggcggaggttgcagtgagccaagatagtgccactgcactccagcctgggcaatagagtgagactgtgtctcaaaaaacaaaaacaaaaacaaaaccttcccacaaagaaaacctgaaacgctagatggcttttctggtgaattctgtctaatatttaaggaagaactattaccagtccttcgcaaaaaagagagagatgaaacattgcctcatttattttatgaagctagcattaccctaataccaaaattagatagagatttttacaggaaaatatttcttataactatggagggagaaatcctttacaaaatagttgcaaactgaattcagtaaaatataataaaatgtataaatacgtttatagtatacatcatagccaagtaggccatgtggcttgtttacaaaaacatagtaggctgggtgcagtggctcacgcctgtaatcccagcactttgggaggctgaggtgggtggatcatgaggtcaggagttcaagaccagtctggccaacgtggtgaaaccctgtttctactaaaaatacaaaaatttgtcaggcgtggtggcacgtgcctgtagtcccagctacatgggaggctgaggcaggagaattgcttgaacctgggaggcggaggaggcagaggttacagtaagccgagatcatgctgctgcactccagcatgggccacaaagtgagactccatctcaaaacaaacaaacaatcaaacaaatagaaatgctgaatagtgctgaatggccctagcactgctcttgatcgtaggagggaaatacttagtatttagtatttcattatcaactattgtaggttcttcagcaatgccctctatcaagtttacaaagctgccttatattcctactttgctctaagtttagctcttttttttttttaacatgaaatgggtgttgaatattgtcaaatgctttttctcatttactatactaatatggggatgtacagnnnnnnnnnnnnnnnnnnnncttataatccatcactgtacatccccatattagtatagtaaataagaaaaagcatttgacaatattcaacacccatttcatgttaaaaaaaaaaagagctaaacttggagctatttgtttgtacgcatataaacatggataaatctggccaggtgcggtggctcatgcctataatcccagcattttgagaggccaaggcaggcagatcacttgtggtcaggagtttgagaccagcctggcctgcatggttaacccccgtctctactaaaaatacaaaaattagctgagtgtggtgggatgtgcctgtagtccagctactcgggaggcagaggcaggaaaatcacttgaacccaggaggtggaggttacagtgggccgagattgcgccactgcactccagcctgggcaacagagagatactgtttcaaatgaaaaaaaaaaaaaaaagaaaagaaaaaggataaatctcgaaaacattactccaaacaaaggaacccagacaaaagtaatctttagggtgagaaggaggatcagtgtgagtaggggcaggcttttgatctaagaatgtatgaggaaagtttttgtgctatgggaaatgttcttatcttgattgtatggtggttataacactgtatatatttggctaaactcatgagtgagttttattacatataaatcataatccaattaagttaatgttttaaattcttatttatcatgctaatcttctctgtattgttccaaatttagtatatatgctgccaaagcaagcacttaagttaattttttaaatacaaaagtatgctattggattcagtgatttgttcttgatgacatctgcatgtcttcacaatttttcaaggaacgtggcctggggtgggatactgcagtggcagtgccatcttgtggtaagatctttggagttaggtagacacaaatatgaattctggctctgaaacttgctacattccagtactttgttcccctgaattattttggatttcctaaaaacagtaactcctgtgttttgagaacctatactgcccaggtactatgctaggcacttatgtgtatgttatctcattaattgtaataataataatacaactcaaaataacattttttgagttccttagtatgtattaggcactctgcaaaacatttttcgtgaattatgtcacttaatacagcaacccaacgaagtgtttgttctacggttgtcatttccactttgcagaagaagagattgaggctgagaatcgtgtttttttttttttctctgagacaggttctcactctgtcatccaggatagagtgcagtggcaacgatcatggctcactgcagcctccatctcctggtctcaagcagtactcctgcctcagtctcctgaatagctgggactacatgcatgtaccaccatgcctagctaattattaaaaattttttgcagtggtggtgtcttgctgtgttgctcatgttggtctcaaacttctgagctcaagctgtccttctaccttggcttcccaaagtgctgggattataggcatgagccaccttgcaatagagagtaatttttaaaatatgaggaactcaggttgctgtcatgattccagctttttttctattcctctctttctgtggaacaaaaggctatttgtctcatgtgttacccaggctttctgcaagagtaactgggactttaagttaaagtcccttcttgtttttcctttaagaaacttcttttaagtcatgagggctcagagtgttttcaagagtgtaagaaggtggtgtcaggtcttggagattggtttctgagcactggacagacttgcaaatgcataagctcagttccagacaggtacagctctagaaatatcaacctcagccacaagcaaaaaggcaatgtttatatgtgtttggtataaaaactgtgacttatttttctactctttccataaacagaatgattctttgtcagcagtgacatttttgaaggccaagattgattaaagtttttgcttccacaactatagtgttgaaccagaattatttttatgatagttaatcactatccaaagtgctcagatagggatctttttaaggaaagttaaaaagtatcattgagaccatgaataattgcattgtagcattgcttacttaggtagttgtgttcccatagaacttgtgtatcttaagttctccccccactcttctttttcttcatcagcatggaattatttttcttcttttaatatgtaatataatcagtctttttggtattcatgtacttaactgtaaatggaattgaattatattttaatctgaaactgtagactagcagcaacctaacataagcagatatatgaaagataagtacattctgattcactgatctttaaaatagtgtagtgccagaaatcagctgattaatttataagtagatttgattcctgaaaaataattgtggggcacagggaaaattgtgatttctcactgtttctcattagcatcatgtctatttttgcttttttacctttcagtcatttttctttttttcttttcttttttttttttttgagacagagtttcactcttgtcatctaggtgcagtggtgcaatcttggctcactgcagcctccgcctcccaggttcaagtgattctcctgcctcagcctcctgagtagctgggattacaggcatgtgccaccacgcctggctaattttttgtatttttagtagagacagggtttcaccatgttgggcaggctggtctcgaactcctgacctcagttgatctgcctgccttggcctcccaaagtgctgggattacaggcatgagccaccacgcctggcatttttctttactgtatagagtatccttccttattttggtttgtctgtcctttgcagaccaactatacttcaagtttaatttaagtctcatttctctcacaaagctttctctatctgatacaacacatttgtattagtctgttctggcagtgctataaaaaaatacctgagactgggtaatttataaagaaaaaaggtttaattggttcgcagttctgcaggctatacaggaagcatggcaacatctacttctggggaggcttcagggagcctttactcgtggtggaaggcaaagcaggagcagacatcgtcacattgccagcgcaggaggaagagagagaggggaggtggcacacacttttaaacacccagatctcacgagaactgtatcacaagaacagcaccagagggggaaatctgtcacacatgattcagtcacctcctaccagaccccactgccaacactcaggattataatttaacatgattggggatgcaaatccaaaccatattatttcacccgtggcccctcccaaatctcatgtccttctcacattgcaaaatacaatcatcccttctcagcagtcctccaaagtcttacttcattctggcactaactcagaagtccaaagtctcatctgagacaaggctggtcccttttacctgtgagcctgtaaaagcaaaagcaggttacttactcctaagataaaatgggggtataggcattgagtaaatactcccattccaaaagggagaaaatggccaaaagaatgatgctataggccttgtgcaagttcaaaacccagcaggatagtcattaaatcttaatgttccaaataatctcctttgactccatgtctcatatccagggtacaatgatgcaaggggtgggctcccaaagccttgggcagctacacccctgtggcttggaagtgttcagcttccatggctgctctcaagggcaggtgttgagtgcctccagcttgtccaggtgcagggtatttagtggatctatcattccagggtctggatgatggtggccttcttctcacagctccaccaggcagtgccccaatggagactgtgtgtgtgggggtccaacctcacatttcttctctgcactgtcctagtagagattctccatgagggcttctgcctggacatccaggcttttccatatagcatctgaaatctatgcgggggcccccatgcctcaactcttgcattctgtgcacctgcaggcttaacaccacatggaagcagcggcccaaacagtacccaggttcctttgagccatggctggatacagagcagccaggatgcagggagcagtttcctgcgtctgtgcagggtggtgaggccctgggtctcacccacctcgtaggcctctgggccagtgatggcaggggctgctgtgaaggtctgtgaaatgcctgtgaggccttttcttcattgttttagctatcagcacttggcttttctttacttatgtaaacttctgcagcccgcttgaatttctcccctgaaaattggcttttcttttctaccacataactgggctacaaatttttcaaacttttacactctgcttccctttaaaatataaattcattggccgggctcggtggctcatgcctgtaatcccagcactttgggaggctgaggcagacggatcacctgaggttgggagtttgagaccagcctgaccaacatgagaaaccccatctctactaaaaatacaaaattagccaggtgtggtggtgcatgcctgtaatcccagctacttgggaggctgaggcaggagaattgcttgaccccaggaggcagaggttgtggtgagcagagatcacgccgtcgcactccagcctgggcaacaagagtgaaactctgtctcaaaaaaaaaaaaaaaaaaaaaaaaaaaatatatatatatatatatatatatatatatatatatatatatatgttcgtttcaggtcatttctttgctcacacatacgagcgtagggtactagaagcagccaggcaacatcttgaatgctttgttccttagaaatttcttcctccagttatcctaagtcatcattctcaacttcaaagttccacagatctctaggcaggggcacaatgccaccaggttctttgctaacacataacaaaagtgacttttgctccagttcccaataagttccttatttccatctgagctctcctcagcctggacttcattgtccatatcactgtcagcattttgttgacaacaagttgataagtctctaggaagttcctaattttccctcatcttcttgtcttctgagctctctgcactcttccagcctctgcccattacccagtttcagagacgcttccacattttcaggtgtctttatagcaatgccccacttttcagtagcaattctctctgttagtttgttttcacactgctataaaaaatacccgagactggataatttgtaaagaaaaagagtttaattgtctcactgttccatggactttataggaagcaaggcagcatctgcttctaaggaggcccagggagcttttactcatggcagaaggcaaagtgggagcaggccagagcaggatgaagagagaggaaaggtagcacacacttttaaacaaccagatctcctgagaaccctaccacaagaacagcatcaaagagggaaatcagccccctatgatccagtcacctcccatcaggcctcacttccaacactgggaattacaatttgacatgagatttgagcagggccacaaattcaaaccatatcaacattttttttcttttctgaaattcttgttgctcttctctttaatacagtttaaattgtctcctatatattattatctatatattagctttattattttttgtttttaattttttgagatggggtttttctcttgtcacccaggctggagtgcagtggcacgatctcggctcactgcaacctctgcctcccaggttcaagtgattctcctgcctcagcctcttgagtagctgggattacaggtgtgtgccaccacgcttggctaatttttttgtatttttaatagagacagggtttcaacagagtttcaccatgttggtcagaccagtcttgaactcctggtctcaggtgatctgcccaccttggcctctcaaagtgctgggattacaggcatgagcaaccacacccagcctagctttattttttagtttcattaatgtatgctatcttttgtcatcctcagatcctaaggcaagataagataaataatattatttcccattttatagatacagaaatattcatcagacaaatgtcattgactgtacactgtatgccacatattagtgttagctctggatatggacaaatgttaactgtgttattttgttagtaatatttgatctcttcttatttatacaggagagattaaacagattctagaaaatgaacttcagatacctgtgtccaaaatgctgttaaaaggctggaagacgggagatgtggaagacagtgtgagtttcttaattgcatagaaataaaagaaaattaagttatgccattgattaaatgatatgtaaaaattggttttaattaatgttgttacatatggcagtagtagatttggcaatagtaatttagtttaaggaatcagcaagtagtgttttctaagctaaaatatttcatgataaaccaataacaattgtaaatgagtagatttgtaaatgaaaacagtatatggcatgtttttcctatttctaacttttaaaggagtttggccctttttttgagaggctttacctttttctcaaacctcctagagtatcagtgaatgccctggaataataattttctgagcaattacatattggtccgaaagaagtcacatgcagcgtatacatttatgtcaagtattgattatggaacaaagataataggaaattttttaaacttggagaatttaaataaggatgttgttttccttgttgacttggatagtggcaggtgcatggaatgaattatattttaagaatttgcagagagtattgcaattttaaggaaatagttgctattcttaggaacccagtagcaacctcagatataacattttttacacactttttttttttgagacagtctcgctctgttgcccatgctggagtgtagtggcatgatctcgcctcactgcaaactctgcctcctggattcaagcaattctcctgcttctgcctcccaggtagctgggactacaggtgcgtgccaccacgcccagctaatttttgcatttttagtagagatgaggtttcaccatgttggccaggctggtctcgaactcctgaccttgtgatccacctgcctcggccttccaaagtgctgggattataggtgtgagctgctgcacctgggcttacacacttttttttcttccagagagagtggagaaagaaggaaaaaaaatgagttagttctagagttttagatgtttgaggtggaaataattattgaatgttttcacattagttactgggtcattttaatggccaggcataaacttagaattttcaacttttggctgggcgcagtggctcacgcctataatcctatcactttgggaggccgaggcaagtgaatcacctgaggtcaggggttcgagaccagcctggccaacatggtaaaaccccatctctactaaaaatgcaaaaattagctgggcgtggtggcacgcccctgtaatccaagctactcgggaggctgaggtgggagaattgcttgaacccacaaggtggaggctgccatgagccgagatcgtgccactgtactctagcctgggcgacagagtgagaccctatctcaaaaaaaagataaataaaaataaataaaaatataaaaacttcaacttttggttcagttcttcttcgtgaatggcttcttgcagtcattgtgtttataagtacttatatatgagttcatttgaaatttggagatgttctgagtatttcagtgagatatttacaggaagtttgggttggcaagatacagataagtttagattaggtggcagcaaactttttctgtacagagtcagatagtaaatattttaggctttgtgtgccatacagctacttaatcactgctctcttagtgggaaagcagccgtagacaatatgtgaaacatcgagcataattatgtttcagtatgtttatggatgcagacatttgaattttatgtaatttcacatgccataaaatattcttttgatttattttccaacctttaaaaaaagtgaaaaccattcttaactcacaggccatacaaaaacaggcagcaggctgggtttgacccacaggccatagtttgctatcccccgctgctgctgatgcatggattaaaactttttaaaagtgctgactgagtaaatcaacaaccttgacagaaagaaaacaccaaaatgagttcgcttttgtagttatttattcattcattcattgagaaacctgtgggtatgaatcagtcagctgggtggagtggctcacccttgtaatcccaacacttggggaagctgagtcaggcagatcacttgaggccaggagtctgagatcagcctggacaacatgacaaaaccctgtctctactaaaaatataaaaattagctgggcgtggtggtgcacacctgtattcccagctgctcaggaggctgaggcacaagaatcgcttgaacctgggaggtggaggttgcagtgagctgagattttgccactacactccatcctgggcgacagagcaagagtctctctcccccgccacaccccccctcccaaatttgaacacagccttggttacaaatacttcaatttacttctttcttcttcttttttctttttatgagatgagttctcaccctgttgcttaggctggagtgcagcggtacaatcatggctcattgctgccttgacctcctagactcaagtgatgcttctacctcagccttctaagtagctaggactatagatgtgcaccacgcctggctaattttttttttttttaaatttttgtagagacagggtcttgctatgttttccagactgatcctgaattcctggactcatgcagtcctcctgccttggcctcccaaagtgctgagattacaggcatgagccatggcacccagcctcagttacttatttctatgtactcttcactaggtgatttctgctattcccatgacattaattttctgattgcctccgaatttatattttcagctcatacttttttgaattcacatatccaaactggtaattgacttttgtacttgtatatcttattggtgtctcaaacttaacgtgtttaaaatggaactcttgattttccctcctatcccatatctctaccaatcttcccccaagaagtagcacaatgattatagccactgctgaatccaaaactggccatcagtcttttctcatttcttacagcacctaatcctttgttatattctgtagattcgatctttaaaatgtatctcaaccatggccactttttagtatttcagttgcaactgcttaattcaggccatgaggccatgagcatctcttgtctggagcaatatggtaacttcattattgttgtctcagcttcctttcagtgtttcttccagtgcattctccacacagcagtcagagtgatcttttaaaaacataaattgaattatatcactctcccattaaaacatagcttttttattacatttcaaataaaattcagactactcacaatagtttaaaagttattgtattaccccattctcgcctctacaacatcatcttgagcctttcttactctcactttccatgttccagccacagaaaccttttttgaaatcttttaataggctcaagctctttacatctttgtctgacagatgctattcaactgcctggaatgctttacctcctgttcttcacatgggtgtctctttttcatcattcaagtctcagcttaaggttaccttctccaacaggcttctgtatctaatttggtcccatcccagcattctccatcacaccagtattaatagagggaccatatctgtttctttcatcatcgtatatttaaagcctggcataacagacctgaaataaatgtttatgggatgaatgcatgagtaaataacttaaggaaagtatccattttatttaatctttccatatgtggtttgatgggaaaatttaatagaaaatctttggatagtggcatggaaaaagaacaataatgatcaaatggcaagcatttaccaataattcacaaagtaaaacaatgaaagataaaaagagaaaaataatttgtgtgtgtgtgtgtgtgttgtttgcatgttaactctatagagataactcatcaatttcaaaaggatatcacatatttgacataaagtttcaggatgtccatgtctcctggtaaattgtaaagttataggtaattgccaaatgcaatgtttttttcaaactatggaccataaaccattagtggattgggaagttaatcgagtgggttatagtcagcagcattaaacaaaaacaaacaaacaaaacagaagaagaaagaaatgaaaaaagagaaatagaatacaataggaaacgccagagtgtatttcaaataataagggtaattatgtatttcttttcatttaacacataactaatatgagtcaagagtaagtctcaatacccttggattaagactgcacacttaataagctgggtcctctcatggaggggttaagaataagttccatatgttccatgcttgtgtaagattgcccctccccaggaaggaatatattctttctctatatattctcatggtttgcttccttcaccttttaagtttttgctcaaatgtcacattctccaagtgagacccaccttgatggccctgtttaaaattgctaagctcaaccccacattctttatccccccttccctgctttatttttagtcaaaaaattgtcactttcaacattcaactatatagggttacttatttattcctactcaaatgtaagctccctaagatcagagaattttattttaggctgttctgttcaatgctatattctcagtggctagagtagtcctgatacagagtaggtggctcaaaaaatatctgttgataagtgcatttcctggcttatgatgtaaaggtatacaatgtatttcttaatgtgtattggtttcaagaaacatttgaagtacttcagcaagtttttaccttcaggttaggagtttgaaatgtatgtgaattttctggcaaagaaatttggtgaatgaaattttctgtgcttatcaagatagtaggtcatatgtagtacaatagtaatttattcatttcaaagagtgagagctttaacaaaaaagatatctggagtaaaagatatataggtaacaccagagacctcatccaagttacctaacctctcaggctatatagcttcccatctataaaatcgttggcttgaggtgctctcagtgatcttttcaaggtctaatgatctctgaaaacctatattgccaatttttgccatgatgaccctgaaacgaagtatatattatttgcaaggatatacttcttcagtgaaaaagtaattgagtcccaactgtgttcttatctgtttgtgttgcttcatgagctaaagagtttatatattaacattcaggtttatgctagttcattttatatatgtgtatgtgtgtatacacatatatacacacatacacatacactcacatgtatacacatacacataaacacacatatatgtatatgtatgtacgtgtacacatgtacacatgtatatgcatgtacgtgtacacatgtacacatgtatatgcatgtacgtgtacacatgtacatatgtatatgtatgcacatgtacacatgcacatatatagacacacatatatatgtatgcatatacatatataaaataaactagcataaacctgaatgttgtatacatacaatatatataggtatacaaccatatttcccctatatatgtatatattatatatatgggcaataaggttacttggattcagtagttcttttgcattaccctatttaggaaattatcaaaagataaaaaaaactacaaaattaacaatttttcaagaattacaggaaaaatcaataatgaataatcaacatcaacattcattttttgctgtgttttttctttttcagacggtcctaaaatctctacacttgccaaaaaacaacagtctttatgtccttacaccagatttgccaccaccttcatcatctagtcatgctgggtaagttgtttatatttcctgggaacatgaaatgaaaaactcagttgttaaaattgctttaagttgtatataaacctcaaaattaaatcaaatacaagtcttgttgaaattgaccttaccaactactatgaagtatatcaggtttgaaacagtttgttctggatagtttgttttaacggtatagtcctcttataccactttaaagtctttagcataactccagtataatttttaaaaattgtcaaaatggtacttctctgactgaagggaaaggatccaagttggaaggaagagaaagtataaatggagttccaatctctctcattgctaaagaaagcatacctttgaggaaaattcattgagctctgcagagtaaagcttgaaaaacactgatataatttttttttttttttttttttgcgacggagtttcactcttgttgcccagactgaggtgcaatggtacgatcttggctcaccgcaacctctgcctcccggattcaagtgattcccctccctcagcctcctgagtagctgggattataggcatgtgccaccatgcccagctaattttgcatttttagtagagatggggtttctccatgttggtcgggctggtcttgaactcctgaccttaggtgatctgcccacctcggcctcccaaagtgctgggattacaggcatgagccactgtgcctggtgatgtaaattttttattaagattttctctctggaatagagggtctcattgttttttcagttttcacagtggaactcaatacatttatacaatgatcacatgattttaatttttaattatacattacgttttttattgtttaatgaagcaaactgacctatagtggatgattatgctagtgataataatttttatgaggaatcttttcatacagtattattccagaactatgtttatttttagattttctgttgttgatacaaatttttctcttttaaatacaacaacttggtgatttttttgtggtagggagacttgtgtccctaaattttgaacattgtcaagctttccccccaccacttgccaaatgtcttgatttttaggtagatagtagcaaaaataaaattaaatttggcttcactgaagtagaaatcactgaactgaaaaagttaaatcttgtgtagttgtattggatggtctgttaatagttggttttgggttaagaatttaaagagttcttggattgctctttattttctatgtttagaccgtatgttaatgggaagtggaatttgcacacagttacaaaattacaaactacaaacttatggtccatgtgtttataataatgttgatgtgaacctcagatgaaattaagttaaatagttataggtatggttctgtatctagtcatgtagaacattattttgtaggttagttaacaaagtgtaatcactgtcataaaataggtaatccacataattaaaagcagacaggagatgtcattgtttataatctgttgctttccagtagcgtgattaaatggatttatcaaaatgtctacctgggctaatggaaacgttcttcattgccatgtagctgaccttagtttgattgccagtcactcactccctaggcaagcaggagtctacagtgctgctgaaatgcagtgtttattggagaatgagtactttatctagcattaaaatatacttctctatttggctttgtggatttttaccaagttataatgattctttttttgtattggaagaataagagagaaaagttcaaaggtgaacaaaaaacatagtgggaggagggacaaatggagactcctgctaatgtaaaagttatgttaatgtactttttattaacacataacttaaaagctagggtttacttcttttagtatgtttattcaatgtatctttctataaaactagagatttttaaaatagcatatatattgaaagctgattttgtgggagacaatttaaaaaacaaaacaaaatccatgcagaaccttaaaagttgatggtaataattatttttaagttgtgagttttattttgtgactcatcaaataaaaatattttgacatcttttttttttctttctttctttttttggagacggagtttcgctcttgttgcccaggctggagtacaatggcatgatctcagctcactgcaacctccgcctcctgggttcaagcaattctcctgtctcagcctcctgagtagctgggattacaggtgcccaccactacgcctggctaatttttggtatttttagtagagatggggtttcaccatgttggacaggctggtctcaaacccctgaactcaggtgatcctcccacctcggcctcccaaagtgctgggattacaggcgtgagccactgtgcccagccactttacatcttaactatataatagaatcaaacaaacaatatcctagtaagttatatagcatatcatattatcaaaaatggtagacagataaacttgctttgtactagacttcataatgaatcaaactgatttgcttttgcagaattttgttacaattgatggattcttagaaatcttatttgtaatttgtaacctaatttataatctaaaaaggagaaaaaagataattatgattctaagtgttatatttgggaattggcaaatgaatataacaactgtgtaattggtagagtaaaatgggaaggtttatgtatatattattgcattggcgtatattacctcacttataattcttaagaatttgcatgaaatttcagtgtgtgaattcactcttagttacagtatattattaatcatttaatataatgtagatataaaataacatgttggccgggcaccgtagcttatgcctataacaccagcactttgggaggctgaggtgggaggatcacttgacaataggagtttgagaccagcctggagaacatagcgagactgtatctctacaaacaatttttatgaaatagccgggtgttgtggcacgtacctgtagtcctagctgctcaggaggctgaggcaggagaattgctcgagcccaagagtttgaggttacagtgagctgagatcatgccactgtactttaagcctgggcagtagagcaagaccctgtctctaaataaaataaataaaataaaatagttattaaattgttcactgacaaaccgtctcactcttaagttttgttaaagaagtatacatacagaaaactgtatctcaaaccatgtcctgttaaaaaacaagaaaacaaaaaaacttcttaacttgattttactgccactagggggtgcctggtaattgagtctttgtattaatataatttctttctaggggaagaaatggtataaactaagagcagcaaaattaccatatgagtgcctataattgtaaactgaatgtttttaaagtaaattatgtgtttcagaaaacagaatttcaagctttctgagaatcgaagagcaaactcttaatcataatctttgtaacagttgaaaagcattttaagcccttttaaaaaagaaatcagatttcactaattaattgaaagggtgaagcagtactccagtggcctctgtgatacaactataaattctattataaatcacagtaaaattaggaaggagaaaacaaactgttaattatactgtttcatattattacaggaaagattcagttcatcaatgacttattgattacttaataaaaacaagctgtgtcctcaggtagcctgtaacctatttattaagatgattaggccttttcttaagttattcctgtatagaaaatattcttagataccaactcattcctggtgttctttttgattgcttcacccagattccttcctaaactcttcatttcttcacctgctctaaatgttggtattctggagagttctcttctcagcagtctttcttattgtaccttctccctgatatctaccctcaactcttcaatttctaaatatgtatagataacttacaaatctctatttagcaactcacatgtcccagttgcctgtggagtttttcatttgtgtgtgtcctatctgtaattcaaaatcatatgtctctgtactactacatgtgtttttctttttctttttttttttttttgagatggagtctcgctctatcgcccaggctggagtgcagtggcgtgatctcggctcaatgcaagctccgccccctgggttcacgccattctcctgcctcagcctcccgagtagctgggaatacaggcgcccgccaatacgcccggctaattttttgtatatttagtagagacagggtttcaccatgttagccaggatggtctcaatctcctgacctcgtgatccacccgcctcggcttcccaaagtgctgggattacaggcttgagccatcttggccggcctacatgtgtttttcgtttcaaatgtccaacagtataaaatactgaagtgtattctaaccaagatgctgattattaaaaaagccattgggttgggaatataagtaattaataactttgttaaaatcatttttggtagaatggtgagaatgagaactcgattatagtagattttcatggataaacaagaaatgaagaaatgattactgttattttcagaaaacttgatggtgaaggaaggagaagttgagggagaagtcaaggtaagatacttgagaagtattggaagcacaaggagtaagagacagcaagtaggaaaaatgtaaacaagtgaaaccaaaatagaaaatgtggccaaagactgagtgcagtggctcacgcctgtattcccaacactttgagaggccgaggtgagtggattgcttgaggtcaagagtttgagaccaggctggccaatatggtgaaaccccatctctactaaaaatacaaaaattatctgggtgtggtggtgcacgcctgtaacccgagctactcaggaggctgaggcaggagaattgcttgaaccctggaggtggaagttgcagtgagttgagattgcaacactgcactcaagcctgggcagcagagtgggtatggaactgttttagtttgctagggctgctataacaaagtaccatagactgggtagcttaaacaataggcatttatttctccttgttcttgagtttggaaatctccaagatgaaggttccagtagagtcagttcctgttgaaagctctcttcctggtttacaagcccaacttcctgccatgtcctcatatggcagagagagagaggagagagagagaactctggtttcccttcatctttttataaggacatcaatcccatcagattaggacccagcccttatgacctcctttaacctgaattgtatcctgaagatgctgtctccaagtacagtcacagtgggtgttagagagtcaacatataaattctagggggacacaattcagttcatagcagagagatacgggtggagcccagggattaagtgttgaaatgacattaggtaacaggtttagagacagtaggaaaggtgtaataatagaagattggagacagatggagaacatttctgggatctagatttcagtactgttacagtaatggttgatgacagattccaaattatagataacatcaaaatagaaaataggtaatagttatgagaataaggatgttaaggaagtgtgaagctaaactgataagtgacagtgacacagtaattaacatttatgaagccaggttttttggcaagcctgttatatatgttatcttattaggtcatcataataaatcacaagtagatacgattacctgttttgcagatagagaaactgagttggggtagaggtgaggtgacgacacagagatagtggttattgggaactacagttgaagaaggctagaaatactgattaactttagtctgtattttaaaaacataaatctaaatataagtgttataaataaagagaataaacactaaaaaaaaaaagaagtaaataacctgcatacatctagaagaaagaaaggaatgaggaactcagtcaatacatcagcaaacagcaatttgaaactgaaacagaaacacaggaaaacaagtataatagaaaacagaaaatatgatggcaaaaagaaaaataaaatttatcagaattctccatgaacaagaaagtactaaactctcctattaaagacagaaactctcaaatagaatttacaaaaatagccatatgttgtttaccaaagagacatcttttaaagaaatgacagagaaaataaaggaaaagaaagtgaccccagggaaatattaactgtaagaatatactatagtaataatatttatatcacataaaattgaatttaaggcaaatagcattgaaagacaatttgccaagaagatatgacaattgcaggcttgtatgcacaagtctacaaaattggacagaattacaagaagatatagaccaactccacattgaacacaaaatctttcagaaaataatgtatttaaggccaggtgtggtggctcatgcctataatcccagcactttgggaggccaaggtgggcagatcacgagatcaggagattgagaccatcctggctaacatggtgaaaccccgtctctactaaaaaatataaaaaattagccaggcgtggtggcgggcgcctgtagtcccagctactcgggaggctgaggtgggagaatggcgtgaacctgggaggcagaggttgcagtgagctgagatcgggctattgcactccagcctgggcgacagagccagactctgtctcaaaataaataaataaataaataataataataatgtatttagcaatacatctttgtcagctatagaagattttaataaccccgtaaagcactcatggaatacttagaaaactgaccatgtagtagaacacaaagccagtatcaaagaatcactatcatattgactgcattgtctggtcattatgcaataaaattataagtaaagtaataataaaaacatatatcccaaatcccccatgcatttggatcctacagataatttacttcaaaacaatttatgggtaaaaatgaagtcataatagcaaacatcagatacttagaagtgaacataaatgagattgctaggtactaaaactgtggatacagccaaaatgatacttagaaatttgtagtcttaagtccaccaattagaagacaagtgttttgaggccgggcgcggtggctcatgcctgtaatcccagcactttgggatgccaaggcgggcggatcacgaggtcaggagatcgagaccatcctggctaacatagtgaaaccccgtctctactaaaaatacaaaaattagccaggtgtggtggcaggtgcctgtagtcccagctactggggaggctgaggcaggagaatggcgtgaacccgggaggcagagcttgcagtgagccaagactgtaccactacactccagcccggggacagagtgagactccatctcaaaaaaaaaaaaaaaagagaaaagataaaacagaaagacaagtgttttgagagcccccagctaaattggacttctagtacctcagcagttagctaccttaccttaacagaaaatcaaggggaactggacaggagtgtttatagtgtgcctttcatgggatgcttctttcacatggtggacagcctaaagcctagttgtccaacctgtgaccagagggtccctcacacaggaaacttgtttatactggtagatgtctttgtggctcttgtctagctcgtgtccaatttttgcctgcgtgaccatcactctggctctaggagcctgaccttttgttctctccagtatctctgggaaagcccagcttggggcagttcctagttcttcagatggaaggtgcaaattcaatataacacaataggaagcaagttcagagatatttttactttcagttcctaggcaagaaggacatgagttgggagggtagtcctctgtccctgtgtcatgtgaagcaggaatgaagagttgggcagagagagagtgaaaagcgtgtagcaactagcaatatatataagggaagttcaagagcaaatacctgaatggtcctgataaaggaagctgcaagaaaatgtggagcctagtctgttaggcaggagggatgcctctaagttcttatttctgaccactggcctgagccatttgggtatagtatagaactggaaactctgtcaagagtagcggagccctgcttctggcatgagaaaattaaatgttcaaaatgaatgtggaagcaacataaaattaaagaattcactacaataagaaagatagaaaataattgaattgtgtgtttaacttaagaaaatagaataataaccgcagagtaagtgcactgaaaatagaaagaaagattaaagagcagaaattaatgacagaggcaagcaacaagaataagaactatttacttgaaaagtcaaaccaggaaaaaatgagagtaagcataaacaaaatactaggtatgaaaaaaagggacttaaaactacagattaagaagagatttttaaagtaataagataattattaaataatactaagcaaataataaattaataaattatttcaaaataaacaatgaaatatccatgtctttatgctaataaaatccaaaatttaggtgaaatggaaaattttatataaaatatgaagtactaaaatgagtacaaaaagagatgacctgaaaaaatgataattattaaataaactgaattagttgtcaaaaattccgcatgctgctccaacccccttcaccctccagaggatttttcataaattttcatggaacaaattatcacaatctgttttttttattttggagaaggagtctctctctgtcaccaggctggagtgcaatggctcaatctgggctcactgcaacctctgcctcctgggttcaagcaactctcctgcgtcagcctcctgagtagctgggactacaggcacggtgccaccacgcccagctaatttttgtatttttagtagagatgaggtttcaccatgttggccaggatggtctcaatctcttgacttcgtgatccacctgcctcagcctcccaaagtgctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcactaaggatgtaaatgaactagtcctctccataaaaactacagcttgattatagctaccctgctcaaaactctccactagttttctttttcttttcttttttttttttttgagacggagtctggctctgtcgcccaggctagagtgcagtggcgcaatctcggctcattccaacctccgcttcctgggttcaagcgattttcctgcctcagcctcccgagtagctgggattacaggtatgtgccaccatgcctggctattttttgtatttttagtagaggcagggtttcactatgttggctaggctggtctcaaacttctgacctcaggtgatccacttgcctcagcctcccaaagtgctggaattgcaggcatgagccactgtgcctggccctctccactagctttctattacacttctaataaaaatccaagttccttactgggacctataaaagacttacataatcttatccttgtctttctctctaacttcgtcttttatcgctgtccctctggctcatagctcaccagccatactgttcctctttaaaccttctaagtgtgcttaaaccttagagcatttatattttgctattctcctgccagtaatgatactaccaggtaacaacttggctcatttcttcactttatttaggcctctactcaaatatcacaccctcagagaggcttttcttgatgcccctatctaaaacagcccctctgttataccctctctctatcttgctttatccctaccgtgcattatattagtgatattagtaattgtattagtcagggttctataggggaacagaactaataggatatatgtatatacgcaagggagtttattagggagaattaactcacacaatcacaagctaaagtcccatgataggccatctgcaagttgagaagcaaggaagcagtggaggggatcagtccgagtcccaaaaccttaaaagtagggaaactgacagtgcagccttcagtctgtggccaaaggtccgagagctcctggcaaaccactagtgtaagtccaagagtccaaaagctgaagaacttggagtctgaacttggagctgaagaacttggagtcggcctgctttattctagctgcactggcaggtgattagacaatacccacccagattgagggtgggtctgcctctcccagtccactgactcaaatgttaatctcctttggcaacaccctcacagacactttcagtcaagggagcaatactttcaatcaagttgacacccgatattaaccatcacagtaatttatttatattcatatttgttgtctgtttctctcaccacaatgtaaaactacagaaaatcagggattttttgttgttcactgttgtatccctaccacctaaaaaagtgtcggaaacatagtagatacttggaagtgtttgtggaacgaatattgtaaagtgacacatttctaaagacatttgccttagctttgatttcttttgattgaccagatatatattgagtatcatcctacaatgtgttaagtctttgttctaggtgctagggatataatgagcaagacagataaggtcctgctttcatagaatttacagtataatatgtatagaggtgtatctggtttataataaaactatggagaagataacaagaaaaaatatcagatgatagtgagtactttccagaaagctaaaatatggtgacatgatagtgaataattgaatgactagtgtgggttgtaaggtcaataaaggcctcactgaagatggactatttaagctgagacattaaaaatggaggggccatctaagtgaagggcagagtgaagaatatgggggtatggctagtgccaaagccctaaggccatgtataaatataactggagaaggtttgacatttctgggctttgtattgctgatgatcaccttgctagaaaaggactgaagaaatgtcttgataataaaagacagtctttgcaacttgctttagtcacggtctagtaagtgatgaaaatgtctagttccattttaattatgtacattttcttttctttctttcttttttgagacagagtctcgctctgtcacccaggttggagtgcagtggcgtgatctcagctcactacaagttccgcctcccggattcacgccattctcctgccttagcctccagagtagctgggactacaggtgcccgccaccacgcccagataattttttgtatttttagtagagactgggtttcactgtgttagccaggatggtctcaatctcctgaccttgtgatccgcccacctcagcctcccaaagtgctgggattacaggcgtgagctgccacacccagccattttttgtatttttaatagagccggggtttcaccgtgttagccaggatggtcttgatctcctgacctcgtgatctgtccgcctcggccacccaaagtgctgggattacaggcgtgagctaccgtgcccagcctattttcttcatttttatataacagcaaggtgtgacagaaaatagggtatccattgtttgtagttgtcccttttacaagtagtattgagtcttgctattgaacttttatctttttgtgctggacttacggttccagttatttattattattatttttttgagattgagtcttgctctgtcacccaggctagagtatagtggcacaatctcggctctctgcaacctccgcctcctgagttcaagtgattctcctgcctcagcctcccgagtagctgggattacaggtgcccaccactgtgcctggctaactatttttgtatttttagtagagacagggtttcaccatcttggccaggctggtctcgaactcttgacctagtgatccaccttccttggcctcccaaagtgctggggttacaggcatgaggcactgcgcctggccccagttaatattttaatggcttcatatgagggtattattgagctctagtcctgcagtcaagcatatcactgtcttctgtggcctctgggttgtgaagttgcatttaactatggctttgaattagtgctgtttgttcaagcaggagtaaattcagggtactaaatgggactcctgtgatagttgagtaaactagtggtgttaaaatatatggctttttggccaggtgtggtggctcacgcctataatcccagcactttaggaggcggaggagggtggatcatttgaggtcaggagttcaagaccagcctggacaacatggcgaaaccccttctttactaaaaatacaaaaattagctgggcatggtggcacacacctgtaatcccagctactcgtatagctgaggcacgggaattgcttgaacctgggaggcagaggttgcagtgagtcaagatcatgccactgtactccatcctgggcaacagagcgagactctgtctcaaaaaaaattttttttaaatgtctttttgtttttgtccttggaaaaccattggtgggaaagcagattacagtagccatgaattaagcgagaatagagttcttatattttccagtgggtgctgtggaagaaattgaggagtagtaagtcaagatagctgagttttaggtccagcttggcttcagaatcactgtatgacttagggaagtctgcacggggcctcagatcctaccaaaaaatagaggctcttctagagttttaggtgttcataatgccactcatccttcctttcttctaaggttcttagcagtagattagacacatagaaatcagtagccaaattggaaaacaaaactgctttaatggccgggcaagcacctgatggagaggatgtggcctagacctgagtcctaaatggtgtcttttacctcttgctctagatctaaatcgaaatctaaatttaaatcttgctctagatctaaatctgagaacctttatgctcatgtggtctgtaggagttatgattgagtcttcagagcctgatggactgatgcagtagacctgccttactaacctagtcacatttggaaagacagcttagagatctcatggtaagctttgtccagagtgcacctaccacaatgggtaaaaaaaatggtagagaacttagtgaactagggcacaggaagtgaaagaggaaactgctggtcttgtccctggcttctgtgaaatctaacgtggtatgtatgaccttgtaagtaattctaattggctctatttttccactaagagaaacaaatctagaatggaggaagggggagtgggaaagctacatattttctcatttaaactctacccttgtggggagaatcatcatgggcagaaattttatcttccctgtgaacagaggcagaagcctgagaaaaagcaaaagaaacttacaccttctccctgaagccttttcagactctctgtgtttgttatgcactccactatacccattaagtttggtacaataagcgaaaaattctgaaatactctttatctctgcttcttataaccatccagcagcagtggtaataggtatctacctgtgctcctagccctcgtcctagcaaagaggtgcatgcatccactgagcaggggtgtgtgtgtgtgtgtgtgtgtgtgtgtgtgtgtatgtgtgtgtgtgtgtgtgtatatgtatatatatatggttgttttttttttttttttttgaaagacagtcttgctctgtcacacaggctgtagcgtggtggcattatcatagctcattgtaaccttgaaccaccctgggctcaagcagtcgtcctcctgccttagcctcccaagtggctgggactaactacaggcatgtgccatcatgcttggctaatttttaaattttctgtagagatggggttttgtgctgggtgtggtggctcacgcctataatcccagcactttgggaggccaaggcaggtggatcacctgaggtcaggagttcgagaccagtctgcccaacatggtgaaaccccatctctactaaaaatacaaaaattagccaggtgtggtggcaggtgcctgtaatcccagctactcaggaggctgagtcaggagaatagcttgaacctgggaggcggaggttgcagtgagccaagatcaggacattacactccagcttgggcaacctgagcgaaactcagtctcagaaaaaaaagaaaaaaaaagagatggggttttgctgtgttgcccaggctggtcttgaacttctggcctcaagtgattctcccatgtcaccctcccaaagcactgggattataagtgtgagccactgcacctggtcggaatgtgtattgatattcatacagtgtggctttttcttttggtaatttctctctgtcatcctgtactgaggccattctagccactctactctcctctctccctgttatcccaaccatgaaagataactgagaagcgtcatagtagaactgttgtgagacttagttattagaaggacatgctgaggacgctttcaaatagttctcatcctacttatttttttttttttttgggggacagtcttgctctgttgcacaggcctggagtgcagtggcacagtctccgctcactgcaacctctgcctcccggttcaagcaattctcctgcatcagcctcctgagtaactgggactgcaggagcatgccgccacacctggctcatttttgtatttgtagtagagatgagattttgccgtgttggccaggctggtctcaaacttctgaactcaggtggtccacccatcttggcctcccaaagtactaggattacaagcgtgagccaccacacccagccctcatcctgtttctgtttctccaccacctcataatctgcacaaatattaatccttacatttttctctcttgtctatttcctactatttcagtctttggtgtccttccttaatacaacataagtcacatccatgagagctctgacttagaattgagaggaaagctctaggataccagctttggaaggagctaaatcaatcagccaattcagtcctatttttgactaggagaggtactgaaagaggaagtaaaatggtcgatttacgccttagcttcttcactcagaatgatcaggatgatttctgccttataggattttagagaggtcagtatgtgataaaataagatagcatatatgagcagcgggccttgcacagtgcatgtgctcagtaacttctctttgccaagtcacagagctagttaatggatgagccaggacttagattttatagggcttttttttttttttttttgagactgtcgctctctgtcgcccaggctggagtgcagtggcgcgatctcagctcactgcaagctctgccgcccaggttcatgccattctcctgcctcagcctcccgagtagccgggactacaggcgcccgccgccacgcctggctaatgtttttgtatttttagtagagaccgagtttcaccatgttagccaggctggtctcaatctcctgacctcatgatccacccacctcggcctcccaaagtgctgggattacaggcgtgagccaccgcgcccggccttatagtgctcttaattccaagttattcgtgtctttgagcattctagaggtgagtttttaaccaactcacaggttgctcaaaaggtcagaatcaatgtggtcctcaacataaagtctcatttcaatctagttcatttatgaagtaaactagaaacagtgctttttggcccttgtagatgctcagtaagttgtttaagtgaatggatgaagcgatgatgctctttcaggaatagatgagcaattgccagtgggggactcctgtggctaagtatttttgttttcaaagtagaaaaaaacagtaggtttttaactttttaatatctccaaataatttgctacaatttcttttgaaatgatttttctgtgagtgtgacttcttcatgctggcttttttagtgatcagtatttgtgaggttttagcagtgcagcagaaaaggagacctggccaggcacagtggcttcctactgtaatctcaacactttgggaggctaaggtggaaggattgcttgaacccaggtgtttgagaccaggctgggcaacatagtggaacctcatctttacaaaaaagtaaaaaatcagccaggcatagtggcacgtgcctgtagtcctagctacttgggaggctgagatggaaggattgcttgaggccaggaggttgatgttgttatgagctgagattgtaccactgactccagcgtgggtgacagagtgagaccctgtctccaaaaccaacaaacaaaaaatgatttaataaaaagaaaatgagaccttaaagtggcctgtaaataagttttttgaaaactttatatatgtaagtaaatgtctgaatgattcagttgtaatttttttttccggccgggcacggtggctcacacctgtaattccagcactttgggaggccgacgcaggcggatcctgaggtcgtgagatcgagatcatcctggccaatatggtgaaaccccgtctctactaaaaatacaaaaattagctgggcgtagtggtgcgtgcctgtagtcccagctactctggaggctgaggcaggagaattgcttgaacctgggaggcggaggttgcagcgagcagagatcgctggtgataagagtgagactcgtctcacttatctccagcctggtggtgagacttatctccagcgtggtgataagagtgagactcctctcaaaagaaaaaaaaaaaatttcccaaagtgctttacgaaacaactttttgttattttcatgaatgatattgtagggaagcaataaatgttttccctccaccctctggggtcttggctgggtacaaattgcatttacataaaacagattaacaagaggaaaacatacttaattatatatgtacacatagaagccccacaaaatatgagactcgaagaatgatcaaatgattgaaacttatatggcatcctgagctacagaaaggaataggagcgtggggcttctggtggatggtatgatacaagttatgagagggtaaggagaggaaatgtatggtgaataaaggttgtcttattatacaaataaaaggtctctcaggtagtaaaaatggtctcagagtagctctcagaagaagaggtgatcatctgtctgggtatggtttcagccttcagtctccttttctgtaacatgagttaattttccctggttgataagattcctagggtgggggttcaggacagttgagttccttttggaggatctgtctttaggcagataaggagagctcatagaaagcctgtgtttgtgtcagctgttccccaagtgccctcagttcaaagtaagcagcataccaaagtgtcatattgtggggttggcatttcctgaactccgtcaatatttatccgtaaaagtattttaagttatcagtattgtaattagaacaatgcatgatttgatatattattcttaaagtaatttcatttctcaagaataaattgatataatcagtatttcaagtacattgtgattactgttcaacttaaatttaattgtagtgagcatcattgttagatttttaaaagtgaaatttgaaagtactgggctggtaaatgttttttaataaggggccacttaaaagtggctcattttttgggaggccaaggcacgcggatcacctgtcaggagtttgagactagcctggccaacatggcaaacccccgtctctactaaaaatacaaaaattagctgggtgtggtggtgcatgcctgtaatcccaactacttgggaggctgaggtaagacaattgcttcaactcaggaggtggagattgcagtgagtcaagattgcaccactgcactccagcctaggtggcagaacaagactccttctcaaagaaaaaaaaaaaaaaagtgtgtttaattttaagaagaggacatttcccaaaagttatgcactctggatgaaagaagaaacttgtcctcaattaaagcactgatggaaatcacaacacatctaattggagtgaggtaccaaacccatttatacagtttattgcctattgatagttcagtgactactgagattagcttgttagcatcacattttgaaaaagaactgcgggtattctctacggttgatttaatggatagtcagaaacttggtcactactctaggaaacaaaaattgatatgtctataaatatttctttgcttttttcaaattttgtctagatggttagaattgtgttttgacagttttgccatgtactacttgatgcatcacaatatatcactatcatcactaattaccacattttgattaattttacatactttggttaatacattttgatgtatccaatatatcactatattgattaaacagtaattatagacctgaggccacctgaactttgaaatcatcatgaaaaatgttattagaaattatgtgaaaccaaatgtttatttatctagacatgtttaattgccagcaaagaaagcaattaaaagtagctgtagagtaagaggccaaccttcgttaaacatggttttaagattgttacagaacttgtggtgatgataacatggtgtcttggaggatgttaacaactgtagcagggtgttaattaagaatgatgtaatctgcagctcagaattattagtatatgttagtttagctggacaggagcaaaacctagtttcagttgtgatgagagctcaaatcatatttatagtggaaagattaacattttatttttatgctgttcctgagacaatttaaaaatcctgaatgaaatacaatctaatgtaaacatcaaggccctagctcatttacatatgtgccagattttcaaactgattgctatttgaacctaatctgtcattgctagctgcattagctacaacaaacattacatttacatattgatttcttattttgttttagtgtaaataacccataattatggtaaatttggtcttttgttgacaagaactcatatgactctgtaagtttagaatggaaatttaaattgccatgtgtcacgctttttaatttaaaatcttgatgtagctaaagagataaaaataatattgtagatcacaaagtattcctaaagagacaaaagagagaaaaaatgttagggcatttggaaagatataaatggtaaagtattaatgaaaaattcaataccacattttaaaattattacatttttataattaaaaaaatcacagtaatctcaaataaagtctttgttcttgcttcactatcaggccatatttagaaaataaaatctagtgaagatgaaccttataagccaattttaaattgttatttttgtttaaaatatacagtgcaagaaaagaaataacatatgcacataacaggaatgaaatgagatttcaatcactgtattgatgttagtactttatattcgtcttaactgcacacatagcactgatttgagaagtataatttcactgctgagagctcatatttgtcagtggacatataatgttatttgctctacttgatgcagcaagtccatggttcccatttacactgattaaaagtggattgtggccgggcacggtgcctcatgcctgtaatcccaacactttgggaggctgaggcaggcggatcacaaggtcaggagttgagtccagcctggtcaacatggtgaaactctgtctctactaaaaatacaaaaattagctgagcgtggtaatcccagctactcgggtgcctgtaatcccagctacttgggaggctgaagcaggagaatcgcttgaactcgggaggcggaggttgcagtgagtcgagaccacaccattgcactccagcctgggtgacaaagcgagactccgtctcaataaataaataaataaataaataaataaataaataaataaataaaggattgtatttttgaagttaaaaatatagggcccatgtaactgtaaaaatggtcactattcgattattcaggcatttttttatggttaatgtttttatggagttataattcatatacaataaacatacaattgttttaaaaattgttttacagacatgaggtcttgctatgttgcgcaggctggttttgaactcctggcctcaagtcatcctcccacctcagcctcacaaagtgctgggattacaggcatgagccaccattcccagccaggtcttaagtgtctctgagttatacgagttttgacaaaagtatattgctttctgtgataccctatgaaaagggattttagtgagtgagatttcaatttggatttgtacattagaagcctgtgctgaactcatgacagctgtttacttgagtactatgaatacagaggccctaaaagcctttatattagtccccttgggctgccataacaaaataccatttattgggtagcttaaacaatagccctttatttgtgaatgtcaaaagtccaagaccatggtgctgacaaaatcagtccctcatcctggctttgtcaccttctcattgtgtcctcccaaggcagaaagagagagaaagctcttatctgtctttctcttcttataagaacactaattgcatcatcaaggccccactctcatgacctcacctaaacctgattacctcccaaagaccccatatccaaataatcatcacattgggggttagggcttcaatgtatgaattttggaaagtatacaaacattcagttcatagcagccctgaagcccaggtattgtgtccggaattggttccttccagtgggttcttgttctcgctgactccaagaatgaagccgcggaccttcgcggtgagtgttacggctcttaaagatggtgtgtccagagtttgttccttcagatgtgtacggaatttcttccttctggtgggttggtggtctcgctgacttcaagaatgaagccacggacctttgcagcaagtgttacagctcttaaaggtggtgcagacccaaagagtgagcagcaacaagatttattgtgaagagcaaaagagcaaagcttccacagcgtggaaggggacccgagtgggtcgccactgctggctggggtggccagcttttagtcccttatttgtctctgcccacatcctgctggttggtccattttacagagtgccgattggtgcatttacagtcctttagctacgcacacagcactgattggcgtgtttttacggagtgctgactggtgtatttacaatcctttagctagacccagagcactgattggtgcgtttttacagagtgctgattggtgcatttacaatcctttagctagacacagagctctgattggtgtggttttacagagagctgattggtgtatttacaattgtctagctagacacagagtgctgattggtgcattttacaatcctctagctagacagaaaagttctccaagtccccactcgacccaggaagtccagctggcttcacctctcagtatgaattaatctttcctagtctagttgtttaattttgatgtatactttataatagtgagtgcttcccctagtactattaatgtattaataggtgggctatgggttagtttagctaattcttctgtctactgaagactttaagagggagttctggattcaaggaattcctagagaggaaatccttaaattactgtgattattattggttcaagacagtttgcctactactattgtaccctgtgaaatgggcctgctgctagttggcaggagggaagtcattcctcttcttcatcaggaattaataaagtggattgttttactaacataattcaaccttaagttcaccttgaaaaattactttgtgtattaaaataaccctgtgctttcttacaagtgggttgcagaagtactctctgaatgagacataaactcagtcaagacaataaagagtgttacatttattttctttgtgttgttgatgattttatcaatacttgatatatgtaagctaataatatatggctttgtatgttcatatatataaaaatacctgtgctagagcttcaaatttattagggcctatgttttaaaatttgctatacctaattttcccctttttaaaaaatgtggaggggtatgtaaaatgtataaactaagccggtgacttaaaattacattggtactcattagaaggctggtattttacaggtaacctctctgttcctgataaatattcatagttaaattggaatgggatctccccaggcatagctagatggacattctgctaatgaaagagcattggaagcctaagacttgtggacaaagaagagagtagagaaaagaagttttactaaaaagatttctagaactgttaatggcataggtattaatgcttagtaatagtactgagaattttaaagtggttatctatctatattttaatagtatcttctgttacatgccagatttatttatttatttatctgtttgtttattttgagacaggacctttctgtgttgcccaggctggtcttaaactcctgagctcaagcagttctcctgtctccgcctcctaagtagctgggattacaggcacacagcactgtgcctggctcccaccccgccaccttcaattttaaaattaagaaacagtatagaaaaattataaggtgatatgtttgaaaatgtctagcattttgcatactcagtgcttaataatgttaactttcattttattttgttgcaaataacactggagccccagggacaaagtctgtgattctgattatattttgaacattaacttcagtctatatctgagggtagatgaagaactgttagttttaatagtctttttctgtttgtagaaaccaaattgtgtccttgttgataatgcaaatagatatatatttttagaactttgcaacaggtttttttttactttatatctgttacagtgtttgaaacctaaagaaatacattttctcttcaaatttggatgtgtatataaatatcatttgtctggactcaggacactcaatgctatggtttcttggcctacgtctgctctgaaatcaagctgtgtctgtctgcccaggggctctgagaacatggaaaatagacagagcttagagttattagaaaaataaaagcaaatgaatttgcaaagaaaaaccagtgaggagaaggatttgattcatcttccaagggtccatagctgttaacccaagccattcttgggggatatccagtctcttgagtggctgggactccataccccctttccttctttaataggtctgtcaaaggcagttcccacaaaagctggctaaaaaactgatacccagctccagcgtctgagggttcatgaagatgtggaggtttttttgtttgtttgttttggttttttgtttgtttgtttttgagacaaagtctcaccttgctgcccaggctggagtgcagtggcagtcttggcttactgcaatctctgccttccaggttcaagagattctcctgcctcagcctcctgcgtagctgggattacaggcggccgccaccacacctagctaattttttttttttttttaatttttagtagagacacgatttcactatgttggccaggctggttttgaacgtctgacctcaagtaatccacccgcctcagcctcccaaagtgctaggattacaggcgtgagccacgacacccaggcgaagataatgcaaatatttctattgaaaaaaaatcataatgaagaaaaaaaatatttataccagtgaagagagaatgaatatatggtctgtcaaaaccatttcttgcattgagttaaaattcaaactgcttttaaaaagtttgtatatcaggccaggtgcggtggctcatgcctgtaatcccagcactttgggaggcagaggcgggtggatcacgaggtcaggagttccagaccagcctggccaagatggtgaaaccccgtctcaactaaaaatacaaaaaaattagctgggcatggtgggtgcctgtaaacccagctacgtgggaggctgagccgggaggattgcttgaacccagaaggcagaggttacagtgaaccgagatcatgccactgcattctagcctgggtgacagagcaagactccatctcaaaaaaaaaaaaaaaaaagcttttacatttgccaggcgcagtgacttacggttgtaatctcaactactcaggaggctgcagcaggaggatcacttgaagccaggaggagactagcatggtcaacatagcaaaaccttgtctttgtttttttttaaaaggttctacgtttgcttatatctttttttctgtctctaattgaaaagaaaacgtagttttttggccggacgcgatggctcatgcctataatcccagcactgtgggaggccaaggcgggcagatcacctgagatcaggagttcgagaccagcctggccaacatagtgaaacaccgtctctactaaaaatacaaaaattagccaggtgtggtggcacatgcctgtggtcccagctactagggaggctgaggcaggagaatcgcttgatcctgggaggcggaggttgcagtgaacctagatcgtgccactgcactccatcctgggtgacagagtgagagactgtgtctcaaaacaaaagaaaaagaaaacatgccttttttttttttaactgtttcattatttctttggttaacactcatccttttgaccctgaagatcaaaagttgaagcagcgtgaactttttttttttttttttttttttgagggtctggctctgtcactcaggctggagtgtagtggtgtgatctcagctcactacaacctcccccttctatcctcaagaggtcctcccacctcagcctcctgtagctgggactacaggcgcgtgccaccatgctgggctaatttttgtattttttgtagagtctgggttttaccttgttgcccaggctagtctagaactcctgggttcaagtgacccacccaccttggcctcccaaagtgttcagattacaggtgtgagccacagcgcccccccaacttgaaggtaaaagactgctccaaggtggcttaaccatggctaactatcataaccaacataaattagggggtactgtgtgagagaaaattgctcctggatgctgcagctgaggactcaacacatagttagctttagaagctaggatcagtttgcctagataacattttagcaaaaatgtctttgcaaattacacagattaccatggcatttttttttcttttacaacagagtctctctctgctgcccaggctggagtgcagtggtgcgatttcggctcactgcaacctctgcctcccagattcaagcaattctcatacctcagcctcccgagtagctgggattagaggcgtgtgccaccacgcctggctcatttttgtatttttagtagtaacagggtttcaccatgttggccaggctggtctcaaattcctggcctcaagggatacacccacctctgcctcccaaagtgttaggattacaggtgtgagctaccaagcccagcaaacatagcgtatttcttacagccttccccactaacccctctcctcagagtcatcacaaaacaaaacttaagcagttcacatgccagtttctgtggaaagcatcactggtctaatttagttgttattctgtgtttccatagcaccttaggaaaatcagtattacagaagcacaggggtactatatgtgaattgcaagtttgcttctttgcccatccctcagtagactcaataagggcagaaatgtgatcttactgtgttcacttccttagtacctgaaggtccaatcataagagtgttatctctgaagttagacctaggtcattgctaccttttttgtatgatagtaattaagtaagtaacatcagtttcctcatctgtaaaatggaaataatgataataacttcataatgatatgaatctcttaatgcctggtatgtggtagcgcttgttaagtgttagtcattattattaatggctaagtgaatggagcaggctagagtctaagtttaaagataatacccttatctgacttctccaaacaaactctactcataaggagcacgaatgtggtagaatcaaccccaaacaagacctctgtaaaaaagaacaggccgggtgtggtggcttatgcctataatcccagcactttgggaggctgaggcgggcagatcacgaggtcaggagttcaagaccagcctgaccaatatagtaaaaccttgtctctactaaaaatacaaaaattagccgggcatggtggtatgcgcctgtagcagctactcgggaggccgaggcaggagaatcgcttgaacctgggaggtggaggttgcagtgagccaagatcatgccattgcactccagcctgggagacagagtgagactccatctcaaaaaaaaaaaaaaaaaaaaaaaagtcagtgtggataacattaggcacaatatacagttatgtttggtgatcaaaacaaggttttattctgtatgaactcctgccaggggatagaactaaaacatgaaaagtaactactacaaaagcactgtagatccttttgctgatgtttcactatcactgtaagattttaaagtatgagtacccttcaaaagtgttctgttttcagtaagttgtaatagctcaccttataacttatgtgcaataaaaattcccacttggctgggtgcggtggctcatgcctgtaatcgcagcactttgggaggctgaggcaggcagatcacgaggtcaggagtttgagaccagcctgaccacaatggtgaaaccccgtctctactaaaaataccaaaattaactggatgtggtggtgtgtgtttgtaatcccagctactcaggaggctcacgcaggagaactgcttgaacctgggaggttgaggtcgcaatgagccgagattgcgccactgcactccagcctgggtgacagtgcaagactccatctcaaaaaaaaaaaaaacaaatgccacttggccgggctcggtggctcatgcctataatcccagcactttgggaggctgagatgggcggatcacgaggtcaggaaattgagaccatcctggctaacatggtgaaaccccgtctctactaaaaatacaaaaaattagccgggcgtggtggcacacacctgtagtcctagctactcaggaggctggggcaggagaatcgcttgaacccgggaggcagaggtttcagtgagccgaggtcgcaccactgcactccagcctgggtgacagagcgagactctgtctcgaaaaaaaaaaagggtttttaaatgtaatattcatagttctatgagtgaaggattatcttcctcttctaagaatttgcagagtggttaagtgcctaaaatagggtcttttacatgttagacactcaataaatatggttgaaagaatgaatggggaaaaaaagaatgaatgacttgtcgaggtcaaagaactagcaagtagtgaaacggattcagatctggctttatgactccaaagcagtttaaagccataaatattatgcttgccaaattaccctcttccacagctatccaggaattgtagaactagacaaaattggtgttctaaagcagtctggcagtcaaactggtcctggcaaacctgtttgcaaagttattacacaagtctgccagtcaagatcaagagacatatctaaggaattgcataaaggcaagcactaaaaatattaaacatatgcatagattcatatgtaaaggtaaaggaagatctatataacaatcaagacttctggaactccgagctcctcagcctagcatttgaagccctccataatggaggtctttaacattgttaaggttttctctgtcagaaacctttcttcacatcaccttacacttcttcctcattgctttctaacacgtttcttaatattcccccatcgtcgtttctgaactgttctatgtctgaaatcatcctccatatctacttatcaaattattgtccatttttcttcatagtactttaaagtattctcccttctccacaatcttaacatcttttcgaacctctctgaggtcagtgatttctatcttttattcctgtattattacagataataggaatcaaataattatagagtgaatgaatgagcggtaaacttctagcaggcaggagtcttgttcaccttgtatcgcccaagcagcctagccttttgggagataggatgctcaggtttgaagaacatagaatcaaatataggttaggggctggattctacctctttgtagcttgatgaccagggacaattagttccacctctttgtagcttgatgaccaggggcaattaacctttcagaagtataattttgtgagtaaaatgaaacctcaggctaaaaaaatgataatcagtagttctttgtatgcagttcagaatatgcagaagtatttcttgaatctttatacagttgaattgaatcaccttctagtgtgctactttccaagggatatactgataagtaatcagttattataaaaacatatatagtctagaattcagggtatccacacatgaaacaaagcaaactgtacaagacaataaagtatgtgatataggaattcagaggagaagagaaggtcattactaaacccaagtagaggcctgaaaggtgatctgaaagctgtgcagtatttggaagggagcaaaggaaaggaggatgagaacaatatgaacaaagattgtagtgagcttgtttttgacatgaggggatgtcagacaagctctagagaaaaagccacattttggagaatagttgtacaatagatctacctttgaaaggccttcaaacctcaggaagtctttccattactcgccatttctgtcctcaaattcattcaacatacatatattgatcattgaccccatctattgtttgagcctcatttcccagtagacttctctcacgcagccttcactgcagtcacattgagcttttggctgcttcctgaatgtggtcatttttctgcccttcccacctttaatgcctcagtagcatttggcgtaactgatcccaccctcctatttgaaacagttatttcttttggctcccttatactagactttcttgatttttctcttctctcactgatgatttatcaatctcctttaaactgactcattctcctctgcttgatttcaaatgactgaaatgccctagggttccatcttggcctctcttttgtctgtgtcacttatttttctaggtgatttgttttggcctcgaagcctaaaaactgactatatggtactgactctcctgctctgggctctcttacttgacctttgagtcttatattcaactctacatgacattttttttttttgactgtctaatagacatctcaaaacatctcaatggacatctcaaactttgaacgaaaacttcactctcaatttctccacctcacctgccactactccactttttcttgttaaatataattccattctcttatttacttaggccagaaaccttggggttatgtttttctctcacactccatcagtaagtggtctgacttccacctctaaaatatattctgaacttgacagtttttcatctgtgcctctaccaccttagtccaagctactgtcacttctttcctgaaccagcctcctgtctgctctccctacccccagtctttgctcactgtggccagagcagccagaataatcttgtataaatgtaaatgtaagtcatatcttactagttctctttataaaatgttccaggggcgggccgggcgctgtggctcacacctgtaaccccagcactttgtgaggctgaggtgggtggatcacgaggtcaggagttcaagaccagtgtgaccaacatagtgaaacctcatctctactaaaaatacaaaaattaactgggcgtggtggcgcacgcagctccttagcacctggaacagtgcaagtcatcaagttaatgttgatacataaatgaataaaatcaaagtcttaactcctatggtagtttccagaaggcaacatttctgtgtgagatacaaagatgaatgactcttgccttctagaaattcaccattcattatgcaataaatatctgtagtgtgccacacattatgcttaatttcttttctttcttttcctttttttcttttttcttttcttttttctttcttttttttgggacagcgtctccctctatcgcccaggctggagtgcagtggtgccatctcagctcactgcaacctccaccttctgggttcaagtgattctcctgcctcagcctcccgagtagctgggagcccagcacgacgcccagctaatttttttttgtattttaatagagacgaggtttcaccatgttacccggggtggtctcgaactcctgagtccaggcaatccacccgccttggcctcccaaagtgctgggattgcaggtgtgcaccagtgcacccagcccattatgcttaatttttatggatataatgacaaaggtccttgcttcaagaaattctattttagttgggtgtgattttcttttattttggttactaatatttcatgttacatatattggtgctcgctaagtatagtctacaattaacctgtgaacgctatggaagacaatagggcagacagattatctgcctaattcttttttttttttttttttgacacagagtctcgctgtgtcacccaggctggagtgcagtggcacaatctcagctcactgcaacctccacctcccaggttcatgccattcctctgcctcagcctcccaagtagctgggactacaggtgcccgccaccacacctggctaatgttttgcatttttagtagagacggggttttaccgtgttagccaggatggtcttgatctcctgacctcgtgatccactggcctcggcctgccaaagtgctgggattacaggcgtgagccaccgtgcccgtcctatctgtctaattctgatctttatgttgtgtgtgtatttgtcacatagttacagatgggcaaaggaggaaagttgaaggttaaaaccatggagcacacccaaaatattttcctggtaccataggcatggcaaaattacacttgagacagacagtagaaattattcaggcatactgatgataggtctttattttcaatactgatgaaaataatatttctaatattagtttaatactcatttaatattagtttaatacttctgtatttcacttgtaattgaaccagagtctttgagtatacattttagtagcatatttggaatttgatataattgacagttccaggaggagataaaaatagaaccatgacttacatttcttgattttttcactaatttcaaatactcttcatggttctgataaatttctaaattttggaactttgttataggctttacaaaatgttgctatgatttctccagtttctaaattctgtgtattactgagtcctaagtgaaagcacaattattttgaatgaatttttacataacaattgaagttctgtagatttcaatatcttctgaattttgactgaaatcagattcatgaatataaataatagtttcatacttctgttattctagaacagctgtttcacttggaattgaaccagagtctttgaatatacattttagtagcatatttggagttgatataattgacagctttgttggaggagatacgtatgcagatattatgaattagcctatgacttgtagaaaattcttaagtatacaaagcatttagacttgaaatttaaaaacaccttggtagagaaagagttaacaggttagctccccttggttgttctcagtgtgttctcttgcctttaggagctgaaaatatgataacattgggcccagacatgcctgtgtggaggttagggtactcctggggtttttgcagctagctgtaaagcaagctagaacttgttcatctctgagttccttgtttttctttcaaccctttcagtgccctgcaggagtcattaaatcaaaacttcatgctgatcatcacccaccgagaagtccagcgggagtacaacctgaacttctcaggaagcagtactattcaagaggtgagttatgtctcacagctaagaaataaaggtagctcattatagctaatgttgaccctgttaaagagggcttatctgttctggttggaaattctctttatgtttcattattgggttcttaaattttaattaactggagcatcaatgattactgtagatatactaaatgacttgacctagaaagatgtaaatgggaactcttgataatttttaaactagtcaacttgaaacgctgcttaaaaataactgattattatgtaatatatttcatggttttatagtcattattcaaaatactatggaaattgttgacaacattcattttggaggatgcttatattttatttgaaaggttgctctcaaataattatttatattgtgtactctgcctgtttctaaaaggaatttgaggggacttttcttaagcagctccatcctgcccttgggcagtatgcctaagatgctgttggagactatcttttagcttagaatatgagaagagtctatttatagtgtcagtattttcttcaacacgaccaaccagggccactgtttcaaaagagaacctcccccaagagagaagaggtaccttgttggtatgccttgggccccagccacctaaaagctagtaattctatcttcatggagggtggggggaacatttaaggctatgacaggacttatgtttagaaacattgaaatgatgactatgttgcattacaccttataagttatgaaagcaacagtcatttgtctactaatttttctaaagagaattaatcatgcttaatcttggattattttataatgtttttcttagactacatttcttaaaataatcacttaatgtcattttgaaagaaccagttttcaccctagtgttttctttcagaaatatatgaactgtttctgtagactattaatggtttccttttttatattgtgttaatgaatttcagcttctgaatttgacatgaataactcattgctttattttcttcattgattacttgaatagtttgttgactctagaaactaaactctttaaaatttttttctgatctgattcctaaactgaattgtaggtttgcgttatttaattttttttcaggattttaaatatgtataaattgtaatttcattttcaacctccataatgagtattttattctctaaattaaaaaacttaattccttgaagaatcatttgtgtttttatggtagaaataatgttttgccgtggctccatctccgagttattatagcatctgaaattttacaggatagtaaaatctaaattgtatatgtgaatatatgaaacaaggaaatttagatttaaaataacttcagtttaaccaacatgacaaagataagaggtaaattcattttattgctgacttgataattgaagaatagtataatgtatgatgaataaatatagtttgcctttttttccttcggggttgaattttctagccataattttgctgccaccctctcaacccccacccctagtttctgttatttgagtgtgtttcagctttctcccacaagagggcagaaaggactattcagcagatagcctaaaaatgctattcagtgttttcaaattagcttctcttatattaacaaaaaggagcataatggccaagttattgtttgatttacagataattggcatattgcagggaggagacttaatttcacccttttaaattaaacagggagatttaaaaagacataaaatattcattaatgttcggtgattataaagtagtggcatatatttattttgcctttattactgtttcgatgggaaaatactgcaaatatttccgaaatcgagttggccatactgacaagttgaaatgtttaagcagcgttaatgcaatctgctcacacctgatatcctatgcagaatgattcaaaatgactacatcaattattaaaagaaatatttaaaattctgtaaatgtgccattgtgtgccacagttggctgaaactgttctccgtggcctgctatgtagattatcaaatatatcttaagcttcaaggacttaaaacagtaaatcttttttataccattttctaaatgtcattttaaaaatgttccagaaatatttttgcaaagacagatattcttatgtatttcttgtcaagaatttggtttcttctcctttttcctttttttccctttaagttaatttaaaataatatttttaaatgctagtttgccaggaacaaataaatgcagttgctacttatgtcacttgcttctctgtgagtagacaggtacacataggctgttttattctgtacaacttagataaaggatgtgggacctctctgggcctagttctgtgacttttctgcttcaacttgtgcaacacctgtgatggagggggtagtttcaggtgaaggacaaggtgcccttatctacagctattcaatccacaatgacacttaagtatgtacattttttcttgttgcatgattggaaagttagtttgattgcatcaagataaaaatataattgtgaaactattttgtagttttattttataatgctagtatttgtcttttattaatgtgaaagcttaatgataccatatgtgctaaattgtaaattaatctatctcaccagtttcaggaatttcttttcagtattaataggtccaagaataaatcctgactaatataattgagggaaaggaaaaaatgttcaaaacacaaaggttcctggtcatttttttagtgtattttatatatatattttttttaatttttgaaagccttgcatttttaaaagaaaactttgcactatttttcacccagagggaaatttctattaaatgaaacaggattgaaaaaggcactatgatttcaacttttaattagaacaaagtacatttttttaaaatactgagttagaaaatagaactaaaatgcagtttgaatttcaaataaactattcaatgaccatatggtcattgcaagttaatggtgataaaccaagagttgtacaagtgtttgttcattctggctttgtggtctgctgcctcacaatgcgtgacttgtgtcctttaggtgctctagattttaatttaagccagttagttattgagggttttcattttgattttgtttttttaaaactctgtacaaatccttccagttacattatcctcctggttggggagaaagcagtgacagtataaaaaggtcagaatggagagagttgcaagtagtcttaaagacgaaaaatcttttctgttttccattatgaccaaacagcttgtaaaaaatatcaaagaatgtgacagtaactctgtgatagtctgtcttttcaacctttttgggtcctaaattaactatttgtcacactttaaaattgtgagtttccttaaatttaaacaggcttaccttattttaatgaattttttttacgctgagaattcagatttgtcaacagtttattgtgcagattctagtaattctcactaatactattaaagatctgtggttacaaatgcacttggggtgggttaaattaaggggaaaaaagattgatttgctttcagcaaatccaaaacccaggtgtggaaaaggatatgaagtctctgaaatcaagccaacttttcttggaaactgattctttgttatcggccttactactgcagaagcttctgttaggcaaaatattgttttctttgtagatgtcatataaatttaaggaatatacacatgacccagaataacaataagaaacctaagtatttttagtgcagaattatggagtattacttatctgttacaacaagaagcatgatgaatagctattggaattatttaaatcctcttccaagtttcactttacctcagaaatctcactgttcttattattgttgatttagttcttaatggcatgaaaggggaaaattggcaacctataaagatatatcttgcagggagtagtaaaacatttcagtactattacagtttgtacaaagtagtgattaaatgggaagccaatagagttgaataagtctcaggaactgaatgaactaaatacacagattataccaatccttaaaaataatctgggctaaataatgataaggctaactctgattctgagcatttgaacctaacgtcggattttgtatgttgtgtctattattctacttgctactttcttaacttgcttgactagcgtatattttggactattctcctttaatgctggtggccagtaacagtaattaaaatatgtagtctttcacagattgtgctaattattgatgttctagtagtgggttgactataactccttaactaacatggcctttctgtaaatgttttaaagtattgggtgttttttttggtttgtttgttttgttttccagtatggggagggttggggttgctggcacagaactgaagtaagagtagggtaactgagaatgtgcatatgcaagagggtaaattaagttgtgtgcttatttaattaaaagtgtaagtggtttgtttttactgcaagataaatggcatatattggatcaattagaatgaaccaatttaattaacatatattatagtttgattttttaaaatttgaaatcacgaatgacattttagcaagaatgaaagagataatttcttctgcaactgggcagtgaattcaagcctttattcagctttcagaaaagacgattatgcatcttttaaatatgcatatatattattagtttcaagttgcatttgaaaactgagatctgttgaaatcataccacttcaaatgaatataaatcagtagggatcattttataaatattgaggtttcctgtgattcttaacaaattatcccctgaagtaataaatttaatatttataatgcagctctttggaactgacaagtcttttcccctctctggaactattttagaataatctggattggatatcttttttggcccatataagtatttgtctacctgcatttcaagacgatagaagcaatgacattttaagaattaagaacagtctttagccttttgttacttaagatatgtgtatcaaacatgatagctgaccacatttcatcatctgtgatttatgtgttggtagttttgaaatgcctgggttaagagaaattccgttcagttatcagaaactaataaacataagatttttttatatgcaagaaaaggcagagagtaaataattgcactggtgaccaatactgtaataatcctgttttacaatatgcacttgacaggttgtaatagtgctaattgaagagactaattcacacttgcttcattctattcaaaggcaaaatcagcagcttgttttgcttttgaccagatggtcctcatgaacacctactgtgcactttaagtgctttactagaattacaaaggccgggggctgcgttcgactccaaatgatttgagaagagagagagagaggggggaaaagaacctctgtgctcaatggatttggtgcaagtaaattaattctagtggacccattacacacagcccccttttcaaagctctgagcctcctcgcttgctctgtagcaatgagaaagagaaaggcagattactgcaaacagaaataaaaaaaaaaaggggggtatgaaagggagaaaagaggccttgaagcctttcatatcatttgagtttttcaagtgcgttatttttggggagggtggatgtatgaaaagccaattggagttttttttgttttaaagtgcgctatttaagcaccatgaatataggcgcaagagcaacagttgactgagtttactgtggtgaagctttgtgtccgaggatgaatcaaattcattatattcaactctttgtgttttaacatgaatgtagggttagtttcacaagactgtgtctgtttaggataattataatttaatattttcctttcataaagttatcactgtagatgtctaaaattttaatcaaagcagattttgtacattgactttgaagcaccctgacagtttaaaattcaaaggaaagcttttttagttttcaaaagaaaaggaaggctcattctaatggcattgaagcagagattattataactaattagaagtcacacatctgttagcttttggtttctgacttacttatgtattttttgagtaaaatatatactttaaaaatatattgctgttattgtgtgaacctaaagggataaaatgcacttaaaagagaaccatttatttgagccaaccattttttgcaaatctctagatggtcctataaaaatatgtaatgtaataaagtacattaagtgtgaattgcagttgtataattaataatcttactttggaatatgctttcaaacaatattttcacacagttctgttgtcataattctgattattaaccaaagttatgagattaaaaaaacctgtccagtttgtacaaatttatagttattccttatccttaaagctgttcatgtatagtactgtaatttggaatactaagactgtgaaataattagttcttattgtaaactatgtgggttaggatacaaggaatcaaatttaggaatatacatcacctgctttttatgtttttgtagttctaaatttaattcttgtgatatattttagtggcattgtttacttttgtttgatggcatatattaccgccaccatgttcattttaattttaattatagctattatcaaagaatacaacaaaatcataccaatagttcatcatgataattgtaaatgtttcatagtcttcttaaagtttgtatcgtctcttcaaattaatgtctagaatttatattttaaaaggcatattgcatcaataagctttttatgtcaataagttttaattacatttttagaaaataaaacacagaaatgcacaagcaaccccaaaaatcttttttatttcttaaagacttcatttaagaaggtagcatgccttttatatatttaaaataaaatttgattcatattaatgtactcatactttgggtagtgctcattgaaatgtaagttatagggtgaggagggatataaggagaattcccaaaccttccaccagcaaaatatacaatgaaatttgtaagtaatgaggcattaatgaattgatatccttggggagaaaaacatttcaagaaaaaatatgaaagattaagaaaaactcactgcaaaaaattttttgcagcagaccatttaaaataaaggtaaaggtactagatttctttcttgtaggtacaataaaaagctatctttaaaggcagaacctcagttagcagaagtggattgatcatgaccatgtagtcacttacttagatggggctgattctttggtttcacagagacagtgctcctcatgcatgaagaagaggtttttctttttcagtattaaaatattaactcctagattcctgaatgccagagacaaggttattttcctagggtatgtgttgggaaaggctataatttcttcatagatgtggtaagtaccacattacttaagctgagaactattttaatgtttaactatcttctagtcctaagataagaaatagtaaccaacctcttcattcctccccaaccctctgtaaaacaaacacacacacacacacaagaaattaaaccaaaggatgggtaagtgaatataaagtgctcataaatataagctggaccaagacttggcatattaagataaggcctgcatgtagaaaattatttacatgtttatctttatatgccaaaggttatttggttacaacctcttcaaatatctggttatggtaatttttcttttgtctaatgtgtcttgtgtatgactcagtgttatacagttaaggagtttttctttttcaaacatactttttgtgataaatattcttttaaaaaatcctgctgctcaatatagggctatagtatagtaccttattaccctcaatgtactcctattattattttgaaaaactttttttttagagaaaaaagattttaaaagcttgtagtaaacattttatataaatgacaaaatgtattccttgctttgtggtcattgcgtgaccagacagtagagtactggattgttctagggttttacagctgcaaggcaaaagcatctgctcattgcaaagccggcattgtttaattttgacactgacttttccatgagtcttgtaccaagcactggattagatgccactaagatgaaatttgttttaagttgctcccaaagtgcagctgttcctatatacggccctgtagcttaaccaaaacagacagacataggatcaatcagaatctttgtacagggtcacctcagtatgctaggggggcccagagagagaatgttaatgatattatttatcatgaataactgcaaaattagtttctgggcttatttaatgtctatagtacagccccccaccttttaaaagcaatagaactgttattaaatatttagctttttaaactggattatcatggctaagtattagagtgtccctgtatgcattaggcactattcttccacaatcaattgcaagaaaaattagtttattggtcactaaagtagtgattggctgaaaataagacctattctaaaattgtttgcggaaatcttgaaaagtggacatttttatagaatgataatttttctttaatgtttcaagtgaatgaaaaatgaaagagcacctcacatcccaggtttcctgggattgtgtgaatttctacccagctggtccaaattgattgatacagggccaaatatttgtctgcctacatttcaaagtctataatttgctaatgaattgtggtaataatctttcatcctacatgaaagatttagccaaacaatttgctaagtatatattttgatcatacaatttttggacttacaccaagctttacatctacttacagctaatgcatgggggtggagggagggcagtaggaaaaataatactgaacatggacgcttgatggaaaagaatgaaggaagcgtgaggaaagaaggtactttggaaaagaataatactgggaaagtcccatgagtgacacagagaaaccaattctgtttgtacttagagttcaaaatagaatttaaaaaaaatgccagtacagttttagtccatagtatccagagatatatggtatccatttagatgaaggctaggaaggaatctttttctgttttggctacagctattccacacattgattatgattataatttcctaaaaacttgatgctgcaaagtcaaatacccacaaagtttaagtaattgaggcataacaatcaaaggcaaatgtttgttggggttgattaaaaagaatctaatgaagaaataaatgtgatttgactaattccagaagaagctgagacaggaacctagtaaagcttttgacatgactgtaggcacccaagagaacattttctccctccaaaacaaggaaagactgtataaaggaaaattaggcctgtttctgggaggatatgtagcattaagttacctttgcttgggaaagtgtaaaccttattttttatgtattttgggagaggagcataagatatactccagaggaaatccaggattacactatggaatgagagagctaggcaatgttcaaaataagattctatcttacacatgtaatacctcttccattgttagaaatcaaggtgccatgatttcctatttgacttatataatttgaattgttttcaagttgtccatgtggagaatcttaaataatattgatagaatttcccttgcctagccatttaataccaagtagttaaaaaaaaaaaaaaaaaaaaaggccaagcacggtgactcacgcctgtaatcccagtactttgggaggacgaggcgaatggatcacctgaggtcaggagttcaagaccagcctggccaacatggcaaaaccctgtctctactaaaagtacaaaaattagccaggtgtggtcgtgggttcctgtaatcccagctactcaggaggctgagacaggagaatcacttgaacccaggaggcggaggttgcaagtgagccgagatcgcgccactgcactccagcctgggtgacaagagcgagactctgtctcagggaaaacaaaatcaaaaacaaaaaactttgtcttatagagagaaatcatatatattataaaagagatgggccctccattttatagattttaaagataagcaactctagaatttttatatacctgtgggacctcttaaatgtatagttaaatgacacatttccagaggattaatttgtattcatttatataattccccttttgttctctgctggaaataagcctcctttagatgttaatacagtggatgtctatccaaggtgggcaccactggatgatttttttnnnnnnnnnnnnnnnnnnnnattttttttttttagtgcaatggtgcaatctctgctcgctgcaacctccacctcccaggttcaagcgattctcctgcctcagcctcctgagtagctggggttgcaggtgcatgcaaccatgcctggctaatttttgtatttttggtagagatggggtttcaccatgttgggcaggttggtctcgaactcctgacctctggtgatccacctgcctcaacctcccaaagtgctgggattacagacttgagccaccgtgcccaaccaacaatctttaaagtatttaggaaagttaagaatctatgtgtaactagagctttattcagatgaatagaaaattttgttttacacattgactttcttagcctctttccttctattttgctgacagttagaatctatcaatttaatacatgccataattttttttttgagacagtctcgctctgtcgccaaaggtggagtccagtggcactgtgtcggctccctgcaacctccacctgttgggttcaagcagttctccacctcagcctcccgagtagctgggactacaggtgcccaccactacgcctggccaatttttttttttttttttttttgtattttttagtagagatggggtttcaccatgttggccaggctagtctcgaactcctgacctcaggtgatccgcccacctcggcctcccaaagtgctgagattgcaggcgtgagccaccaagcctggcctacatgccataactttttgtaggtatattgttatcacgttatggtagttaccatagcaaatacttaataaagttttggtttggagacctttgtgggtttttttttttttcctggctatagtgttatagaagagatccataatcattactatgaaggaaaacttataaagaaaatcacatttaaataaaattaattataagtgagataattagtaagattcctgatttttttaatgaaaactcaatttcaagagcaaatattagagttacaggttatgtagctgaaattcaaaatatgctattagcatttgtttctagtccttttggtgttctgttatcaaaggcacattatatttacatgcctgcctgcctttgcctaatgaaaatgtgaaataattcctcctaagaggtatgtttataatgtcctataattatcatcataagaaaagcatatcatttaaatatcagttcattgctgttgaatcgggagatgtttcccttattcctcatatcctaaacaaggaaatcttaataaggtatttttaaaggctgctgtttttttgctggtcagttttttttatatatatgtcatgtatatgtcatatatatgtcatacatgtcatgtatatgtcatatatatgtcatatatgtcatgtatatatataatgacacatatacatatagatcactttgcttgaaatttgaaatatcagaaatatagtaaatatcttaagagtcttgatttctgttgataattcttatttcaaatattgactctaaaatttggtcattatgtgggaatttagaaatctcgtgtgcttcaattgaaccatttatgtgggtgtgtgagagagaggggtgtgtgctagtctgtaggcagtgactgtataagtaaatgtgtaaatatgttgctgtgaaatgtaagtaatcttttaatccttaaggtattacttaaagggctcagggttgaaatagcgttttctgttgccgtggtgtttgaatttctataaatcaatttttttaatgaataataagaaattttattttttatcttaaagtagacttttaccttatatgcatatgctacaataagattgtaaaagtaaattatatatacataacaaggctttctaatacataagattttataatattgagagataataaatgtaaatggtactaatttgatgtcattagctttacttgtgttaagtgaattaaaattccatatgagtattaagactgtggaaccagcataaggacagacagatagatcagtgcactagaattgagaacctagaaagaaacccttacatttatggtcaattaattttcagcaagattaccaagaaaattcaacatatggtgctgggacaactagatatctacatgcacaagaatgaaactggactgttccctcacaccagacagaaagaaaaattaacttaaatcacagatccaaatctaagacttaaaactataaacctcatagaagaaaacaggaaaaatttttcgtggtttttgggttaggtaatggtttctcagttaggacactaaaactacaaacaaggaaaaataggttatttgaacttcatcaaaattaaaaactttagtgcctcagagggcatcatcagtaaaatgacatgacaatttaaagaatggaagaaaatatttccaaattgtatattgataagagacttgtatctaggatatatgaagaactcttacaactcaataataaaaagacaaataatctaattgaaaattggcaaagatctgaatagacatttctcaggagaagatatgcaaacagccaataagcaaatgaaaagttgcccaacatctttagtcattagggaaatgcaaataaaaaatccaaagaaattgaaatcagtgtgttaaagagatacctgcattccagtattcattgaagcattgttcacaataagcaagatatggaagcaatgtaagtgttcatcagtgaatacatggatagagatcatgtggtatatatgaatatatacaacagaatactattcagcctttaaaaagaagaaacttctgtcatttggaacaacatgggaagacctggaggacagcatgctaagtgaataaacatgttctcacttatatatggattctagaaaagtcaaactcatagaagtagagaggagaacagtgattaccagaggctggtggtggggtgtggacgggtaggaatgaggaaagcggagatgttggtcaaaggatacagtttcagtttgacaggaggaataaattttaatggtctttcgtacagcagggtgactatatttagtaatgtgttatatatttcaaaattgctaaaagattagaatttaaatgttcccaccacacacacacacacacacacacacacacacacacacacacacacacacacacacacacacagtaaatacttcaagtgctggatatgtgggggttgttgttgttttcttacccagtctgcagtgcagtggcacaatcaaggctcactgcatgctcgaactcccgggttccattgatcctcccatctcagccacctgagtagatgggactacaggtacgtgccacaatgcccagctaatttttgtattttttgtagagatgaggtttcaccatgttgcccaggctggtctgatacacctgggctcaagtgatctgcccgcctgggcctcccaaaggattacaggtgtcagccaccacacctggcctgctggatatgttaattagcttaatttaatcatttcatagtgtatacatatatcaaaacatcactttgtaccccataaatatacacaattattatttgtcaattaaaacaaagaaaaatggccaggcacgatggctcacgcctatagtcccaggaatccccacctctactaaaaatacaaaattagccgggcgtggtggtgcatgcctataatgccagctacttgggaggctgaggcaggagaattgcttgaacccgggaggtggaggttgcgtaagccgagatcgcgccattgcactccagcctgggcaacaagagagaaactctgtctcaaaaaaagaaaaaagcaaaatgaactaccccttcacaccactaggatggctagaattttaaaaggtaggctgtatgcagtggttcatgccggtaatcccagtactttgggaggccaaggccagcggattacttgaggtcaggagtttgagaccagcctgggcaacatggtgaaacccatctctactaataacacaaaagtgaagtggacattgtggtgcatgcctgcagtctcagctactggggaggctgaggcatgagaatcacttgaacccgggagatggaggctgcagtgagctgagatcgtgccactgcacttccagcctgggcaacagagtgaaactgtctggaaaaaaaaaaaggtgacagtgacaagtgttgtattggcaaagatgttgagaaatgagaactattacgcattgctggtggaattatgacataatgtagtagctgtggaaaaagtttgatagttcctcaacatgttaaacatggttaccatctatctgacccagcaattctactcctagatatgtaacaagagaattgaaaacatgcatccacacaaaaatgtgtatgtgaatgtttataggagatggttcataatagccaaaatgtggaagtccactaatgaatgaatggataaacaaaatgtggtatatccatacaatggaatattttcagtcataaaaaaatggaatgaaatacagatacatatgacaatgttaatgaaccttaaaaacatgctaaatgaaagaaactaaacacaaaaagccacatattatataattacgtttatatcaaatgccgagagtaggcaagtctctggggcatctggctggagggaagggaaaatagttaatggttgctattgggtttgaatttttgttgtttttgtttttacatttcattaataatcacaagttatgtagcacaatgcattttaaatattaaacttcttcaaataattattttctttgtatgcaacagttttttttgtttgtttgtttgtttttgagacagttcttgctctgtcacccaggctggagtgcagtggcacgatctcagctcactgcaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggcatgtttttaaggttcatctgtgttgccacatgtaatccgtattttattcattaagactgaatgatattccattgtgtgggcataccacatttttgttcattcattaatggatacttgggttacttccaccttttggctgttatgaataatgctactgtgaacattcatgtacatgtttttgtttggacatatgttttgttttgttttgttttttgttttttttcagacggagtctcgctctgtcgcccaggctggagtgcagtggcgcaatctcggctcactgcaacctctgcctcccgggtccacggcattctcttgcttcagcctcctgagcagtccggaccgcaggtgcctgccaccatgcctggccaattttttctatgtttagtagagacggggtttcactgtgttagcgaggatggtctgtatctcctgacctcgtgatccacccgcctcggcctctgaaagtgctgggattacaggcgtgagccactgcgcctggcctggacatatgttttcagttctcttgttatatatctaggagtagaattgctatgtcagatggttactttatcatatatatgattttttctgtgttttttctaattgtaaaatatacataacaaaatttagcattttaaccatttttacgtgtatagttcagttacatcaagtaacattcacattctcttgcaaccatcactttaacccattttcaaaaccttttttgtctttacaaactaaaactctgtacccattaaacagtaactccttattcccctttgcctctagctcctagccaaccatgactctactttctgtcaaattcttaatgtaaccaccctagttacttcataaagtggaatcatacagtatgtggccttttgtatttggcttatttcactcagcttactgttttcaaggttcattcatgttgtagcacatgatagaattttattttattttattttttatttttattttattttattttgagatagagtttcgctcttgttgcccaggctgtagtgcaatggcgcgatctcggctcaccgcaacctccgcctcccgggttcaagtgattctcctgcctcagcctcccgagtaactgggattacaggcatgcgccacaacgcccggctaattttgtatttttagtagagacagggtttctccatgttggtcaggttggtctcgaacttccgccctcaggtgatccacccaccttggcctcccaaagtgctatgattacaggcgtgagccaccgcgcctggccggaattttattatttttttaaggctgagtaatattccattgtatgtaagtaccacattttgtttatccattcacacactgatagaccattgggttgtttccaccttttgagtattgtgaataatgctgctataaacatgggtgtacaaatacatctttgaggtcctgctttcatttctattacgtatacacccaagaaatgggattgctgaatcatatggtaattctgtgtttaagtttttgaggaacaggtttccacagtgaatataccattttacatttcctccagcaatgcagaacagtttccatttctccatgtactaaccaatacttgttattttctgttttgttttattttattttatttttatttttatttatttatttattttttttgagatagagtctcgctctgttgcccagcctggagtgcagtgggtgcgatctcggctccctgcaagctccacctcccgggttcacgctgttcttctgcctcagcctcccgagtagctgggattacaggtgcctgccaccacgcccagctaattttttgtatttttagtagagacagggtttcactgtgttagccaagatggtctcgaactcctgaccttgtgatccgcccgccttggcctcacaaagtgctgggattacaggcgtgagccaccgcgtgtttcattttttagaatagccattctaatggaggtaaagtggtatctgatcgtggttctggcttgcatttttgtaatggctagtgattttgagcatcatttccttttttttttttctttgaaatggagtcttgctctgtcgcccaggctggagtgcgatcttggctcactgcaacctctgcctcccaggttcaagcagttctcccgcctcagcctcccaagtagctgggattacaggcacgcgccccatgcctggctaatttttgtatttttagtagagacggggtttcaccttgttggccaggctggtctcgaactcctgacatcaggtgatctacctgcctcagtctcccaaagtgctggaattacaggcatgagccatcgcacccggccagttttgagcatcatttcatgtgtttattgaccatttatagaacttctttggaggaatgtctatgcaaatcctttgcccatttttcaggttgggttttttttttttttttttgattgataaaacgttctggaattggttaaggtggttgtatgactttgtgaatatattgaaaaccactgagttgtacattgaaatataaaaaggaaactaaatatgaaatggagaactgagagcttaaaagacagctacacatacaaaataaaaaattattccgaaaaggaaaactagagaatcgggaattatgccacttgggtaaaatataaaaatgccaagtttcaggtcgggcaccatggcttattcctataatcccagcactttggaaggctcaggtggacggatggcctgaggtcaggagttcgagtccagcctgggcaacatggcaaaaccctgtctctgctaaaaatgcaaaaattagctgggcgtggtggcatgcgcctgtaatcctggctactcaggaagctgaggcatgagaatcgcttgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattctcctgccccagcctcctgagtagctgggattacaggcattcgccaccacacccagctaattttgtatttttagtagggacggggtttctccatgttggtcaggctggtctcgatctcctggcctcaggtgatctgcctgccttggcctcccaaagtgctgggattacaggtatgagccaccgggcccagcttctgttacattttttaaaggggacatatttctactctgtttctgactattagatggcagttatgttgaactactagaataacatttcaagtgggttgatagcaatttttctaggttataatatagacagtggtactattattgggtaccgtttacattatcatacagggtttctgtgactaaccttgcatagtgcttccatcagtattttttctgttactataatgtagtgaaagtgtatttgagcaggggatgaatactttagggaataaagatattaattagcctgttaggaaagcatattctcaatggggaaattatcatgtatcatttatatttctagttgagatccattagaaaggagaatggtttttacttcatagtaatttgagtgtatttctggggaaaatctgctagtcagtgatattctagttactgaccttgaaaattcatgccaacttcattgaggggaaagaggaggaagcttcatattgagttaatgttttatacttttcaactcatttctccaaccttagttcatttgattcttaaagcatctactagtgtcagtagctgtacacttgtacacataaagctgaacaagatgaaaatggcatctcctggctgtgcaacacaatggtcctgctgaggatgtgaatataggacttgatagtcaactattcttgctatataaacagagatactgatgcagaagataggtaagtagtatttaagagttcacagtaaggtcattgcttttccccattttatgatttgtagtgctttctctgattccatttcctaaatctttcatccattaactatactatactatatactatagcagtagtttacctcaccctccttctatctcgctacacggactctttatcagtaaagttagcataacagtaggatcacttccctgacacatgttgtttgtgagaatgaaagtgagacaatgtaggtgaatacaactttattaactctagaatactttttatagaagttatttgtctttccatgtacctcagattttaccaactgatatttacttacctgcctctgaacacataaattttttaaaaggatgtgatttcttgctcatgtagttccctcagctcttctccctcagccttaccccttctcctcatgccattcaaagatccgtatgtgtttcaagaagactacactcagctgacacatccttcaggaaaccttctataattctgtgtcgtatatgaagataacctctccttatctcctgagttagccttgaaataccacacagtgatattgtgcctcatacaacattcatttgtataattggtttaggccatcttatagcctatatactcttcgaggaggggtactatatcttactgatgtttatattctctatacagaattttttaagaagagtcaaagaacaaatagtatttgttgaaattaattcaatttcattaaaccaatctatatcacgttctatctatattgtagcagttattggtgttaacttgcaaacattccattgaagttattagttgaatgctcgagcttagtgcaaaaaagctgattattaaatattcaggaattttgtgaatctgacaaagtgttggtaccttgaaattggcttcagtgggatcgtttatctcatggagattggcaaactcttaaaaacactgctttttgttttgggagagccatttaccggtatatcattggttgtatgtctgtaacccccactagagtatgagcttcttcaagttcatctctgcctgaatgcctcgactgtgataggaacattctttgctgaattaatgaataaataagtgattgagtatatcagctgctttattcctctactgcctgacccctgctggcagagaccgaatttcagaatctagtgaattttttgagactgagttttaaaatggtccattgtcatagactgtagtttctttctgcttcagagtttgaaccaaaaaaaaaaaaaaaaaaaaagtctgttggaaatcaaggctattaaacacacatgtttcaatagcacagtaaggatggcatttctgtctattatcaccttgttaagctactcctgctatgactttgctactactaagtttttggcatctattgcttaactaactcacctttcaatttccaagttggaaaccaatagtgtgaaccatctcaaattagctgaaagatttcctttcacattataagaggtaactaactgattaatttttcctagtcatagatgctataataccaacaaataaaaaatgtaatgtcttgaggccttaaaatattacttttttttttttttttgatggagtgttgcccttgtcgcccaggctgaagtgcaatggcgcgatcttggctcaccacaacctccgcctcctaggttcaagctattttcctgcctcagcctcccgagtagctggaattacaggcatgtgccaccacacccggctaattttgtatttttagtagagacggggtttctccatgttggtcaggctggtctcgaactccctacctcaggtgatccgcctgccttggcctcccaaagctctgggattatgggtatgagccactgcacccggccaaaaacatttaaaaaattactatattaaaacaacttgtattttctattaaggttcctatcagttttatcaaaagtaacatttatataaaattgaaattgggatataattttttttttttttaatgagacagggtctcactctgtcacccaggctggagtgcagtggcgcgatttcggctcactgcaacctctgcctcctgagttcaagggattctcccacctcaacctcccaagtagctggaagtacaggtgcatgccactatgcccagctaatttttgtatttttagtagaaacaaggcttcaccatgttggccagtctggtctcaaactcctggcctcaagtgatccacctgcatcgacctcccaaagtgctgggattacaggcgtgagccaccacacccggccgaggtataatgttaagagtcattaggattttgtattttctctaaaacatcctccataaccatgatgtatatatgtttttttttaaaatactgtttttctaaccatcctatgtaacatctattgtcatctaaacctgaaactatttttaatttcttgttaaattttggataagataagtgcactatattcagatttcctttttcttctttttttgtgacggagtcttgctctgtcaccaggctggagtgtagtggtgtgatctcggctcactgcagcctgcacctgccaggttcaagcagctaattttttgtattttagtggagacagggtttcaccatttggccagtatggtctcgatcacctgacctcatgatccgccctccttttcctcccaaagtgctggcattacaggcttgagccaccacgcccggccatattcagatcttaacactaaatattaaaagactaaaaatagcagcttctccctgaagttctcagttttatgttcggtataccatatttactgttagttatagtacctgaagttactttcaaaatggctgagataataccagtatatataatactaaatatatagcagatttacttttgtaaccaaggaggtaagtaggctaatcagttaccaacataatttttgttttggagttctgccatcattttaaacaataggtttaatattttgttggtaaaatcaaaacagaaagtaacataagacgacatgcatatttgttggttttattgaaagatgcaaaaaccttcacagttccacagctctctgcaacctcaatctccctgctcaatcaatcagttctcccacctcagcctcccaagtagctatgactgcaggtgcgtgctaccacaaccagctgatttttttattttttaaaatagagacagggtctccctgtgttgctcaggcttgtctggaacttcctgggctcaagcgatgggcccaccttggcctcccaaagtgcagagattactgatgtgaggactgcacccagcctcacagttttaattaggtacaagtaccctctatctctagaggtacatcctttggcatcagttactcagttacacattgaaatactgccaagtgtggtgactcacacctgtaatcccttcactttgggaggccaaagtgggtggattgcttgagcccaggagttcatgaccagccttagcaacatagtgagaccctgactctacaaaaaaatacaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacagtctcggttcactgcaacctctgcctcccgggttcaagcgattctcctgcctcagccttctgagtagctgggattacaggcacctgctgccatgcccagctaatttttgtatttttagtagagaaggggtttcaccgtgttggccaggatggtctctatctcctgacctcgtgatccaccaccttggcctcccaaagtgctgggattatatgtgagccaccacacctgaccaaaaaatgtattttttaaaaagcaactagtggctaggcacagaagaaagatctggagaagaaaatctggccaaatgtgtaaattacaaagggaaagtactaatttgtatgttttggataacttaagactgtgtgatataaccacttttcattcaaaactaactctagactttaggcccttacctgctccacccagctttaactactcccaccccccttgaactatcccataatatagaatctaaaaactgcataggaatttctccaatctttcataagttcaaacagcatcagcctcataggcaagtgtatagagactgggtaaccaggcaactgtactctattgaaaccacaatgtcagttttattaactcatgggtcaggcaatgtcaagcatatattaatggggcaagttcattagtgtcagtgccaagcatatatggaagggtaagttcattgactgactagggtactgtagagaatctgttttgcctctagcctacatatctcacaaaactcaccatttttgtaaatagaatacaaggaagatggcaagaactgcataattcgataaaaactagttgctcttttttttttttttttttttttgaggcagagttttgttcttgttgcgcagactggagtgcaatggtgtaatctcggctcaccacaacctccgcctcctgggttcaagcgattctcctgcctcagcctcctgagtagctgggattacaggcatgcgcccaccatgcccagctaattttgtatttttagtagagacagggtttctccatgttggtcaggctagtctcgaactcctgacctcaggtgacccacccaccttggcctcccaaagtgctgggattacaggcgtcagccaccgtgtccagccccaattcatatttttaaaacttagtaataagaactaaaatgaaattatttcatttattcagattgacattcagaagtataacaattttccatcacagtgtttacttttttaattactaaagaaatacatgagtcatttttattataaatgactcaggaattcagaaatgtaaaacataagagctcatctttatgaattgcatgaatttctccaggatcagttcttagaaatgaaatggcagggttgaagggtacatgaattttattttaatattgccaaattgctcctcaaaaaagtgttacctacttcttcacctagctagagtatgtgagcaggcatgttagaatatacacaagtatattcttactgacaacagatatgacagtatttttagtttttgcccagttgaaaggtgagaatgataccttgttttaatttgcatttccttaattactaagtgaagttacccatttttctttgtgtatgggtttatcttaataatattattctttctgaaccaagttactttagtatttattcaattataaagtgactaatgtgcatatagcaatggtttataacaatactaaaacacccaattcacattgttaattttactactaagtatttgttgctgtgtgtattttattgccctttttcatgtatatcacagttggaatagaatggagagaggcagcatagcatattggttaaaagtatgtactcctatatctcaagtgttaatgtcttaaaattacatcttgaaaaaaatatatatgcatatatatatttagatggagtctcgctcttttgcccaggctagagtgcagtggcaggatcttggctcactgcaacctcctcttcctggtttcaagcgattctcctgcctcagcctcccgagtagctaagatcacaggcacctgccaccatgcccagctaatttttgtatttttagtagagacagggttttaccacgttggccagggctggtcttgaactcctgaccttaggtggtctgccgacctcggtctcccaaagtgctgggattacaggcatgagccattgtgcccagccttgaatatatttttatattatattccagggtgattgttacattgaaaataatatttacatttttctttttttttactgaaataagtggcaaataaattagtttcattttctttctttctttttttttttttaagacagagtttcactcttgttgcccaggctggagtgcaatggcgtgatcttggctcactgcaacctccacctcctgggttcaagcaattctcctgcctcagcctcctgagtagctgggattacagctgcctgccaccacacctggctaatttttctatctttagcagagacggggtttcaccaggttgtccaagctggacttgaactcctgacctgaggtgatctgctggcctcggcctcccgaagtgctgggattacaggcatgagccactgtgcctggccctagtttcattttcaaatgttcatatgattgatttccaaacattaagacttggttggaggaatggctggcagtgtgaaatgttaggaaaaagacccactgatttttgaagtcacaaagaataggggttcaaattcacattcagctctaccacataataaagcaatttctatacccatagaattgatgtgagcatgaaatagagtaacatgcacagtacctggaccagtgcctctgctactcaataaatggtagtttcagctactataatggcctcttataccttattgatatctttatcattataactatcacattgtatcataaacatttgtttctggatatgacttttagaggactgtgtgttcctttaaggcaagactattgtgtctttatctatctttgtatttctcctgcagaggttgcaaactggcaaccacaagattattttatttgcaaccagtttgggtcccagcatgttttaaatgtgcactggttgccaacatttaaaagttaggaggtttcacatttaaaataaaatgaaacaggattcctgacttctggcttcttgcaaagaatcagaaaatcctggtaatgctgaaccctacattttctataacagcaatcagctagtctggagcagcatctgcctctttggataggcaatgctctctaatttgccatcgtccctaacattccaatattgtatcctcgaaacaaaggctgaatgccatttgcccatcacatttcattcatttgtgttacttactgggcggctcttgaaatttgcattttcgactgctgctctagtgactgccagagagtctggaactcaaggaagcactcaataaatgtttgttgaaaggaagaaagaagaaacattaatatatgcacacagagaaaatttaccagatttacttgaaaatgtacaaggtctggctgggcgctgtggctcacgcctgtaatcccagtgctttgggaggccaagcgggcagatcacctgaggtcaggagtttgagaccagcctggccaacatggcgaaaccctgtctctactaaaaatacaaaaattagccaggtatggtggtgggcacttgtaatccctgctacttgggaggctgagacaggagaattggttgaacccaggaggcggaggttgcagttagccaagatcgcgccactgcactccagcctgggcaacaaagagcgaaactgcatctcaaaataaaataaaataaaataaaataaaataaaataaaataaaatagtacaaggtgacaggggtttagcattgctctagcaatagctgttctcatcttttctttttcaatatagagtatgaagcatgagtgataatgttggggaattgagagaatgatgctctgaaataagtgactttcattggctatgattgccaggctgtgacaattttcaaggatagacaacctcaaatttacttattactgtcataatgcagtaaaacacgccaaaaaataaaatatgatcaaatgcagttaccgtttattttggactgcatgacaatattcacttgcacaaaaccatataaacaacacccacctgtgtttgaaggcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatctacccccggctgctccaaatataaataaaaaactataacatttttttaaagtttaattttggtttttttttttttctttttgagacggagttttgctcttgttgcccaggctggagtgcaatggcgcaatctcggctcaccgcaacctccacctcccttgttcaagcgattctcctccctcagcctcccaagtagctgggattacaggcatgcgccaccacgcctggcttattttgtatttttattagagacgaggtttctgcatgttggtcaggctggtctcgaactcccgacctcaagtgatccgcccgccttggcctcccaaagtgctgggattacaggcgtgagccactgcgcccagcctaaagtttaaaattttatgcctcaggcagacaagctacatttcaagtgctcagtagccatatgtggttaatggccactatattggacagcacaaagaacatttttatcttcatagaaaattctgtttgctcttatagattattacatacacaattacttatcctttattttgctacattgtcattacagtttttgtttgtaatttgataatgcagtttcatatgtcctagaaatactaacttttgctttcttgaaatcttattttcccccaattttttttatcaactatatgtttaaatcaacatttttttcctttgttgttccattaagatagtcaacatctgacaatttttaccttaaaacttttaagttctgtgatcaatacagtcaaagtaatgcctctaggtattattcatttttaagacaacacagtctatgacagtgtctctccatgtgccttttttaccatgtacagtgaaaaactacttattaaatggtgattttcccccctttatcttattaagtaaattatatggtctttttttttatggaagcctccatagttagagatgtaaaacagcaatttcttggttctatagcatgacatagttcagagctgagattagagaaaccccgtagagttgttaatacttgagggcatccccaactagaaaagtatgtgaatttaggcatgggaggaaggaaggatctgctttaaatttagtgtagggtcactgagtcttaatgatagattaaacaagggaggtagaataatgaataggggtatactgtgtgtagcactaataccagaagtccatggtttgtggcggttttttaatgtcctttcccatatggttttgaatagagcaggttatggcagggatgagctaaggaatagctttgttaatggataaataggagtaattttttaacaggagacttcaggcagtttattcagaatgcctccttatttaatgaatcatgtggttaaattttttttcctgatcttaataatacattaagtgggattgctaaggtattcctggtattttctttctaaaatagctatatctacatttcagagccagccctaacagtgaatccttgggttgggttttactttcttaattaaaggccagtcgtatggagcttttgagcattggcagcatcagtccctagggtttggtgtgcagtagtagactttctttcatagtgtcaattcatttgatacgatttaattaaattgtcatttggagccagtttccaactctactgtattcacctaaacttaactaggtgtgtaattttggtgactttactcttataactttgctcatggccaaggcagctacttttcttaagataggctttctgccctcctgcctacaaatctctgagagtaatgctgaaagctgatcttgcaaagtagcaagttagactcagataacctgaccagacacacttttaagtatctctcagggctgttctttggaggagcttacttaatatttcctaaaggagaggttaagtaggttgtctttggtgcgttagttatgcagagagaagagaaatgtaactctcctgactccagggccccaaatgcaaacactggcctagttgttcccaaactttcttcttgatgtggatgacttgaatggtttattttcacttgatgagccacacccccaggccactttagtattcatggcagaccccaacactaagtccctttgttgtctttgttttttgcatttttttgttaactagaaaagataaaattatgagagacctgattatagactgaggttctgttgctgatggttcccaccacttttttcacatctcagagaaaggcaaaggcctggatgggcaacagaaaacagcaaagcaaacataaacatcacatcacgtctgagcatcagcgtggtgctaccagagtgggaagggatatagtcattatcaaaatataaagatggttctttgccaaaagcattaacattgtcagcattttaaaaagtttgaagcttgctgtagaagcaatggtcttttcttcaaggaaaaaaaatcttttttcttgaagaaaaggaaaatggattaagaattttaaaaatccgcattattgttctgacctagacattaactaagtgaatgacatttaggcaagtagcttaatttgtctgtgtttgcgcatgtgtgcacttgtgttttttaaatcacatgaaataaaaaggaagtgcaattctataaaaaacaagtgggcagagtagattaatggcactgttttacattgtcttccttatagacgcagttttagtttagaacttacaaaggttacaaataagacacagctgtttctgataagagtttcacttgtccagatcaaaagcatagaagaggagttggcaagagtgcccaactgtggagagagagaaaactagaataacaggatagggcataattgatttactgtccattggccaagtagaagtagcaggcccatagtgtgaatatcttcatattcttttattccagctaaaatccttactaatgtaaggggtgaaggagactcagaaggcattggccaaaagtgtataagaggaagagccttggtaactctcatgataaagtttaactatttttatatgctcttctcctttttccttgatttattttccttggaaattttttatcttgccatctttctcagatgtgtgtgacaccaggaactctgccccctttctgtgaagcattcaattgttgaaacaataacaagttgctatttgttctggcagttgttcttcctctacagcacttaaaagtacaaagtggacagactgtaactgcattatccattgcagcacagcagctgtggaaaggctcatttgctctcataagaggggctttgcccatagttgatcacatgttactagtttttgttgttgttgttgttgttttgagatggagtctcactctgtcacccagactgtagtgcagtgtggtgtggcctcgtctcactgcaacctctgcctcctgggttcaagcgattctcctgcctcagcctcccgagtagctgggattacagatgtgtgccaccatgcctggctaagttttgtatttttagtagagatggagtttcaccatgttggccaggctggtctcaaacttctgacctcaggtgatccgcccacctcagcctcccaaagtgttgggattacaggcgtgagccactgcaccccacccacttgttactacttaatgaccactgtttagaattaagtgcaaatggtttcatagaagattcatacacgttacaattataaaagtgtccggtagctgggcacagtggcttacaacctgtaatcccagcactttgagggggctgaggtgggaggattgcttgagtccaggggtttgagaccagcctgggcaaaataatgatacctcctctctacaaaaagtttaaaaattacccaggtgtggtggtatgcatctgtagtcactcagaaggctgagttgggaggatcttatcagcccaggagatccaggctgcagtgagctgtgatggccctacttcactccaactgggtgacagagtaagacactgtctcaacacaaaaaaagtgtccagccgggcgcggttgcttatgcctgtaatcccagcaatttgggaggccaaggcgggcagatcacctggtcttttttttttttttgatctgggctcactgcaacctctgcctcccaggttcaagcaattcttgtgtctcacctcctgagtagctgggattacaggatgcaccaccacgcctagctaatttttgtatttttagtggagacagggtttcaccatgttggccagactggtgttgaacttctgacctcaagggatccgcccaccttgacctcccaaaatattgggattacaggtgtgatcctctgcacctggcctgatcttttttctgtgcatacatatggtatgcatacatatgtacctatacttatacagacataacttaaacagagatgcatattattttgtaacctggtttttaaaaagatcacgtaacaactttttatataaccaaatattcttccatattaggggtcagcaaatttttttctgggaagagacagataattcctattttgggctttttaggccatgcagtctctgttacatgtactcaactctgctatcttggtagtgcaaaaacagccagagaaaatatgtaaacaaatggatgtggctgtgttccagtgtaactttatggacagaaacagacagtagactggatttgacctctgggctctgctttgctgatgctggttcatcactttaataaccgcacagtattttatttatttaactgttacattattggatattagattatgccaattttgtgttttgatatgattttgtgtgatgataaacaaggctgcaatgaatatccttgtagcgaaatatttggttacaggtatgattatgtctttaagattaactagtatattgcttctgacattgtatcagattgactactaaaattcagatttaaaaatcaaaacatttcaggtccacagtatttcttgattcatgtgtccaatctttaaagtgttatataaaattgaatttcacaaaatggtgttaggttaaagtaaaattcctaaaaatgtttctataattgttccagttatttctaaaattgactgggcttaattggtgttttccttcctggaaagaattataaattgattaatttacttgatttttaaatgagattttaagagcttttattgagtgattgtaattttatttattgcaggctgtaagaaacatttttttcatattatttactaagccattaaataattggaaaagtattgttccctcactgtttccataaagtgtacagaggaaatattgcccttcgtgacaaggtcttgtctgactgttaggaaactaacctatttcttttgggccttgtttcagctagcctacgataggaaaacataacctgtttgtttgtttgtttgtttgtttgtttatttgagacggagtctcgctctgtcgcccagactggagtgcagtagcgcgatctcgactctctgcaagctccgcctcctgggttcacgctattctcccacctcagcctcctgagtagctgggactacaggcgcccgccaccatgcctggctaattttgtttttgtatttttagtagagacaggttttcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaacccaaaaattagctgggcatggtggcacattcctgtaatcccagcttctcgggaggctgaggcaggagaattgcttgaaccccggaggcagaagttgcagtgagccaagatcgcgtcactacactccagcctggtgacagagcgagactctgtctaaaaaaaaaaaaaaaaaaagattaacagattttcaattagcagaaatttagattaaactgagaatgcaatgaagtctgtagtaaagaggtagtatcttctctcattaatttcttaggctaataaaatcacatcatccaaatgaaattgcaacatttttagaatttctgtaacaaatgattattaattatatttattctcaaaagtgactggccaccttaggcagagttcaaagaattttagtatcagtaaacttgagaggcatggctctctggaagagcctatatattatttgcacattctaaagcggtgcttctggccgggcgcggtggctcacgccagtaatcctagcactttgggaggccagggtgggtggatcacgaggtcaggagttcgagaccagcctggccaatacggtgaaaccctgtctctactaaaaaaatacaaaaattagccgggtgtggtggcatgtgcctgtggtcccaggtagttgggaggctgaggcagaagaatcgcttgaacctgggaggcggaggttgcagtgagctgagattgtgccattgcactccagcctggactctgtctcaaaaaaaaaaaaaaaaaattgaaattaaaatttaaaaaaaagcaatgcttcttaaaatttatcttggtaagagttatctaaagagcttattaaaacagagattgctgggcactcagagtgttctatacactaggtctgtggtggggcccatgaatttgcatttctgatagtttccaggtgatactaatacctggtccagccaccctctttaagaaccactgttgtagaaaaataattaaccttttttttcagttataatccctgcaacttcacagtttctataaacttgtgtttttcagaaagcttctaaaatttagcttctttttaatttgtgaaatatgtttagcttttctcatctataaacattttcttagcactttaggaattgtcttttatcgtaaaatccaggtttgaccttttactaaagatacaaattcatggctgggtggtggcttacgcctgtaatcccagcacttcgggaggccaaggcgggcggatcacgaggtcaggagatggagaccatcctgtgaatggtgaaaccccatctctactaaaaatacaaaaaattagccgggcgcgctagtgggtgcctgcagtcccagctactcgggaggctgaggcaggagaatgacgtgaacccgggaggcggcgctagcagcagtgagccaagatcccgccgctgcactccagcctgggcgcgacagagggagactccgtctcagaaaaaaaaaaaaaaaaaaaaaaaaaaagatccaaattcattttaataaatgtgtgattattagttgttactttaaataatatctaactttgcaattgtcaagttgctttcacccacatcagacttttagtataggaaattatcaacataaccatgttacccatggaagtgttaaatcttatgctgggtagtgtttcaggatggccaaaatccgtctccaacttaatatatttaaattagtttacatatttgattaactttactatcatcatcctagtaatctcttagaaaggcaattgtcaaatttctttatagccaagtaagagttgaaataagtttttaaagtatggtacaaagcaaaactaagttacagttattagaatgaagaattcatttagaggcaaaagattttttaaaactgcagaatccagtcagttcaaagcctgattgaaagcaacttcaattttatagatttcttgaaacagatcttcattgttttctggaaagatagtatttgagaaaaagaaatgtctccagttactgtttttatgaggagagaatagcttggtctttttaatggttaatgagaagaagtaatagttaaacacttagagcattgatttctgatttgaattctccaacacaggccagccctgggggaagggggaagaaaaaaaaagcttgctaattaacatttgattactgatgccaccttctcattccccttgcaccatccggtttcaagcgttttttgttcagaaaggattttaaggagggttttaacttgcatcttagtaaaacaaatccatgtgcaactgcaacgtgtatacaatacttttaaaaacaagaggaaaagaaggccttaggtatgaagtatgtgttcagaacgcattctgaatcacttctgattcagaagtgactgctttcttaactataagcctttcagagtgccagtgattgctaggatactggaattaagcctagtttgtatgccttattttgatttaaacacacacacatacaaatacttatttgctcaatgcagttatttaacaaactcttaaccagaacatctgataatgcgatgcactgggagcttaagtttgatatatttaaaattcggtctaagctcaggttttcatatgaccagagtcctttttcttctaagaatgataaaagaatgagatggatggctgtagtttcagggtacttttttgtaagggctgtactatgatgtgcgatagtatcttaattcagaaaatctagaaactaaagcactgattactgaacattttgtttttgtattttgccatatcaaaatgtttgatatgtgaagaatcgtgggccagatttcaaaaaattttaaatgttgagataaattaataaaacttgaaaactatatcacagtagcgttctggcaaaatcatataaccactttgatgacattagattgatagaatagttttctgggaaaccagtgtgacaggctttatttttaaatgagatctcataaggggaaaatattagtgttttttaaaaagtataataaaagtaaatgccaaatctcatgcaaaaaaaagtactaaaatgcttattatctttatttctcatgtgaaattatttgccatttttctttttgatgtctgttatatttttttctattgtttctccattttgtagcattaatagttttaaattttctctcattacttccttgtcttgtatatgtttagcacctcttttcctgtacctaggattaactccagtattttcacgaaataataacattttggagctttgaaaatcagaaacgatcatgttttattctcttctaaggtggagtacatgaggtctcagaatggctccaccaattttcccacagtaacagttgagcagaactaggattagaaatctagttctctggctgggtaaggtagctcgcctgtaattccagcactttgggaggctaaggtgggcagatcacaaggtcaggagctcgagactagcctggccaacatggtgaaaccccgtctctactaaaaatacaaaaattagccaggtgtggtggcacactcctgtaatcccagctactcaggaggctgaggcaggagaatcgcttgaatccaggaggtggaggttgcagtaagccgagaacctactgcactctggcctgggcgacagagcaagactgtcttgggaaaaaaaaaaaaagaaagaaatctagttctctgcctcgaggtatgccgcaacaccttaaactttgtgacttttttattagtttgctttcacgagaataatacctgaatgacatttaaaattccctaaaagtttttcaatagtttgatagatatttagctcacaaggaatggttttattataactgagaatgttatctactgaattttatatttttcaatataaaaatagtttagaacaactcatttgaggctaatctgagcttcatggtttagcctttagcagagcaacttttcctaagaattactttcctaagaaattctgatgaaatttaactaaaaaataaaactgtttgaaaatttaaatgaatcaaaagaaaagtttgtgggagatgaatatgttatgaaggtacttttataattttatattgagtagcttataatgaaatgatctttcccccagtgctgtgtttagcgttgaaattcccacagacattgaggaagtatgaagtttgaagtagagattattacttagtttttcacattaattatagtatataaacaggtgtttattagcaatgacaaataaggaaacaaatcagtaccatattaattctatactattaaaaattaacctgatttatatattttctcagttgcaaacgattgtcttatctgaaacgatatggaagaaattaaactatacctttagaaaatcttgaatgcaaattagaaaatctgttgtcaatctagaactctagatccaaatacagtatagtttgtaatgtaagtttaatgttcagctggtaatcaaagcatttattaaattcctcctgaactaattgaaacatttgcatgtaaaacaagaattgaaaagatcatgaaggttcagcatgatcttgagccaatgctgatcaaaaaaaaaatgtgtaagacaaaaaggcccttaggaaatgttaccctgtgaagtgccacttgtccttaactggaatttaacatactctaaagatgaaactccgtcagaagcagcacaatattggcagctgggcatgccagccactgcaccccagcctgtgcgtgtgttctttttacttctctaaagtgctctcaagtcccaaatcaatcagtgtccttccccctctctttctcacttccctctcttctttctttccctatcatctatttctccctatctctttaccctccatcttcctctcttctctttcctccttttcccttttccccttcttctccctttcccttccccctccctctttcttcctcatatttcttcatcttccctccttctctgaaagaactgtgtccttcatctgatccatgatgactttaaattcatctgtatcattttatacaaagctgtattttatcattgaggtttcctagaatactaacttttttcagaatcgtttttatgttttgtgtacattttggatttttttcttccctgcaggattatgatttcaattttttattaaatataaccatcaataaagaaaatggaattgtaatctattagtaaaatccccactcttttgatgcttttgctatcttatcacttgtgcttcatccatatactggtaacatctacgtatggtaacagcattggtatgcatggaattatttttgaaaaacactaaattgttgtttagtgattgtggttcaacataagattcttttagtttaaactcagaatactctgtgaatttagcctttgcattggaacaatcaaacattagcctaatatgctttacatgggactctctcagccaagttctgtctgcattagccagtttattctatgacaagttgcttaacagatgtcattctggggagaacaatgaagccaaatacttgtgcaatggctaacattactctgactttgatcacttttgttcagcacatcagtctggcgttgtgcttaataccaacataacactatagccaggacatgcttttcaggcttagaatagcaaaggaatgttattcaattcagtgcagttacagatgagttaatgaaaaaagaaaatactgtttatttcataatactttattgttgtattttggaattaaggtggaattcaaagaatcccactccaaagttatttgtttgtatacttatagtatttgtgtgtactttacaatgctagggtagctttgcggcctttccaaaaggatgtaaatatttgtcctgctttttttcaaaaatagctgataaggttggttatatctagataacataatgaaaaataatttcaagaaattatttcaaagtaataatttcttaattattttaagaaatagttttaagaaattattttgtcttgaagcctaaagactcctcatactccctcttctatccttcatcttttattaacgtaacactctcggtttgtggaacacctttctcgttaagaacactaatgtttaaaaatgacaaaataataacagctagtgaaagtggttagaggttaacccaattgcatttggttaaattgttgggttgataatgactgataaaaatttccaaatgatgtgactgactataaacaaaatattgcatggtagactagccatttgctaagaacctctaaagaaaacctgtttgtttgaattgagtacagatcaagccattccccaagctcctcagatctcatttactaagtcatttttccacaggtgtgaattagagataaaaatagagtgagttctgtgtttttgttttattttttgtttctcctttccgtagtgaactagtatctctatttcactggaatggtaacttagatgtgattatgtataagaaagggtaatgtgaaaacaaaatgctataattggacaacatgatactttaggcttctgcatttttaaaacataaatgcatgatgcttgttgaagtatgaagaaccctattgaagtttttgggttttgttttgttttttgagacagggtctcactgtgtcacccagagttcagtggcacagtcgtggctcattgctgcctctatctgctgggctcaactgatcttcccagcttggcctcccaaagggttgggattacaggcatgagacaccatgcctggcctcaagtcttaacatagaacatatgatggggagcatttcaatcctaacttcatttgatacagtaggataataatgccataattaacttgaagaattaattaaaatggataatctctccattattatgattcgttatttgtgaataaaaactaaaatagaaaaaaaaaaccctgaagagagacatactgcttttttcttttttttgagacagggtctcactctgtctgccaggtgggagtgcggtggcatgatcatggctcactgtatcctcaacttcctggactcaaacaatcctcccacctcagcttcctgtgtagtggggactacaggcatgagccaccatgcctagctaattttgttattttttggtagaaatgtggtctcactatgttgcccaggctcatcttgaactcctgagctcaagtgatccttgtaccttgacctcctaaaattctgggattacagatgtgaaccaccacgcccagtaacacttcttttattttattttatttttatttttattattttcttttgagacagagtctcgcactgatgcccaggctggagcgcagtggcacgatctcagctcactgcagcctctgcctcctgggtttaagccattctcctgcctcagcttcccgagtagctgggattacaagcacacaccaccacacctggctaatttttgtatttttcatagagacaaggttttgccatgttggccaggctggtcttgaacacctgacctcaagtgatctgcccacctcggcctcccaaagtgctaggattacaggcgtgagccaccatgcctagccaacacttcttaattactggctgacgtagagtttaaccttccaacactttattctgataagtttacctcctttcctttcaaagtaaaaggtataatgttgcatgttgggaaaaatagtttctcatctttaatgcattttttgtatttaattttcaggaagggcctatagctctgatattagtaaatattacatgaaatagtttttaatttggattgatttcaaaaaaataacgtgtgctacttttttttttttttttggtcggtggtagggagatggagtctcactctgttgcccaggctggagtgcagtggcatgatctcagctcaccgccacctccgcttcccggatgcaaacgattctcctgcctcagcctcccaagtagctgggattataggcaccgccaccacgcctggctaattttttgtatttttagtaaagatggggtttcaccatgttggccagactggtctcgaactcctgacctcaggtgatccacctgccttggcctcccaacgtcctgggattacaggtgtgagccaccgtccccggccctgtgctactttaataataagtttctgtatctttgaaacttacataaaaaatatgaagacaattttaggtttttcctcccctgccccccttgcccttcaataaaaccccactacccttcactattccacatagaaacttgaaatatatgtttttggttttgaatcattgtgcatttttacgattaaataaattataaaaatgtataatcgtactttgcccttagtgaactgggtgcctgaagtttcttgactgaaaagaaatgaagtcagccaggagttgaaaacaagagagggaggatatttcttaactcttatttcatctagtcttcattgagaatctgcttttaaatttgattttgttcttttttacaaaattttttgacttgggtttttatagtttcaaattcttgttttgaatctagaagaaaacaagaaatacactgtatgtctcataaattgattggaaactgtaagtcatgtgaaaattctattttaattgtcctgtttctttcttttcataggtaaagagaaatgtgtatgaccttacaagtatccccgttcgccaccaattatgggagggctggccaacttctgctacagacgactcagtaagtgacagtcaaattttcagttttatatcctcctttctcttttgccactttcagtctaattggctttgataataagcacaattaaatgctttgagtcttccattgaaagaattatctagccaggcacggtggctcatgcctgtaatcccagcactttgggaggctgaggcgtgtggatcacctgaggtcaggagtttgagaccaacctggccaacatggtgaaaccccatctctactgaaaacacaaaaattagctgggcatggtggcggccgcctctaatcccactactcaggaggttgagataagagaatcacttggcggccgcctctaatcccactactcaggaggttgagataagagaatcacttgaacctgggaggtgaaggttgcagtgagccgagattgcgccattgcactccagcctgggcgacaaaagcgaaactccatctcaaaaaaaaaaaaaaaagaaatatctaaaaccaagcaatgtgaaagtaagagaagttgtaataatttgagttcacttttagaacagatatcacaagccaagcaggtcaacattctgttggtaatgttacagtatcaatgcaaaaatttgatgctgctggatttgactttgacttagtttttttcttgatgagaagaatatattcagatactactaatgaaatgttcaaggcaaaaacattttctttcctaaattacagatatttcaaaatcaagctaatcattatatttaattttaaaactacctttttcatagtagactgatacttaaaagttaatttttatagttaataacactttaatctcaaacatacccataaattttgctaccataagaagctggaagaaaatgtctgtcatttttacccttattatatattttataatgatttccttattgtaaatgtttgaagcctttcctatctctgtcatttccactcattgctgttttctatgagagtaaatttcattatataaggaggccatctgaaattcagttttggccacttttccccataaacttgcttattctaaccagatacctaagtttttttaaaaagtaaaagtaaaaatgagaatgtttctggaaatctcaagttacatctaatttttaaaataaatagggctaaaaagaaattgggactttgtaaacatcttgtaatgatcaatactgaaataatgattatgcctaggaattgaattatcttttaacattttctagtaaatattatgtttctgcctggataataactacagttcactcctcttccagcatcaccactatatattttaatataaaagaattctttgtggaagacagaaaagttttaagataatttatgtagatgctacttgaatctaattacaatgtaaacagtatgcctttggaacatgctttgtggattatgaaattttaaaaatcagaaactttaataatcagaaaatagcaaaacctttatttttggtcaggcacggtgactcacacctgtaatcccagcactttgggaggccgaagccggtggattacctgaggtcaggagtttgtttatttatttatttttgacttggaatcttgctctatcgcccagtctggagtacaatgacacaatcttggctcattgcaacctccacctcctgggttcaagcgattgattctcctgcctcagcctcccaagtagctgggattataggcgcctgccgccacacccgggtaatttttgtatgtttaataaggacgaagtttcaccaagtaggccaggctggtcttgaactcctgacctaaggtgaccagcctgcctcggcctcccaaagtgctgagattacaggcatgagccaccgtgcctggccgaggtcaggagtttgaaaccagcctggccaacatggtgaaaccctgtctctaccaaaaatacaaaattagccgggcgtggtggcttgtgactttaatcccagctacttggggggctaaagcaggaggatcacttgaacctgggagggggaggttgcagtgagccaagattgtgccattgcactccactgggcaataagagcaaaactccatctgaaaaacaaaaacaaaagcccctttatttttaataaacacttccagaaaaaaaaatctttaggtttaggtgcttaaatttgtttctgaaaaactgattttagcattgatgttatagtatataattagaattattggctggtcatctatggctaaggatagggatgtgtttgtggttttcttgtggttttttttttgttgtttttcttgcttgagtgagaaatttgatagaaaatgtgctacctttatttttacaaaaataaaagaataatgttcatacatgatggtctactgtttacctgaggaggcatgaagaaaacagaaatgttctcagtattgtctaagaacttgttacaagaaatagtaatattaatagaagaagataattaagacctgagcatatcattaaattctctgagctttaattttgtcactaatttgcagaactattatgaagataagtgataatataaatacagtacctggctcatagtagacactcagtaaatgagtcgacattataattaagataactgcaaaaaaagttattgtaattacagattacaattacaggcaagaattggctggtttaaagaaatgaagtgatgtctgagacttgcttcagaataacctatgtgtggcagagtgagtgaggatagagctaatttagattaggcatctatcaatcattgttgaatctaggtgatacatatattgggtttattatactgttctctcaacttttgtatatatttgaaaattttcataataaaaagtttaaagcaaaaatagttgtcttgtttaagagcagggacataagataatagagaaactctggaaatgtggggcttcacagggttggaaaagccaactgcttttgcaccccacccttgtagaaaccagactgaaattggcttatcaggtacaagttccaagaatgataggcaaagtcgatgaaatatgatcaattcttctgcctgtaaaatagtgccttatacattttaggtgctaattcattgaattgagttggcatggtcttttatgagacccatgttttaatggtttttataacatttaattttttgccaaagagttgtcatgcagtctaattactataggaaaatatggaaagcagctaaaactgtttgtttccaagactgtaatactacttggtgctcttaagtcacagcaaacacaagagggaatccctattaagaggcttgattcttttagcctcattattgccatttgcaccttgtcccagaacctgtgaagtggtgcctgcccacacctccccagagcaaatgttgcggcattggcagggtgttgccttgagcttgcatgatttgatacaacaaagatgtttagggccaggctgcttttaactgatgccacagcagattcactagctccagtgcttgaatttagccaaaaatggcttataactagtattctgaggagatcctggccaaataatatgtcgtaaaacctttttcattaggagtataaaaactcataaaactggtacttgtagtctatatttgttgcaggcggtggtgtttttatacttactgaaatcattcaagtggaggcatctgctacaaaacaaaatagtcctcacagcttagggcatgaattgggtacagctgagaaatgtcagctgtgtaaacagcctgaaatgtgttaccaacaaaaatataattaatttctttccaagacagtgtgccataacttaatacttagaatggtttaactttcagagaaagcacctgaacatttgcttcctagtgccagagtagaggattggttataaaggtcattaaaagtgaggtcattttgtacttttattgctcagttgaagaaatttgtgtggctttaaatatacagtagccttagatatcattggattctgtgaatttatgaaaataccatagatcaagaaattaatggatttggggtgatgaaaatgttctaaaaattagattgtggtaaaggttgcacatctctaaagttttaaaaaataattgaacatttaaaatgagtgaattttatggcatataaattatgcctcagtgaagctatttttttaaaaaagaagttaattaactagattaaaatactttttcacttacatttttatcctgcatgagaaatactttgcagtaacacaagagatgttttgttcagtatacttctcattaacctttgactcacccaacaggagaaagaaatagacctcttgtaatcaattcttttataatcttgagtctcttatgaacctaatagacttcagtcttgggcattttcaggttactcagtgaagtcaacactcatttacaacattgttgcccatctcccttcagagttaacgtattttctttgcttgtggttgtactcgaatagggtgtgggatactgtatgaattgtcagtaactccgttccttttgtactctttgatcagggaaataggtatctaaagctttaccagtaggaaaatgttttcatgctgtgacagttcagctgtgagaacaaggagttacaagtaggcaaaatctcattttacactttaacaaggaagctcttggtttctagataggagaaataattttaacactgtgaattatgtttagataccttattacaatgcagacaatatgaatacatgtagttctttttaaattcctggatttaataatgcttatacaaagaaaactctttcagttttttgtttttatttttatttatatatttttttgagacagtcttgctctgtcacccagggtggagtgcggtggtgagatctcagctgactgcaacctctgcctcccaggttcaagtgattcttatgcctcagcatcccaagtagctgggattacaggcgtataccaccatgcccagctcatttttgtatttttagtagagacagggtttcgctgtgttggccaggctggtcttgaacttttggcctcgaactcttggcctcaagtgatcctcacctcggcctcccaaagtgctgggattacaagcctaagccactgtgcccggccaactctttcagttttattactttttttttttttttttttttgagacagagtttcgctcttgttgcacaggctggagtgcaatggtgtgatcccggctcaccgcagcctctgctttccggattcaaacgattctcctgcctcagcctcccgagtagctgggattacaggcatgcaccaccacgcccggctaattttgtatttttagtagacatggggtttctccatgttagtcaggctggtctcgaactcccgacctcaggtgatccgcccacctcggcctcccagagtgctgggattacaggcatgagccaccgtgcccagcttaatactttattattgtgctttctctctctctctctttgacggagtcttactctgtcacccccaggctagaatgcaatggcatggtcttggctcactgcaacctccacctcccaggttcaagcaattgtccctcctcagcctcccgagtagctaggactacaggcacgtgccatcatacccagctaatttttttctttttcttttttttttttttttgtagttttagtagagacgcggtttcataagttggccaggctggtcttgaactcctgaccttgtgatccacctgcctcggcctgtcaaagtgctgggattacaggcatgaggcactgtgcccagacttttctttcttgattactaatgctcttctgtatttctgtcattggccacaaaatattcactcagaattgagaaactaggaattttagaatcaaagctctttgggcgtgtgttaggattcagaaagctacttattaaatattttcacattgagaatgtgaaataatttacaagtaaaaccattacacagtggcttttatataaaataaaaagagccaggcacaatggctcacacctgtaatccagcactttgggaggccaagatgggtggatcacctgaggtcaggagttcaagaccatcctgaccaacatggagaaaccccatctctactgaaaatacaaaattagccaggtgtgtggcgcatgcctgtaatcccagctacttgtgaggctgaggcaagagaattgcttgaacccggaaggcggaggttgcagtgagagattgcgccattgcactccagcctgggcaacaagagcaaaactctgtctaaaaaaaaaaaaattaaaatgaataaatacataaaatgaaaactgcacacagccctttccccaccccactcttaaatagaaatgaatctgaaggctggacacggtggctcacacctgtaatcccagcactttgggaggccaaggcagacggatcacgaggtcaggagttctgagaccagcctggccaacgtattgaaacctgtctctactaaagttacaaacaattagggccaggccccctaacttttgagatggagtttcgctcttgttacccaggctggagtgcaatggcacgatcttggctcaccgcaacctccgcctcctgggttcaagtgattctcctacctcagcttcccgagtagctgggattacaggcatgcgccaccacacccagctgattttatatttttagtagagctggggcttctccatgttggtcaggctggtcttgaacttcctacctcaggtgatccgcctacctcggcttcccaaagtgctgggattgcaggcatgagccaccgcgcccagccaaagttaatatttctaaatagaagtacaacatgaatcacattcagccttgcttacttattttcaatggctcctttatgtacagatttttatgctggcattcaaaacccttcattctttagtctgaaacttcccttccaggtttgttttcccatacaggctctgagtaaatacttgataaatatttgttgaatgaatgattgaatattacaccatatgtgtctcagctttagctaaatacttatcttactatttttcgaatatacttggtactctcccactctgtcatttaatcatactcttccttccacctagaatacctacaacaattatctccttccttgaagacctttttgtttttttgttttgttttgttttgttttgttttgagacggagtttcactcttgtcacccaggctggagtgcaatggcacgatctcggctcactgcaacctctgtctccggggttcgagcaattcttctgcctcagcctcctcatagctgggattacaggcgtgtgccactgtgcctagctaatttttgtattattagtagagacggggtttcactatgtcggccaggctggtctctaactcctgacctcaggttatccacctgcctcggcctcccaaagtgccaggattggaggcgtgagccaccgcgcccagccaagaccttttctttgagaaaccctgcctatgcccttcttcccgtgctgccttctccaaccctcttagaaatgcatttatagttctcttcttctacttaagtttttttcacttttttcttattttgttatttgtttccttcatttctcccttccttcctcctctctggcttcatctgggtcaccacaagcaacttaatgtctatggatctcagtctccgtaactgtcgaacaataactcgtagagttattgtgaagattaaagagtcagtagttacaagaatacttactgctaggtttattttgaagactgaagtagtatgtactagaaagaatgccttaacatggttgacttttggctattactgtgttttatttattgttttaatctatctattcattcacttgacatttgtggaacaactctgttaaaagaaaacttcagacaaattaaatttaacagagtttaattgaacaagaaaaaaaaatgattcgcaaattggcagcctccagaatcatagcagattcagagagactccaggaatgcctcgtggttagaacaaatttatagacaaaaaaaggaaagtgacgtacagaaagaagcgaggtacagaaacagctgtattggttacaggttggcatttgccttatttggaaacagtttgaacatttagcagtgtatcagtggttgaagaatggctgctgagattggccaagacttaactattattataggcatatgctcataagttaggttttcagtcttgtctacctattaagttaggttaagcttcctccaccaggactcaaatgtagaagtccggagccctaggctgggcatggtggctcatgcctatactcccagcggtttgggaggctgaggcaggtggattgcttgagaccaggagtttgagaccagcctggccaacatggtgaaaccctgtctctactaaaaatacaaaaaaaattagctgggcgtggtggctcacacatgtgatcccagacactcaggaggctgagacacaagaattgcttgaacctaggaggcggaggttgcagtgagccaagagcatgccactgtactccagcctgggtaacagagcgagactatgtctcaaaagaaagaagaagaaatagagtccttctgagatcatatttagttcgctttaacaactcttacaggccagtaactgtgctggcccttaaagttgcaatgataagatcttgcttctcagagattgatgagtttggtgggagacatatataaacaatgacaactgaagtatataaatgcaatgggatcatagaagagggaacaaccaattttgctaacagttagtggtagtgaaaaaatgacttctcagtgaaagggacatttgattatgttttaatttgtatacttgtattcctccttttgtaaattataagcattggaagtaagaaatgtcttcacatttatatcaaagagtgttttaggcatttatttaaattgcattcatttatttaaattgttcagtgctccacaaagttgacatctatggcaataaacaactaaaggatcgatttgtatgagtatagtaattggataaacattttgagaatcatttatttctaataaaaattaagttatcaaaactaagcattttatagcagcaagtagaataacagatttaggagtgtgcagagctacattgtgagccgatttttaccaatgtgtgtgtgtgtatatatgtatgggtgggaggcagaggaaatggaggtggaggagaatgcaattgagcaaaccagtccaagtttgttgaatcctaacattactattatttagatgttacttaatgtttgagcttcagtttctttatctacaaaatggagatgatattaacacacttgaaaacctattgtgaagattacatgggttaacatattattaggtgggaccatatgaagttgccattttttagggacaaaaatggttgcagattagaagtttcatacaattatatctaatatgtaaagcacataatataatgcaggggttgacagttatgactgtgagcccaaatctcactcagcatctgtttttgtcaatagtattttcttgggacacattcacaccgatttattttttttcttccttttttttttctttttttagacggagtctcactctgtcccccaggctggactgcagtggcgtgatctcagctcaccgcaacctccgcctcctgggttcaagagattctccttcctcagcctcccgagtagagtagctgggactacaggcaggtgccaccacgcctggctaatttttgtatttttagtagagacggggtttcaccatgttggccaggctggtctcaaactcctgacctcaggttctccccgccttcggcctccccaaatgctgggattataggcatgagccatagcgcctggccacattgatttcttaatgtactgtgccacagctgctgtcacactataagcagggatatatagttgcaaacaaagaccatgtggcccacaaaacctgaaatatctactgtctggccctttacggagaaagtttgccaacccctggtgtaatgtctggcatttagtaggcattcaacaaacattaactctctttcccttgagtaagcaccttctttatattgcatacacatgcagaatcagaagcattctttgaatagcttcagggtcatcttatgctatttaaattactttgttagcctgtcctagggcagacagattcaggcaatctttggacattttcactgactttttcattatttgggaaggtcatggataatgttgcttctgatggtggtgagactcagtagcttcagagggttcattgcccttgtcaacatatagagtcttttgcaaataacacaggcaaagactaaacagatggaaagaacagctttgaaagcagtagaagaaagtttgggtttaaaagaaaagaaaagttgtgaaatgaattctattctgaacaagagtgagaagtttgggaatgtggatgaagcactcaagggaaatgtttgctcagtaaatatgaagaagaacacatggaagcaagacagccccagttggaaacttacaagcactaagacctgatgctgtgggtcttgatttcagtttattaaaatcccaaacctgtagactgctgcttctgcccatgaagggataactgctttgggattttccccctctctgtaaacaactgcaagacaggataaaatacatgaaacaactgttttcagatattagccaacaggactctgaagaaggaaacaagagttctatgagagtcttaaattctgcctggaggcaacttctggatcccatagcaggaaagggaaagtaaaacagaacttggtaatttcgctgagttgaagggacagagattggagttttgggaggctccagcggctatattttgcaaagcagactaccagcagagaaaaatctccagaaatctgcatggggttccccaagtctttagctgaataccagtctctgtgcatgcatagggtgaaaatccagaaggctaagcaaagagaaattgttaggaaaaagagtagttaactggagctataaggtaaacaatccccagagtttacacaaaactaaaactgcttcaagtttcttccaactacacattgtagagacacctcagtgaatacacagggcattcagtagctatcttcagaagagttaacaccttagtggagtggataaattggccctagaatgaaggctactccaggactttttaaaagcttaaaaagaagcctgaataaggaataagctgattaataggtaactgcctctaaaaacaaagtccagcatccaattaaaagttactgcacatacgaacaagcaggaaaatctgacccataaccagaaaagaagtcagtcaaaagaaacagacatggaagttacttagataatgaaattggcagacatggactttaaagtagcttttataaatgctatgaaagtgctcaaggacttaagtgaaaacataagaggaaataataaaatatataaaagagaacaaagtatcatggcagggtgggagtgggggcagcgatggctcttgtctgtaatcccagcactttgggaagctgaggcgggaggatcacttgagctctggagtttgagaccagcctggccaacatggcgaaaccccagctctactaaaactacaaaaattagccaggcatggtggtgcatgcttgtaatcccaactactcaggacactgaggcaggagaattgcttgaatctgggaggcggaggttgctgtgagctgagatcgtgccactgcactctagcctgggtgacagagtgagactgtgtctcaaataaaagaaaaattttttttaaaagaacaaagtaacacttctagagataaataatatagtatctatctgaagtacaaattttactggatgggataaataacagcttagacaatgcccaagaaaagatcagtgaatttaaagatacagcaatagaaactgttcccattaaacagttcccattaaaagataaattttaggaaaaaaattaataagcaatatggaatttttaacatgtagaagtaaaatgtttaagaacagtagcacacaaaaaaaaaaccagaatggaagtgtaccattagtgatcctacattataaatgaagttgtatactgttaatcaaaggtaatctgttaggttaataatgcatgttgtaaaccttacagcagccacaaaagaaagaaagaaaaagaaatatagctaaaaatccattaaaagagataaaacgcaatgctgaaaaaagtacaaataaaacagagaaaaggccaggcgtggtggctcatgcctgtaatcccagcactttgggaggccgaggcgggcggatcacctgaggtcaggagttcaagaccagcctggccaacatggtgaaaccctgtctacaaaaattagccaggcatgatggcaggtgcctgtaatcccagctacttgggaggctgaggcaggaaaatcgcttgaacctgggaggcagaggttgcagggagccaagatcgtgccattgaactctaacctgggcaacagaatgagactctgtctcaaacaacaacaacaaaaaagaaaacagaaaaaaagggaacagagaacagatgggataaatacaaacagcaatatggtttaaatctaaccatattgataattacagtaagtatgaattacattaaaaggaaaagattattaaaaatgaactttaaaaaacaagattcaactgactacaagaattttattttattttattattattattttttagatggagtctcactctgtcgcccaggctggagtgcagtggcgtgatcttggctcactgcaacctctgcctcccgggttcaagtgactcttctgcctcagcctcctgagtagctgggattacaggcatatgcccctacgcctggctaatttttgtatttttagtagagacggggtttcaccgtattggccaagctggtctcaaactcctgactttgtgatccccccgcgtcggcctcccaaagtgctgggattacaggtgtgagccaccgtgcctggcccaagaattatattttaaatgagaacaataggttgatctacttttaacattcttccactaaacaagcataaaaatatttgccatccaaacactaaacataagaaatttgggatgactgtgacatcagaaaagatacagaacaaggatttttttttttttttttttctgagacaaagtgtcactttgttgcccaggctgaagtgcagtggcacagtcttggctcactgcaacctccgcctccagggttcaagcaattctcgtgcctcagcctcatgagtagctgggattacgggcacccgccaccatgcctggttgattttttgtatttcagtagagatggggtttcaccatgttgcccagggtggtgttgaactcctgatctcaggctatccacctgtcttggcctcccaaaatgctaggattacaagcatgagcccccgcgcctggccagaacaaggaatattatcaggactaaaaaaagagattctgtaataattaaaaggtcatttcatccagaagacagaatgatcctaaatgtgtatgtgcctggtaacagtttcaaaatacgcaaagccaaagctgacacacaggtagagatttcattttcctttctcagtggtttacagaaaaatgataggtaagaatgtagatttggccaacatgattaatcaactttgcctaatttaaatttgtagacacttcacccaataatagcaggatacatattcctttcaagtgtgcatgatgcatttacaaaaatagactataacctggaccataaatatttatttattgtctcaatacacattagatgattgtaattaatattatcactaaccaaacataattaaattatgtatcactaacacagtggcctgaagctcttcaaatatttgaaataaaaaacatactatttttttaaattcatgagtcaaagaagaaatcagaaaagattggtaacattttaaactaaattaaaatgaaaacatagcatattaaatttgtgggattcagttaaacagtgcttagaggagaattcatagtttaaatgcttatatttaaaaggcggtccaatgtcaatgaaataatcatctacctgaagaagatagaaaaagaagagcaaattaaatccaagtagattaaatgacatagtaaagataagaaaaaatcaatgaaataaaagacaaattaggaaaaattattgaaaccaaatgctgactctttgaaaagatcaattaggccaggtgtgatggctcacacctgtaatcccagcactttaggaggctgaggcaggtggatcatgaggtcaagagatcgagaccatcctggccaacattgtaaaaccccatctctactaaaaatacaaaaattagctgggcatggtggtgcgcacatgtagtcccagctactcaggaggctgaggcaggagaattgcttgaaccccagaggcagaggttgcagtgagccgagatggtgccactgcactccagcctggcgacagagtgagacccagtctcaaaaaaaaaaaaaaaaaaaaaaaatcagctgataaactcctagctagactgatcaagagaaaaagagactagatatgaattaacagtgccagtaattaataagaggacatcattacaaatcatacagacagttaaaagatgaaaaggaaatgtgaatgactttgggccgataaattctgcaacactaggctgaaatggacaagttgcttgaaaggttaaaattaccaaattgatccaagagaaatagaaaactagaaaagcccaaatataattttaaaaattgaacttgcaattaaaaatcctgccataacatgggtggatcacaaggtcaggagatcgagaccatcctggctaacacggtgaaaccttgtctctactaaaaatacaaaaaaaagtagctgggtatggtggtgggcgcctgtagtcccagctactcaggaggctggggcaggagaatggcgtgaacctgggaggcggagcttgcagtgagccgagatcgcaccactgcactccagcctgggcgacagagcgagactctgtctcaaaaaaaaaaaaaaacttgccacaacaaaaacttcaggaccagcttattacattgccaaacactaccagatatttaaggtaaactaattctaatcctcttcatattcttttccaactcattttatgaggctgctgttacatttataccaaaattggtccgagacattggggaaaaaacccaaaaagctacagaccaatatcctttatgaaatacatgttaaaaattttaacacattttaccaaattgaatttcacagtaaataaaaagaatagtacatgaataatacattttaaaagggtgaattttatgttatatggtatggtaccatataacaacaaataacaacaaagctgttactttttttttttttttttttgagatcgagtcttgctctgtcacccaggctggagtgcagtggcatgatttcggctcactgcaacctcctcctcccaggtttaagcgattcttctgactcagcctcctgagtagctgggactacaggtgcatgccaccatgcccggctaatttttgtatttttagtagagacagggtttcaccatattggtcaggctggtcttgaactcctgaccttgtgatccacccgccttgcctcccaaagtgctgggattacaggcgttagccaccgcgcccagccaaagctgttacttaaaaaagaaagaagagggaaggatgggaaaaagaagacaaaaaaaaagaacaaaaagagttatgcatcatcattgggatttatctcaggagtacgtggatggtgcaacattggaacatcaaccaatgtaactaatttcattaacaaaactaagaaaacatatacaatcaggtgaataaggtcctggaaaagcatttaataaaatttagcatacattcatgataaaaatctatcagcaaggtaggaaggcaaagtagtatagccactctggaaaacagcggcagctgcttagaaaattaagtagacacttaacatacaatctcaactcttatatattttccaaaggggaatgaaaacatgttctcacaaagatttgtacttgaatttttattggagctttatttatagtagacaaaacccagatgcaacccaaatgtccgtcaactagtgaatgataagcaaattgtgatatatctatacaatggaatgctactccaaatgaaaagcagcaaactactgatagatacaatacttaagttaatgatgacaggcacaaagactacatcactgtgtgattccacatttatgaaatgtggaaaaaccaaagctataacttacagaaatccagtcagtgggttgccaaggagtaatggaggagactgactccaatagggacacaaagaaacttttgggagtcatagaaatgtgtgtattagaattgtgtttgtgcttattggaatattgtgcaactggaatattggtgtattttatatatgtaaatgagtctttcataaaaataagttttttttcaaagcaaaagcaaactaacttagcaaactgggaatagagaagaatttccccagcctgatagaaggactctatgaaaaagcaatagctaggctgggcgtggtggctcatgcctgtaatcccagcactttgggaagccaaggcgggtggatcacaatgtcaggagttcaacaccaacctggccaagatggtgaaaccctgtctctactaaaaatacaaaaaaattagctgggcatggtggtgggcgtctgtaatctcagctactcaggaggctgaggcagagaattgcttgaacccatgaggcagaagttgcagtgagcggagattgcgccactgcactccagcctgagcaacagagcgtgactccatctcaaaaaaaaaaaaaaaaagaaaaagaaaaagaaaaagcaatacctaccgtatttaatgggggaatactttcactctaagattggaaatgatgtaaggatgttcacttgcgcaagttctattcaatgttatactgctagtcttagtacagtaaggttaggaggaaagaaaacacatgcagattagaaaggaggaaataaaactttttttgttttacaaaatatttagtagtttgtttcttggtagatccaacataatccaccaaaaagctaatagatgtgacaagtgaaattagcaaggtcatgggccatgagatcaatatacaaaaatcaattgtgttacaatataatagcaaacaacattttgaaatgggttttagaaaacttatatgactcgcaattctatccaaaaacatgaaatatttaaggatacattaataaaatatttataagatctatacattgaaaatggcaaataattggagagaaattaacaaaattaagacatggaatgagctaccatgatcatgtgttggtgtatatatatatatacacaaatttatcttagatcagagatgacttaaatgcaaaagctacaactattaaacttggggaaaatataggagaaaatcttgggataggaaaaaatttctgagagaggacactaaaagcttataagagggaaaaaatgggtaaattggacttcattactatatatatatgtgtatatatgtatacacacatatgcacacgcacacacacacacacacacacacacacacacacatatatatatgtgtgagccacagagtgagtcacagagcctggcctacattcagtatttttaaggcagtacctcctcccagacagctgtggattcactgcaatgccaatcaaaatctcaatagcatttttcatagaaattggcaaattaattccaaaaattgtatggaaatgtgaaagagctagtgttcctaaaacaattttctgggtttttttttttgttttctttttttgagacggagtcttgctctgtcacctagtctggagtgcaatggcgcgatcttggctcactgcaacttccacctcccaagttcaagcgattctcctgcctcagcctcccgagtagctgggattacaggtgcctgccaccatacctggctaatttttgtatttttttttttttttttttttttagtagaaatggggttttaccatgtttattgggctggtctcgtactcctgacctcaggtgatccacctgccttggcctcccaaggtgctgggattacagatgtgagccaccatgcccagcctaaaatagttttcaaaaagaacaaaattggaagacttacactccctgatttcaaaaaatattactataatattcaatacaatgtgatatttgtgtaaagacagacataaatcaataggtaaaatagagtgttcaggaatagatccatatgtatgtgctgttaattggttttgtgcaaagataacaaagtaatgcggtggagacagtttgttctttatttaacaaatggcgatgaggcaactggatatcagtaaagatagataacttcaacttttaccttatgccatacacaaatttatcttagatcagagatgacttaaatgcaaaagctacaactattaaacttgttggagaaaatataggagaaaatcttgggataggaaaaaatttctgagagaggacactaaaagctcctaagaggaaaaaaaatggataaattggacttcattacaattggcaacttttgcttttcaaaagacaggattaaaaataaaaacaaggccaggcgcggtggctcacgcctgtaatcccagcactttgggaggccaaggcaggtggatcacctgaggtcagtagttcaagactagcctggccaacatggtgaaatcccctctctactaaaagtatagtagtcctagctgctcaggaggctgaggcaggagaatcgcttgagcccgggaggcatagattgcagtgagctgagatcgcaccactatactcaagccaggatgatagaggagactctgtctcaaaaaaaaaaaaaaaaaaaaaaaaaggacacgccccaaactaagagaaaatacaaatttcatggtgtttgcctcagatcaggtatggtagttgactagaaaacacaaggaaattttgagaagtgatggaaattttctataatttgaaaattatactagtggttacaagattgtatagatatataaaaactcttctaaatatgctttaaaatgggtgcattttactgtagataactagacctcaatcagttttatttttaattagtggatttaggatgagtatgttgatctgagaccttaactgagaagacaaagtacagaaccaggattcaacatcaaatctgtctcccctcccttttgctttctcttgtaccatgccatttcttatatgtccttgcttctcagaacagttccagttttaaaatatccagtccaatttatcctataattgcatttacactggccaaaccatatgcctttattgaggtttgggaattataataccaagaggcatggatggctttccaaagtatttagtctattcccctagtagctgacctaaatttctatttatcagttgagcaattatctttacctctgcgctaatctaagaaaccaatggcaaaggccaggcatgacatcaaggagtcagtaaggccagatgagtgagctaaatggcatctatacaattgagttttcagtcagggtgggtggtttgcttgagcttagcggtttgagaccagcctgagctcagcagttcgagacaagcctgggcaacatggtgaaactccatctctatcaaaaatacaaaaattagttgggtatagtggcatgcacccgtggtcgcagctactcaggaggctgaggtgggaggattgctggagcctgggaagtcaaggcttcagtgagccatgatcatgacactgcactccagcctgggtgacagagtgagacatggtctcaagaaacaaaacaaaacaacaaccagattactctggagtaggacagtgtgctaaaaataatttagattctttgcatttcaagttgtagagggaaagtagagaaattaggctgagtttttctttgtcttcatgtgattaaactgaatgtgaaggtttacaattattcagtaaaaggtagaaacaagcaaaaatgtgcctttatcttcctttattaggtaggcagtatgtctttgaacataagtgaatttcaaattttcatcatggtactttggtttgtatgtctgtgtgttcttgaatggtagccatattattaatgtgtcaggaaatagcagtagtactctattttggtgctcacagttacttaaagtgtagatgagtatattaagagacatgtatatagtgatttgtagtttacaaagtgtatttcttgtacatgatcttatctgagccaagtagtagattataagtgactaatttttaatagaaattatatacagtagaatatagttactatctgttatcctaaattttccttagggttgcttgaaaccacccttttctgcctagtgcttgtaatcattttccttctatgagactgtgaactccttgagggcaggaaacaggtcttagtcatctttgtttctaaagtgcccagaatgcctctggagtaaaatgaatagtaaaagtttcttgcattatattaagcatggcactgaaaaatcagtgattggctctaaattgcatttaataactgctagcccagtattctaatacatattactgctttctccagagacacccctgctctttaaaacaaacaaaaaccacaaacaggttcttttttgttacagagaaaggtcttgttggcagccttgtacccaaccctattttataactgaaaaatggaaagttgtttataatacatatgtgcactacttaatctctggcatttgtgtttgcaagctaacatgctgtctattgcatttgaacagctgtaacatatgtgatacgatttcttaataagtcattttcttgagcaatggaaatattgctgaagtagtagtccagcttattaagttgtacttttagacccttgggttttaaacataatcaattacctataattctgtatttgagaaagattgtgaagatagcattataaactgttttggaggtaacagaaattctttttttttttgatgtgcaaaaatagaggggtgcttacaactgtgtttaattggctgtaaagtcttacaaattttctcacccaaaaggaaggctgaaaatgaacatttatgcatggtaagtagccttttgaacccaaggtgacttaatcaacagtcaaatcaattgttgcttcgcatcatgacattgtttaatattctacatgtagaatatatatagtttttaaaaaataaatatccacaggagattgctggtactgattgttcccagagccaatgaaagtctttttgttcttttattgtatgtttgttgacaattgtgatcaacatggaatgaactgctttacagtttattactttcaaagtacaaatttgaatgctgtggattcagatgtataaaagagataaaattacagacagctttgagtggcagttacatatcaaacctcacgggggtttgacaggcaacgaatatcgttattagacgctttttccataattgctgacatttatccagtgtttcacagtatttgctaatgtattaatgcagtcaatctctgagaggctgcacatgcctttttagccctggcttttatgggattctgaaattcatagacccacagatacttattccctgctggttgccgtagtgacagagctcagagataagccaagacagagcccttttgtgattgcttttcaggtgacattcagcggcagcttgagtagagtgtccttttatagttcctgtaattcagaaaatgataacagctttttgctgcttagaagagaagtctgtggactgctccccttgggattttgttttgctgtgccacttcataccaacaccagcctgataaagttcttattattgtggagatttcaaagtgcaaggagatggaattaattatgacaggttagaagatacaggactgattttacgaataaaactttaaagaatcaatacatgttcgccaaccatatgtaacaagttaatttggacattttaagctattagtggcaatacagttagccacttgtttaataagtaaatgcacccaacttctaaattgcttgtgaaccctgctggctgttccatccaaagtgcagaaattatctttcagttctgttaccattttctcatttgaaactattgcttcaacattttgttgtttagaggcaagtagctttattttaacattttcttggttggggtatttataatttcactattctcagcattgcaataattaaaaatagataatttaaaaatagcaccttatctgaattgcttcaaattcagaagaaaacacctgtgatgatggagaagaacactgagaaggaaagcagttcgagaaataactagagaaaatagaattttacctggaaagatcatagaggaggtcataagaagccaatactttcacctagactgttaaagctaggagagttattaatcttaattctggaagaagaagaacaccacaaacaatgcataagtgtgggacaccttgagagctggaaaccactgtctgggtagctgatgttattgagaaagaggcaaaagaccaaaaacaaaataaaacaaaaaatgtcaagaagaatcggagacactaccccaaattgaaccatgcgaatctgctgggagataggaagcatttagatatcttacccctaaagtgtaaatgtaattcacagttaaactggaagcaagtagaatgaactaaatagagaagtaacttgagaatctgaagagattaaaaagaatagatgtgttcccaatttctaatagatgtgttcctgatttattgatgaacaagcatatggattgcacatgaatgagggttcagaagagcaatttggcttaataaaagccaatcagttatcttgaattagatgttcagttgaaaactggagatctgatttgtgttactcgtttctaacctttcagtcttatttagaatagatgtaagctaaactctcataaaattcaaatatttgtaattcagactaagaaaggtaaccttcagactagtgacaaatatgacattttcaaatgatatttagtagacctttattaacactctgttaccctatagtgttcatcgtaccccttacttcttattgttaacttaatcatcagtcatttgctttgatatacagtagtcccccttattctcaggtgatagatttaaagactgtagtgaatgcctgaaactactgataataccaacctctgtatatactatgttttttcatatacatgtacatctgtagtaaagtttaatttgtaaattaggcacaataagaaatttgcaacaataatagtaaaacaggacaatcattttaataataaaatcaaacacttatttcagaggatcccttgctgaaatcttcatataggttcaatgctttctggtgcaacacatgaccattcattggaaaatattttctgtttatgtttttcacccacaaatttaatgccttgttcatcttaactaagcacttaccacagacattgtggttgtaacttttgcactttggggtgcagcagcaaaactagcagatgtttctttttccttcaaatgcaatttcacttatagaaaacaagttctttttggagatcttagcaacctcagcatgattgttttttcttattaagtcaagaactttctccttttcacttaaaggaagcactttatggcttctctttgtcatatctgaattgccaacatcactactcttgagctttggggccattattaagtaaaataagggtaacttaaacacaagcactgtgataccttgacagtcaatctgataaatctgataaggtctactaaatgactaataggcaggttgagtatacagcatggatacactggacaaagggatgatttatgtcctgatggggacagatctggctggtgcaagatttcctcatgctacttagtatggcatgcaatttaaaacatgaataaatattaaattgggaataacaaaaatatttttggaccacagttgattgcaggtaactaaaactgtgtataaggagggactactggagttccatttcataacaatggaacaggatagctaggaaaaaaatgcgtttagacagtagagataactgcagtgtggcagaggaatggtaggagaatgaaaatagaggctgggcactgtggctcatgcctataatcccagcactttgggaggccgaggtgggtggattacgaggtcaggagcctggccaagatggtgaaaccccatctctactaaaaatacaaaaattagccgggcatggtggcaggtgtccttaatcccagctacttgggatgctggggcagagaattgcttgaaccgggatcgtgccactgcactccagcctgggcgacagagtgagactctcaaaaaaaaaaaaaaaaaaaaaagatatgatacactagatatgtaaactggaaagtgaaaccacagataaggggagactacgatattaaacaaaagaggaaaaagagatttgtaagaattgtattattatatgatacacttttcaatactgtggttatccatttaaagggactttcccagaattttgtcatccactgagaaggtctttaatattatgtcattccctcagtgttttagaatacttaactatcagtttataattgctactaaaaacaaaataagaaagcaaacaaaattatgcaacctatagaatagggggaaagggcatatagtctcaaaaaatgtggggagactgcatgttaaaaaacggttatatttagggaattggctctttttactaacatggcaacttattcctgaatccagaagttcaaaaatgctatcatagttcttacctatgatatttatctattttcagatgtttgtaaatttcagatgtaatgaaaattagccttttacagtatgacatcacaagttttgaagtgagcactaaaatcgctttttgaattttagtttaatgcaaaatatgtcttacaactaaacatggagtatttttgtgacttgactccagggaaccaaaataaatttttacatgaactgtaaccattctcttgacttctgtattatctttgctttattaataaataattagtaacaggaacaatatttaaacaatatttatgtatcttactttgttctaggcattttgctgaacgtcgatatgtttttttttttgagacagaggctcgctctgtcgccaggctggagtgcagtggcgtgatctcggctcactgcaacctccgcctcccaggttcaagcgattctcctgcctcagcctcctgagtagctgggattacaggcatgtgccactatgcctggctaattttgtatttttagtagagatggggtttctccatgttggtcaggctggtcttgaactcctgacttcaggtgatctgcctgtctcggcctcccaaagtgctgggattacaggcgtgagccactgcacctggccttatatgttttatctttaatcttcacgttaatcaatcccgaagggtagatgttattatccccacatttacacattaaggaactgaggcttagggtggtttaacaacttgttgaataacacagaaagaaggggtattgaaaagggatcttgacccgtgtttgactaaaggctacctctttttactataccataaattatttctctgtgaaccttaaatcccaagttcttatcctttctttcctagcatagttccccaattttacctattatgcacagtcagagattttccttaaagaatcttatctggaggccaggcacggtggctcacacctgtaatctcagcacttcaggaggccgaggcaggcagatcacttgaggtcaggagttcgagaccagcctgaccaatatgatgaaaccctgtctctattaaaatacaacacttagctgggcgtggtgccatgcacctataatttcagctacttgggaggctgagacaggataatcacttgaacgcgggaggcggaggttgcagtgagccgagatcgcaccattgcactccagcctgggaaacaagaaagagtgaaactccgtctcaaaaaaaaaaaaaaaaaaaaagcatctatctggatctataagattgatctttttgccttaagctcatgcctctctgggaataacaataatagatatcacttaaaaatatttattatatacaaggcattagtctaatacacatataataactcatttaaccttcccagcaaccctatgagctgaaggctattattcaccccattttacagttgagcaaactgaattatattgatatgaccacataaataataagtagcagtgggatttgaacccccaaagaatggccttaccacactatgtgcctctcttagtagtagaagatcagtgacaggatgtctgtgaaaacctgtcatctgtgttctttaggtgaataatgttcactgggtagcaactcatgatgagcatgctacacattgtggccatagttccatttttatggaatgtgagatgaaaacggtaactaggtctttctgtaatttactgtgaagtgtgactactgtgtgcacctgtttgacaattcttttagttgcattggtctagagacagttgacaagtttaatcacttttaagcttttgacatccaagaaggagaaggtattgtccttctagcctttttcatctctaaaactgttagccaagggtttactaattgatccataaaacttaagaaatgatattaaatatccccagttaaacatgaagataaaaggctaggtactttaaaatttgtccaaggccgcagagacaggattaaaacttgggagctccttatactgaacattagagtattgccactgaccaaaatcctacagtttcaaatcagatagctgtgtgtagaaaaagagcaatgaatatggggacagaaaatgttgtttctagttcaggctgagtaaaataagtttcttcacctgtgttctgtaccccatcaccttctattttctcaggaaacatatgttatcaataatatctaatatattttttctttgatctcattgtactagaaattctgttcacatttaaacatggcaagtctctcatcttaacagaaacacacacgcatacacacacacagaaacataaacataccattaaagcaaaaccaagaaatcctccctgactttagctactactttctcttctctttacagccaaaattcagagttatctgcagttattatctcaatttttttccttctacttattcgtcaactcatgccattctggctttcaatttgtttctccaccagaatagcttttctttaggtacgaatgactgccatgttgctaaatcaagtagactttcagtcttcactgttcttgacttcttagcagcatttaaaaaaaaaaatgttttgttgaaaacaattaggaaaatacacaaatcatgaatgtacaatttgatgaatttttaaaagtaaatactgccatgtagccagcatccagattaagaaagaaaacattttaaagtatcccagaagccccccctcacattccctttatccaaaagataagaccatagattagttttgcctggttttgaacattatatattatgaatcatgcggtatgtactatttgtctctttcactccctcctttcttcctttccttccttctttgtccaaccttccgtttatgagatggatccatatttttctatgtagttatagctcattcattctcagtgctttattatattccattgtgtggatatttcacccgtttatctgttctactattgatgaggcaggcatttagatagttttcacttctgggctatttaaaatactttctaggagcatttgaacctgttgaaaactccttcctgagacgctttttcatttggctcctagtttctccttttctatctcctttgcaagctcatccttctttaccctgtcactaaatataggagttctttaagactcagttccatgtactcatgtcttctcacttagtatcttcttcctaggtattctttatcatatctacaatttaaattatcactcatgtgagattgttaacaaatttatatttctagcctcatcttctcatgttagctccagaagagccttcttatcatcttcacttagaggtcccaaaggaactaaaatttaccatatccaaaattgaattcatattattccctgcgcatgcctgatcttcttcttaagtattctaattccatgaatggcatcacaatccatccagttccacaagcaagataagagttattcttaatttctctctgtcttgctgactttatgtaaatcatcatcaattcctgtccattttagctcctacatatctcccattcattcacttctatttccactgccactaccccaatataagataccaacttttcattgtggactgtttattgcagaagtttccaaattgggcttctatatttactctcacttcccctcaatcaactctccgtactatatcagaataacactttttaaaagagatataaatctactcaagtaatctccctgcttaaatcttcccatgtaaagaccggaccccttaatatgactaaccaggcactgcatagtctgattcttgcttacttctgcaaagtagtcttacttcttgcttacttctttagtgttatcttatattttattgcctcttgttctctgttcactagctacactggtctgagagttcttctgaggtaccatcattggggctttttatcctgttccctgatatatcctgtataattcttattctttcaactcaaacatttcttcatggaagctgtccttttattgcatttacagttgtgattttatattttatttagggattatttcctattttataccatatgttccacaagggcatatgtctgtttttgttcattattgcatacctaatccctttggatagtaggtgctcaataaagattgtttgaatgaataaacctctctaaaactcagtttccaattcttaacaactgtgacattgttgtcagtttaaataagatgacatatttggaaacacatctgaaaatataacacaataacaaaatttaaggaattgggatcattatacccaagcagatagattcttcctactgaagattataattatttaatttaactttgattttggaatatgcaaaaacatgacaacaagtatggtttcagctcttttgatctattgatctgtctctcctgtagttccaccattcttaccatagtttagactcttataactttctcctgatttccctgtttcagatctttctgtcttacttccctcactccattctccagaacttgaggaatgtgagttatcttattaaatgcatttgcatcttattacttgcttgcttcaaatctctcagtggtttcccgttgcctacaagataatgtctaaactccttaatggaacatatttgactgttcataatctgatcagtgcctcccttcctacctgtgttcctcaccattttgtgccttacctggcctccaaccactctaaactacttgtttcttagatgtgttaccttttttcttgccattatgcatatcatttctttctcttctaaggtgcttacactccgcctaccctcctctttaattaaatcatcctttaagactcagctgacactcctttgtgacatttctcttgaagtcttcaggcaaagttagacattatctcttcttgtactaccaaagcattgattgtgggacttaaccacattggtaaaattagttacacttcttgtgtataagtttattcactactgtttgtgaacccctcaaaagcaagaataccattctttttctctctctatccttaggtacatagtagatacttaatatttgttgacaggatgattagagaagaatgcccagaagaaatgaggaatggccagattttaaggtgtgagaagttgtatcagaacaaatttatgctgtagtagtggattccctgtattgttgttaagagtgtaggattctctgccgggagcggtggctcacgcctgtaatcccagcactttgggaagctgaggtgggtggatcatctaaggtcaggagttcgagaccagcctgaccaacatggtgaaaccccgtctttattaaaatacaaaattagctgggcgtggtggtgcacgcctgtaatcccagctactcgggaggctgaggcaggagaatctcttgaacctgggaggcggagggttcagtgagccgagatcatgccattgcactccagcctgggcaacaagagcaaaactgcttctcaaaaaaaaaaaaaaaaaaaaagagtgtgggattctagtgctgtataaaagggagagttaaacctgatttcactttgaatggagaaggttaacaatcacatgtttttattgcacatctacttatgacagttggattctactttggggtcttgtaagtcacaccaagggaatatatgtgaaaagttagagatatggtaatgctgttcttatttagtgcataggataagcctagttagaaaatgttggagaaataaaatcaattatctatttttccttttttgttttccttttcatatgttgaagccctctgtttttcagttttaaaatcctttcatatagattaactcatttttttcatatctgcttaatcaggcaaaggagttattgtttttgtttgttttgtttacaaataaggaaactgagattcagagagataaattacttttgcaagaacactagaaagtttgaaagttggccgggcgcggtggctcacgcatgtaatcccagcactttgggaggccgaggcgggcagatcacaaggtcaggagttcgaaccagcctggccagcacagtgaaaccctatctctactaaaaaatacaaaaaattagctgggcgtggtggctggcacccataatcccagctacttgggagggtgaggcaggagaatcgcttgaacccaggaggtgaaggttgcagtgagctgagatcacgccactccaccccagcctgggcgacagagatagactgcatctgaaaaaaaaagttcgaaagttgtgtctggactaggactagtcatttctacttgactgcctgccacggaactacgtggtctttctagtggcaacactagcatacagtgccatttgtatttgtggttcttcttcttctttcttctttcttcttcttctttcttcttcttccttcttcttcctcttcttcctcttcttctttcttcttcttcttctttctttgtttttttttgagacagggtctcgctctgtcacccaagctggagtgcagtggtgcaatcacaactcactgcagccttgcctcctggctcctgggctcccacttcagcttcttgggtagttgtgactacaggcgcataccaccatgcctgcctaattttttgtattttttgtagagacagggttttgccaagttgcccagcctggtcttgaacacctgggctcaagtgatcctcccaccttggcctctcaaagtgctgggattacaggcatgagctaccacacctggcctcatttgtgctctggtttatgaggaatttttttaaacctgagccaaaatttctttttcttttctttctttctttttttttttttcaagacagagtctcactctgttgcctaggctggagtgcaagtggcacgatctcagctcactgcaacttgccctccacctgccgggttcaagcaattctcctgcctcagcctcccgagtagctgggactacaggtgcacgccgccacacccagctaatttctttgtattttagtagagacagggtttcgccatgttgcccaggctggtttcgaactcatgagctcaggcagtccacccgccttggcctcccaaagtgctaggattacaggtgtgagccaccacgcctgtcctaacctgagccaaaatttctaaaaattcccaaactacactcaaaatggaagattgtctcccaaatgccacagttttaatgaatgaatataatctagcagtgtcctcaaatgctctttacttcatatgggctgatttgaactcgatgcacttattgagcttattgatacttgaggatctgaggaaatgaagcaatacaggtaaagttcagtaaagttgggaaccggtgagaacagggtcatggtgtaggagaagatgatattagtgagccctagggagcaaaaactagggtacagtatgggattaccaccaagtgcaagataatgagggagagaatcaggtcctagaggaagatttgaggaataagggtagaatctaaaagaaacttcaagctacctctcatttatgaccaattgtgcctaccactgcttcctggtgtgcacaggtatactatcaaacgttctccagagaagccaaattcccctactcctcacagtattttcagggatatcccactttagtaaagaggaggtcatagtaggtgtccaataaatactggaatcctctctgttcctctttaccatcctccccacccccaagtccaagatttcccttaactctgaaattttatgattctgtaaaattctaatacatgtccttcagcaaatgaaatggatcaattaaaaacaggtaaatttcaagtaatattagattcctggatgacaattgtactaatatcctttaaaagtaactctcaagagagtggatgagatagctaactaaatgcggcctggaagtgccacttctaccgagagagaccaaatcatcaagtcagcataatttgggcaactcttaggagagaaaatgccaagagtggctggtgaggagatgctgaagccaaggctgaaaagggaggaagctgggaaccttgtgtggagtatctgaatgctggtgctagttcttggccctgaatagcttttgggaaaggggtgtattaaggaaatgagggatagctcactcttgccacagaccagcctagctacggcggaccctttatcctccatggacatgtgagctggcagggtaatctttcttttttttttctttttatttttttttttttgagatggagtctcgctctgttgcccaggctggagtgcagtggtgtaatctcggctcactgcaacctccacctcccgaattcaagtgatttcctgcctcagcttcctgagtagctgggattacaggcacctgccaccatgcccggctaatttttgtatttttagtagagactgggtttcaccatactggccaggctggtctcgaacttccgacctcaggccatccgcctgccttggcctcccatagtgctgggattacaggcgtgagccactgtgcctggccagcaggggaatctttctagggagcaagacagacaggagtgtggtcggcatggagcccaggagcttttgtgtgctggtcagctctggcagagattagccatagacacccaccctccagggctcctcatcttcctctaggaggtgctggccccaggtaacctccaacctaagaaagatcggggctgggccaggtgcagtgcctcactcctgtaatctcagcactttgggaggccgaggtgggtggatcacctgagctcaggagttcgagaccacccagggcaacatggtgaaaccctgtctctattaaaaatacaaaaaaattaactgtgtggtggtgcgcccctgtagtcccaggtatttgggaggctgaggcaggagaaccacttgagccccagaggcgaaggttgcagtgagctgagatcccgccactacactccagcttgggctacagagtgagactccatctcaaaaaaaaaaaaaaaaaaaaaaaaaagaaaaaaagaaagatcggggctaacttccccgtaagactggggcatatctgcaagccctcctgctcactggctcctgcgaaggcccattcctagctgccttgcaggagcgtgtacacagcaccccctttgcagcccagccagagtgcattgttccacctgagtattttcccagtgactcaggagcacatcagaaaccccagcacagccataaccccaccctgagctgtgggacttcctggtacttccagggctgtggcatgtagcttaggagtatggagccaagatctaagaccaacacttgagcaggggaggagcccccaccatcagaggactgagaactagggtaggagcagggtgtgcctccctccacagggctggtccggaaagtgtgcggcatatctccctgctccagcctctgcctgagggggccccatggcccggaacacctaacaaaagaaaatgcaggcacagtgccagtgactggagggggcacccccaaggctcagaagcagacctggtgagggagccatctcctcccctcccacaccacagagcacacctgagaatgcaagaaagtacaaaagatctatgtggctggatatttgcctagctactggccattactcttaagcaccatctactggatcgcagctcaaactgcaaaaacaaaaattatcctgctaatatatacacctgtgaaaccaagtgcaagaattcacccacacataaagaatcaacacaagaactctcgcagttgaaaaagccagtgtccccttacctccagacaagtccactagtttcccaacaatggttcttaaccattccaaaatgactgcaatgacagacacagaattgagaatctggatgtcaacgaagtgcattgagattcaggagaaaattgaaacccaatccaaggaatctagcaaaatgatccaagagctgaaagatgaaatagtcattttaagaaagaaccaaactgaatttctagagctgctaagtttactacaagaatttcataatacaatacaagtatgaacaacagaatagaccaagaggaggaaagactctcagagctcaaagactggttcttcaaatcaactcattcagacaaaaataaagaaaaaatttaaaacaatgaacaaaacctccaagaaatgtgggattatgttaagagaccaaatctaggctggacacggtggctcacgcctataatcccagcattttgggaggccgaggcgggcggatcatgaggtcaggagttcgagaccaacctggccaacatagtgaaaccctgtctttactaaaaatacaaaaattagccaggcgtagtggtgggcacctgtagtcccagctacttgggaagttgaggcaggagaatcgcttgaacctggaaggcagaggttgcagtgagccgagattgtgccattgcactccagcctgggagacagagcaagactctgtctcaaaaaaaaaaaaaaaaagagagagagagaccaaatctactattcattggcatttttaagagagaaggagagagaataagcaacttggaaaatatatttgaggatatagtccatgaaaatttccctaatctcactacaaaaattgatatgcaaatccaggaaatacagagaaccctggttagatactatatgagacgaccatccccaaggcatgtactcatcagattcaccaaggtcaatgtaaaagaaaaaatcttaaaggcagctagagagaatggtcaagtcatatacagagagaacccaatcaggctagacaaccccattagcagcaggcctgtgagcacaaaccctacaagctaaaagagatttggggcctatattcagcatccttaaataaatttcaaccaagaatttcatatcccagcaaactaagctttataagtgaaggagaaacaaaatccttctcagacaagcaaatgctgagggaatgtgtttcaaatagaccagccttataagaggtccttctgggagtactaaacttggaatcaaaagaatgataccactacaacaaacacacacttaagcacatagcccacagacactgaaaagcaattatacaatcaggtctacatagcagccagctaacaccacaatgacaggatcaaaatcacatatatcagtactaactttgaatataaatgggctaaacgcctcacttaaaagacacagaatgacaaactgaataaaaagataagacccaaccatctgttgtgttcaagagacacatctcacacataatgacacccacagtctcaaagtaaagggatggagaaagatctaccacgcagaaataaaacataatagagcaaggggccaggtgtgctggctcacacctgtaatcctagcactttgggagtccaaggctggtgaattacatgaggtcaggagttcgagaccagcctggctaacatggtgaaaccttgtctctactaaaaatacaaaaatcagccgggcatggtggtatggtggtgcacgcctgtaatcccagctacccaggaggctgaggcagaagaatcgctggaacccaggaggcagatgctgcagtgagctgagagtgtgccactgcactccagcctgggcgacagagtgagactctgtctcaaaaaaaaaaaaaagcaagctttgctattcttatattcgataaaacaaatgttagtaaaaattaagaaggacaataaagggccttatgtaatgataaagggtacagcacaacaggaagacttaactatcctaaatatatgctcacccagcattggagcacccagattcataaaacaagtttttggcattaaaaaagatttaggtggccgggcgcggtggctcatgcctgtaataccagcactttgggaggccgaggcagcctgatcacctgaggtcaggagttcgagacctgcctggccaacatggtaaatccccatctctactgaaaatacaaaaaaaaaaaaaaaaaaaactctaaaaactacacaaacagatggatattaaacaacttgctccagaataactcctgagtgaacaccagtattagcgaaaattaccaaaatctctgggatgcagctaaagcagtgttaagaggaaagtttatagctctaaacaccctcattaattagttagaaagctctaaaattaacaatttaacattaaacctaaaaaaactaaaagaacaaataaaccccaaagctagcagaagaaaagaaccaaaattggagaagtgcatgatgaaattgagatgcaaacatccatacaaaagatgaaaacaagagttggctcttcgaaaaaataagcaagattgatagactactagctagattaacaaaggaaaaaagagaagatctaaataaatacaatcagaaatgacaaagatgacattacaactgattccacagaaatacaaaagatcttcatagtactatgaacaactctatgcacacaaattagaaaatttggaggaaatagagaaattcctggaaacacacaatctcccaaggttgaatcaggaagaaattgaatccctgaatagacgagtatcaagctttgaaattgaataaataataaaaaacttgccaaccaaaaaaagcactggaccagatggagtcacagctgaattctgccagacacctaaagaagaactggtatcagtgctactgaaattattaaaaaaaaaaaaaaaaaaacagaagaggagggactccttccctagctcatgctgtgaggccagcgtcaccctaatactataatctggcagagaccataaagaaagagaagtaaggccaatatctctgatgaacaaagatgcaaaactcctcaataaaatactagcaaactgaatccggaagcacctcaaaaacttaattcgccacagttaagtaggctttatccctgggatgcaaagttggtttaacatacacaaatcaataaatgtgattcaccacataaacagaattaaaagcaaaaaccatatgatcatctcaatagacgcagtaaaagcttttgataaaatctgaacatcacttcttgataaaaaccctcaacagatgaggcattgaaggaacatatctcaaaataataagagccatctatcattaaccacaaacccacagctaacattatactgaatggacaaaagctgggaccatttcccttgagaactggaacaatacaaggatgcctactctcaccactcctatttaacatagtactgaaagtcctagccacagcaatcaggcaagagaaagaaatgaaaggcatccaaatggaaaaagaagtcaaactgtatctctttgctgatgatatgattctatacctagaaaaccctaaggactctgccagaagctcctagaactgatagacaatttagcaaggtttctggatataaaatcaatgtacagcctgagtgcggtagctcatgcctgtaatcctagcactttgggaggcagaggtgggcagatcacttgaggtcaggagtttgagaccagcctggccaacatggccaaatcctgactctactaaaaatacaaaaattagctgggcatggtggcgcatgcttgtaatcccagctactcaggagactgaggcacaagaatcacttgaatccaggaggtggaggttgcagtgagccaagattgtgccactgtactttaacctgggcaacagagtgagactctgtctcaaaaaaaaaaaaaaaaatcagtatacaaaaatcagtagcatttctatacaccagtaacacccaggctgagagtcaaactaagaacacaatcccatttacattagccacaaagaaaatgaaatacctaggaatacaactaaccaaggaggtggaagatctctaaaatgagaactacaaaacactgctgaaagaaatcagagatgacaaataaatggaaaaacaattcatagtcatgcattggaagaatcagtatcattaaaatggccacagtgacaaaggcaacatacagattctgtgttattccgatcaaactaccaatgttacttttcactaaactagaaacaaaaattctaaaattaatatggaacctagaaagagcctgaatacccaaagcaatactaagctgaaagaacaaaatgggacttcaaactaaagtgtaaggctacagtaaccaaaatagcatggtattgatacaaaaacagacacatagaccaatggaacagaatagaagactcagaaataaagtcacttacctacaaccatctgatttttgacaaggccaacaaaacaagcaatgtggaaaggactcccttttcaataaatgtgctgggataactggctagccatatgcaaaggaatggaactaggcaccttaaattttataatatacaaaaattatctcaagatggattaaagatttaaatgtaaaacctcaaactataaaaatcccagaagaaaacgtgggaaatacccttctcaataagggccttggcaaagatttttttggcttagtccccaaaaacagttgcaacaaaaacaaaaattgacaagtaggacctaattaaactaaagagcatctgcacagaaaaataaactattgacggagtaaatgacatacagaatgggagaaaatactttcaaactctacatccaacaaaaattctatatccaaaaatctgtaaggaactgaaacaaacaagcagaaaacaagcccattaaaaaatggataaaggatataaacagacatttctcaaaagaagacatataagcagctaacaaacatatgaaaaaatgctaatcatcagaggaatgcaaattaaaaccacaatgagataccatctcacaccagacaaaatgactatattaaaaagtcagaaaacagtagatgctggcaagactgcatagaaaagggagcacttacatactgttagtggtaatgtaaattagttcagtcactatggagagcagtttggagatttctcaaagaacttaaatcagagctaccattcaacccaacagttccattacgggtatatacagcccctccccagcaaatagattattgtaccaaaatgacacttgcagtgctattcacaatagcaaagacatggaatcaacctaggtggacatcagtggtggattggataaagaaaatgtggtacatatacaccatggaatactatgctgcctggaaaaagaatgaaagcatatcttttgcagcaacctggatggagctggaggccattacctaagctaagtaatgcacgaacagacaaccaaacactgtgtgttctcacttacaagtgggagctaaacactgagcacacatgggcataaacatgggaacagtagacactgtggactactagagcagggagggagggtgtgggttgtaaaactacctattgggtagtatgctcactacctgggtgcaatatacccatgtaaaaatcctgtacatgtactccctgtgtctaacataaaagttgaaatttaaaaaataaaaataaatcatgctcacattctcatgtcattttttttctcattttgctgggaaacttttttttttttttttttttgagacggagtttcgctgttgcggcccaggctggagtgcaatgacgcgatctcggctcactgcaacctctgcctcccaggtttaagtgattctcctgcctcagcctccctagtagctgggattacaggcatacaccatgacgcccagctaattttgtatttttagtagagatggggtttctccatgttggtcagactggtctcgaactcctgaccttaggtaatccgcccaccttggcctcccaaagtgctgggattacaggtgtgagctaccgtgcccagcccattttgttttgtttttaaaggaagatttctaatattactatgtgttgatcaaaataatttataaaatgatttattcccagtctctagaaaatattttgcagtttttgtttttttacactcacataaacattcttttttttccccccttaactctaatatttcaatacatttattcagcttgaagttacaggtaaactagttttttgaataatcggacttagtagtacacaacaatagtttctgcctggtttgaagagttaacacttcacagctttcagatttgtggcattgacgtaaataagtgctgcaggtatgagtctgcccatagaatacatgcttgtcttgggaatggatcattcttttaccatgtgccaaaatatttttgaaaagagttttggatctgagggttttcccatttttgtctcttggtttttttgtgtgtgttttttttctttttttttcagacagagtctcactctattgccaggctggaatgcagtggcacaatcccgactcactgcaacctccacctctcaggttcaagcagttctcctgcctcagcctcccaagtagctgagattacaggcacgtgccaccacgcccggataatttttgtatttttagtatagacagggtttcactatgttggccaggacggtcttgatctcttgaccttgaggtctgcccgcctcggcctcccaaagtgctggggttacaggtgtgagccaccatgccctgcctggtttttttgtttgtttgtttttttaatataaaagatttttcttgcaatgcatgtgtatatataagaaccagtaaataaacacatgtatattgagtgattacttactatttcttgtatttacttgagtgggagtcctaaaaagtataattccttgtgtattattcttatgtgagacatttcaaatctgttggatttttttaatgtttaatatacattataaatttgaaaatgtttttattagctacattattcatcctcataaatttaagagcaatcatgtcttacaacgtagagctgaatgacatttggattactgtaattcccatgaagtccacagagatgaaatacattagaatgcaaagctaattatacaggaacattaagtatgaaatgaaaacagtatgtctgtcaaaaaatgaagatgcgtaagttcaaattatgttgaaggtaaatttggtctttattttgcatattttgattggtagttttaagtctttgtgactactgaattaaatttaatatgccatatcatgtcagaatgcttttgaaccttatacttttcactgaggcccagatgtcaatcagatagttatttaaactctaatgatagtttttagtgtttatctcactttggagtggtttccaggccttggattataggactaggtaggttatatatttctctagaaaattacaagtctttcatattttatcttggcaaggaaagtaggaaaagtacccatataagttagagcattagacatttattgcatggcatatacaaagcaacctactaagagccccatggcagctaaaaatgagaatataagatccaggctgtgtcttcaaggaccttagagtcacctaaacacagatacaatgaaagttgtagttcttttaaatcacaaaacactaattctagagcttcacaataacggttttaagagttgagcagaaggaaaaaaattacttggctaggctgagccagcaaggattaactggcaaggtgaaattactttttcttgtttctagatagtacccatttatgctggtgtgcctaacatggtatagttaattcagactcttttttcctaggaggaaaagccaggacaagatgcccagcagcactatgtccatgtcccgagaccaaagttgttagcatgactgcctaggttttgccaaggaattagatgctgctggaaaaatatccagagctcttatatttgctatccaaagagttccacagtgttgaggggtaaatggcatctcactattgactagacatgagccaagtggctcgttggtacccttcatgcatacaaagcaggcttgagatgtatccttgcatatttgaaggttctgtggttatgatgagctgaaatgaccactgattaatacagtagctctctaaaataatgaggtttctccactaacggaacctctttatttatcaaacttataataaaatgaggaatctgcttgaggtaaaataaccttttcattgtaactgaagatttcgtcttgattctctgaatttgttgtgattgtagaataaggcaaagggcttgttttgataagatcctagactgttataatcaatatatcatgtgttgactttatatgcttttgttaatgtgactatctaaatgttaggaaaatgaagaaaaatatcttcagaaaatgttacatttctaataatgcacttttcctgtgtatgatggtttttaaatttttcaaactattaagatactgaaattatgtggccataacaagattaccatcgaactgttttcgttcaccaatatgtgtgattttctacaaacaagcaatttcttctgttgaatttcctgctcagcgtcattattttgccctttgcttttcatgtgtttaacactttctgtttcaaagccagtttccatgagctctgccttgtgtcctccagcctgtgcatgtgtatatacgtgtgtgggtatgtggggaggttggtggggggtgagaaatgacagttaattcctgttaactctgaccaagtaatgtacggtgggtatttgtgaatcaaattgtgcattgtgaaaaatacgtatctgtccactcctgttttcctagtgaacattagcattgattatgatgtggacatatttctcagactttctgggtcttcatctaaatagcagcagcaaataatgaagtattcagagcttaaccatcatcatctcatgtttccttgagtttaaattgaagtaaaaatggagtaaaagaccatcttatttatttttaaaatctgctatccgcagaaagtaattaactcaagatccacaattagcctcacagcagtccatattaactacctccaactatcctaggtctttcagaggtggcataattttgagattattttgcacttgaaacagagaggcttataataactagcttgaagcacatttaagggtgtgaggtttttcctttttctttttgtgttaatatctaccttgtctaatgataattttctggtttgtaagtggaaaaaagcaaatattagaagaaaattctttctccctaatacaaagctaagtctttcataagtctaaaagtagctgctttgctttaactggaaatttcattattgaattagtaacttgacacaaaagaattaacaaagtgaatcaaatactccagcacaatgaagtaaatttaaagaggcccactcatcaccattgctggctggtaaagtgtaattgctggtgctgccttgtttacctttttggtttgattttgttttaaaggaaatgttcacttgtatagcattcctgcataattcagatgctgcacaaagctcgaccctgggaacctattttgtagctctctgaatgttttttatgcaacctgcttttacaggtttaaattacattttgtgacactgtttttgtggttgaattagaaactttttttttctttagttaaacctgtgataagtaattgtcacagctagtgccttggtacaatgctaatttgaagtgacatgtccatactggccctctgtaacatgaagaagcctaacaggtgtgaggggtgtggcttcccatgggctctcttgaacttctaaccgagaaaaacagcagaaaaagtgaaatgaaccttgaataaagctgtcagcagtaattatctcagcgacactttgtggggagataaaataagcactgatgcttttataacctgagcacattgcatccaagatagatttttcacccatttagtataaacttctaaatacctttcaagagatattttcatacagcctaattaaacaataacaacaataacaattaacgtgaaatataaattgttgaaaaacatgcatttgtttttattttaacatggtttctttttgatatttaagtagttttaataacagaaaactttttccatgcttctttttgtggtaagccattatggtgtgaaatctcaagtaatgtgtagaaaattatgttctcttttgggaaaggatacttccacaattagaaaaatgcttgaaagtttggttttcagtttctttgagaggtattcagtgtattgaacatatcatcatatggatcatatatgaaacaggtaatacatatatttgaatgagctgaatgacctgcaagtcatcatatgaaccccactgtattggagtacagtaagaaccacggaagatttgatcaatgttttttaatctgttctccaaacacaatccattgtctttttctttgacagctgtcttttaaaagtatactttaatttatttagcaaactaattcaaatcactaatgactatgtttgcctgacctgagtagagtatagaaaagttaaagtgagatttttgtttataaatttcctggctatagaagctaactgtgggggtgtgggggagtaaacaggtgaaacgtggttttgcaacataagttgttctctttattcttttcatggtcttaaaatatagttatattttgggcaatctaatgacttaactttttttttttttccataattcaacttcaccatgttcctgcatccccaaaattaaaagcttgacaagtcagcctggttggtttatgtttcaggtggagatgatgtcatttttaaaagctgggaatcttcaggcacagtagctcacacctgtaatcccagcactttgggaagctaaggtaggaggattgcttgagcccaggagttcgagaccagtgtgggcaacatagcaagactctactaaaaatttaaaaaaagttggccagatgtggtggcatgtgcctgtagtatcagctgctcaggaggctgaagtggaaaaattgttggagcctgggaggtaaaggctgtggtgagctgtgatcaagccactgcactccagcctgggtgacagagtgagaccttgcctcaaataaatactagagatgaagttagttctgactcagttttgctgtctgttaggtctgtgatcgaccctgggtgaaaatatgagcctcatttttcttgtctgtgaaatggcggtgtggcaagctatgccaggttcattcttactaagagggaataacaaggattaggcagaatagcataaaatagaactagcatgatctatactttattcacaaacctaaagcctggaaaattattggctttatcaaagcagaaactgttcaccattggctctatctctagcactcagctgaggtcttgacacattgtggttgttcagtaactattagttaagtgagtggataatggtattttgcactctacttatagtactgtctgtctgttcccccagagtgatttagcaacattcatacagtcaagcatagatagatatattggttgatagacagattcagatacacatactcttgaatcttcacaacaatcttgtaacttataagactttacagaggtggaaattaaggcactgagaaggtgagagagttgtccagagtcatacaagctcttaaccagcagagccaggatttcaaaccctagaagaatggctttggagtccaagttcataattgctctgcttttatacctctgcaacgaagtatagtgacatctacctaccaaagaagttaccttacaatgacacatttttccagatacttcgttgtcagtgatacaaatgatttgagagatagggggagacattttggggtaggacttctccttcttcagtaagacactacttcttcccctcccctcctaggacagcaggtcccctcatccgttgtactcattgaagcaatgttgcagcctctcttaggattaccatttccctagtgaacagaacagaaatgtcatacatggttatggcctgggcagacttccaaagatgtaggatgacagagttttgatctctaggaatttggctttcccctcctttgggtccagttcctgacccactcatgtaaaacctttgtctattgaggtgcaaggcgggactgaactccagaggcagggctcaggcacctgaccaaattgaggactagctaaaatagggacagggcaaaagcagctttccataagacatgtccaccattgtgccatgtctgtttaccattaccatgggaacacccagaagttactgcccctttccatgtcaacaactaaacaacccagaagttatcccccttttcctagaaatttctgcataaccaccccttaatttgcatgtaattaaaagcaggtataaatatgactgcagaacagcctttgagctgctactctgagcacactgcctatgggggagccctgctccgcaaggagcagtagctttgctactgttgtacactgccacttcaataaaagttgctgtcttaacacctctggtccacccttgaattcttttctgggcaaagccaagaacccttctgtgctaagccctagttttgggactcgcctgccctgcatcactgtgacatccacattgcctctgtctactcagttcccacctgggattctgggtctccccttaggaactagctgaataaatgaggtttatctggaagatttgtccgagtgtcactggatatgattgactaccaaaagataccaagtgttttggagacagaaaaatgtgaaattggggaggtcatatagaaggctttcagaaagagattgagctgagttttgaagaagttttgtcacttaaattttcctcatattatgttcacatgcctaagaaatagacagatggaaaagaatggtgagggaaacccaggcaagagtaatggactgagcagaagcctaagagtaggcacatgcaaggcacatttttggatcattgagcaaagaaacctgtatacaaaaatagtgggaggtaatggctggaaaggtgggcagggttatggccttgaacatcagactgaaaaagttttcagggtgagagaaaacatgagaatcatctagtccaattttttcatcatacaggtgataaaacttagagaagaaagtcgatcaaggtcacagaatgaataagaggcagatttagagttttaacccaggtcctttgctctatatatagtgtttttcccaagtatttacacacctggaatcataccacaggctgacttatggcagaaaggagtcatacaagggcaccatgaagcctaaagatgtaaaagaacaatttttgctttgctttaatggtggcaacaggaaaaaaaaaggtggcttacaggctagttaaatgtttttaagctaaatgttctcaggaggcttaactggtccctcaaagtcattgcagcagacagagatacctttttagtttttcatttgtttgtttgtttgtttttgttgttgttatttttgcctccaatagcctgttgttctttctctcaattttggtttagttcctctcgcaggaattgaatgggaaacctggagcaagttccacttttggacatggctatgtaatgtatcctttcgaaattcccagtcgtaagcaggtaatgagtgatataagatatgggcccttagaaaccctcacagctcagccaggcgcggtggctcacgcctgtaataccagcactttgggaggccgaggtgggcggatcacctgaggtcagaagtccgagaccagcctgaccaacatggagaaactccgtctctactaaaatacaaaaaaattagccaggtgtggtggcgcatccctataatcccagctactcgggaggctgaagcaggagaatcgcttgaacctgggaggcggaggttgtggtgagctgagatcgtgccattgcactccagcctgggcaacaagagtgaaactccgtctcaaaaaaaaaaaaaaaaaaaaaaaaaaagcaactctcacagctacaatatatctaaacaaaaatgctctccacaggttggcactcacaagaatgttatgtgggaaatgataagaaacccttctctctttataatttaaatttgttcacttaggaagaaatttttctttaacattggtcggcatcatttggatatctttggtatggaaaagactgaataatatatttggttgttatatgttttagaacatatactaatacagttaaatttaattgacataagttgatataaaatacttaaatgataccaattctgtcatctaggcttagattcttaaaaataattgggcattgcaactgaaaacacctatatgataatccttctggcaaggacacaaagatgaggtggtgtgtgatttttatttttttaaagttgaaaatctagtccactatgctacatattttttcacttatctctttattgctgtcaacaaagatattattcccatttctcagacaaggaaactgagatgttttgagataagcagctttcctgagaaatgacattagttatcaaagcctggctccaaggccaggttatttggatccaagtgcctgacatataataacttaatatttattgaataagttatcaactctgagtaactatatggttagtataacattcaacaaatagttctaaattatcaaataatatgaggaagaaaagcagagtcaagagaaatctgcacatattccagatctctctttccccctcacccttcttactggttataggcaatgtgtttaatatgttcttttccctcttctgccctccaccagagggtgctcataagcaactaaatggcataaagctgtagtgataggaactgtgaaagaagggctattttaattcacagtgtggattattggcctctgtgaaaaaaaaaaaaagttgactttgaaacagagttcttgattgagctgaaataactttggtttaaagttgccttacaaataacatcttgagcacttacttacctgaggatagtacttttttatataggtaaagttgaccattctctctaaaaaggtatgagggactatgccattagacagtgttaggctggtctgggttgtatttcttattgtgtaacttaatgctcttcagaagtattttaatgacgtaaaatacttcagaacctcttctagtgtactcactaaaatcaataagtaatgaagtacaagaatattgatgtctgtgtttagttataaaagcatatccatttagaaattgtgctaattctgttacagtgagcagctctttatctcgctatgacataatctggttttaggggatgaaatgccctagaagattaaaaaaacaaacaaacaaaaaaaccttttatattgagcaacctctgtttgatagccaaaatctcaagataatgttgggacagtataaggaagcataaaagtgggtaattataatgtggaaaatagcatcaggtgattctccttgattttgagagtcccaccagattaaatgaaagaaaccaaaaaagtaagtcaggagcatttaaaattactatatatatttccaaaagcttttaaaaagaaaatatgagataattaaatcaagatatttgttagtattttacaattaactgtaacatctttaaaaaacacatagctggctgggtgtggtggctcacacctgtaatcccagcactttgagaggccaaaagggggagcccaggagctcaagaccagcctgggcaacatgatgagactccatctctacaaaaaataaggagaccctcatttctacaaaaaattaaagaattagctgggcatggcagcatgcacctgcagactcagccacacaggaggctgaggtgggaggattgcttgatgctgggagatcgaggtggcagtcggccgtgattgtaccactgcactccagtctgggtaacaaagcaagactgtctcaaaaaacaaaaaaagaagaaaaagaaaaaccgagattaggagtcaagaagagaacatgcttgtgctatcattaagcagatgtgagacttgggacaaacactttacctctctatacctcagtttcttttcctgttaagtgagaggattagacccttatcttgtgaggagaaactgcctttcatttggaatctgttggggatggtgggatcactgatagaagtttaagagaaggctgctgataccttctctctggaaattcttattactagcttggaatggggcaagggagatgctgagtggtggaagatatggcagtagcacttgactcagctaaggcttcaagatctcctggttgggatacaagcaactgatgaattctgaggactcttccaaatctagtatcttgtgtgtaaaatgaagccatgtatagcagccatccttgtttcttccagctccggttgcttacatggtagtgtttgtgtttatgtacatagcaaaaagcctgagaacttgtaactgttggtgtttatttcattaaactttaccaacttgccaaatcaattgaggactataacgcagcaaggccaggcagagaacacagttttttgagctatttacacaggagttttgttgataattgatcttgacctgcacatgtcttttaatattctgttggttccagaatattattagtcacttcctttttaacagtgtgcttttttatgaggtgactaaactgctgtttaaccctgctacaagaatgtggcagtgggctagtccagacaagtgcatgtacacttggtaactagcattcttgataagcttgcttcaacctgccacaaattaaagctctgtgtgacttttctagcacataagtgacaaaaaaaatggctgggggaagggcagaagaaacctcggattgtgaataaaaataagctttttagagttgcgctttggttggcagtaaatgaaattttagcctcatgactcagttcggtttaaaactacctcagtaatctatttagctgaacagtaagcatctgaaaatttaaaaggggtattctagaagtcatcttcaggactccttactataaaaaaccttatctacgttggaaatgtgatgtaatagaaaactccatggcttttggagttaaatctggtttgccatctggtacctgatttatcttggacaggttactccactactctaaggttgttttatgatttgtacaatcacgatagtctttaatttacagagttgtcatgtatggtagacatatgttaagcacttactatgtagtttctgactaatggatggtatctaggagtagctgttttaattaagccaaagaaagtaattactggttatcagatagtaagacaagatatcttagagccttaatagttgttcgattggatactttttaaatggttgtgagataaagtgcctgagttttaattttggttcaccagtcagtacctgtttgactttgggcaaccttcttattctgtgtgagatttagtaacctcatctctaaagtggggattataatccttacctggcagagttattgtgagaattaagtggggtagtgcgtgtaaagcactttgtgtaataacaatacatactgagctcttaatagtagcagttattatacaactgctttttaaaatacggaatggtttcatgggtgtatgtatatatatgtcaaaaagcaatactttaggctgggtgaggtggctcctatctgtaatcccagcattttgggaagccgaggcgggcagatcacttgaggtgaggagttcaagatcagcctgggcaacatgatgaaaccccatctctacaaaaatacaaaaattagccggacttggtggcatgcacctgtagtcccaggtactcaggaggctgaggcaggagaatcgtttgaacctgggagacggaggttgcagtgagctgagatcacaccactgcactccagcctgggtggcagagtgagactctgtctcaaaaaaaaaaaaaaaaagcaatactttatatgaggatataaatgcatatattaatagcactgaatactgccttattgaagtataattgacctgtaataaaccatacattttttaagtgtacagttggatacatcttgacatacaaatacacagattaaaaagatcatcagtgcagtgtagtcagtgctaatatccggtagcattcccaaatctggatgaaattacatcagtgtcttgtgaggacgatgacaagcttgagatatggtttttaaaaaatgtctcatattaattgttcttcttaaaacacaagagaattgtattttacaaactgagtgaataaaagataaaaacagtaaagctgtagtttgaatctcgttcacttgtgttactgggtgtgtcacatgcagagcaaggagtctgcaggtgacataaccaaatctccttagtgatgtatgaagatcatagcccattagggctagaagggatctgagaggccatttagttggtcgtacctatattttacaaaaggagatgttaagactcttggttactgacccaaggtcccataacaggttttatagcttccaatactcttaaaatgtcttattctttgtcatttataattagaaaaaaagacagactgcaagcatgtatttggggagggttaaaatttggctataaaataaaaaatactttgaagaactaattcatatgtatatgaatatatgtatatatgaatatatgtatacatatgaatatatatgtgtatatatgaatatatgtgtgtatatgaatatatatagtgtgtgtgtgtatatatatatatatgaatatatatgtattgtttgagactgagtctcacccaggctggagtgcagcggctcaatctcagctcactgcaacctctgcctcccgggttcaaacagttctcctgcctcagcctcccgagtgcctgagagtacaggctcccgccaccatgccgagctagtttttgtatttttagtagagacggggtttcaccacgttggtcaggctggtctcgaactgctggcctcaagtgatctgccctccttggcctcccaaagtgctggaattacaggtgtctcacaccgagccaccacgcccagcctactaattcatatttttaaagaaagaagtattaagaatggccttaaatgctctgaggaccaagcttaacatgataatactgtgttttactaacaacttgttagacatagccagagatcagtcatgatggtttactggagttttcctttgcatattgtcctagtattttattttcatgtgaagaataacataaagaataatacaaagaaaatactatatgctttgtttattgtgtaaagaagaaacatcgaaaagattctaagattttgaaagagcttttttgtcttctcagttgtttcaagtaatagttgtcattattcatgaaaattagttgcatatgtacacattacatagttcagcagttcacagctttttggtctcaggatccttttgcacttgtaaagaaatcatcaaagaccccagagagcttttgtttatgtggattatattcattgacatttaccattctaaaaattaatattgaagaaaataatatttaagataacaagtgaattacatgttaatataaatagcatttttatacaaagtaattatattttctaaaaattcagtaagtaaagtgacactgtttttatacttttacaaatctctttaatgtctgtcttaatagaagacaactggattttcgtgtcttccttcttctgcatttaacctgttgtaatgaatttttttgattgaaaatatgaagaaaatctgacctcctacagatctatagttggaaaagggaggagtattttaatagtcttttcaaataattatagatattattctttgatactaaactagaacttgagaagtggtagtttcctaaaggttagtcttattttttttattttaatttttttgtgtgtgtatatgtggcaaggagctttctcgggtaaagctaaatgttactttcaatgtagaatctgaagccctaccactatacattttgtattaatactttgtcacagtaagatacattggtctgcctcacagtttgaattaaacctttatccatacataattttataacatcatgcaatcactgttcatttggagaatattggtcttgtgagttatgcagattttctaaatgttgacacatttcattacatgatataaaaagtcacatctattatattaatataaccactgaacgcatcacaaaggctttaagcattgagaagctgtcaagctcatgatggctgatagtttttaaaactcttaatttttacatgaaaactcaaattttgtcattggcaattaatactgtcagacctgttccttgaagtagtagtctcacttcattcattttggagaaaatgttcagcaattagggatactcaatcacaggttgagtatccgtaatctgaaaatctgaaactttttaagcagcaacatgatgttaaaaggaaatgctcattggagcatttcagattttggatttttagatttgagatgctcaactgttaggtatatatgatgccaatattccaaaacccaaaacagttctaagtctgaaacacctctggtcccaagcattttaaataagggatacttgtctaaataccaaatccaaataaccacagtttgtctgcccatcatttgtttaagtagtaatggtgtttctgaaaaaaagtggctgattcagcatataactgaaacacacatgctttttcttcaacccatccattatactttggtatgctgtagaagtcctttatacatacttcccatttgtcacatagaatattaaaagacatgtattaagagtcaaaatttacttaataaataaattaaattacttaataatttttactgatttaacagggacattattaaatgaaactgccatttttacagtgagtaaatggaactggagatttttaacagcttggtgttactaccttaatttgtgctgaagtaccagcagatttgcctaccattgctttttttaacatcagtataaaaacactgtggccaggtgtggtggcttaggcctgtaatcccagcactttgggaggctgaggtgggcagatcacctgaggtcaggagttcaagaccagcctggccaacgtgttaaaaccccgtctctacaaagatacaaaaattagccaggcatggtggcacacacctgtaatcccagctgcttcggaggctgaagcaggagaatcactcgaacctgggaggtggaggttgcagtgagctgagatcgtaccactgcactccagcctgggtgacagagcgaggttccctctcaagaaaataaataaataaatacaacacagtgaaaaagtctaatgccatttaagtattattatgaaataattttgaccttatggaactactgaaagaatctcaagaaccctgtgcctgtagtacatactttgagaatcacatagtatgttcttttttttttgagacggagtttcactcttgttgtccaggttggagtgcaatggcacaatctcagcttactgcaacctccacttcccaggttcaagcaattctcctgcctcagcctcccaagtagctgggattacaagcatgaaccaccatgcccggctaattttttgtatttagtagaaatgggatttcaccatgttggtcaggctggtctcgaattcttgacctcaggtgatccactcgcctcagcctcccaaagtgctgagattacaggcgtgagccaccgcgcccagcacatgagccattgcgcccagcacagtatgttcttaacactaaatactgtttgtaagaagaaaagaaaaaacttcaaatggactttgagtattcactcactgatagaatatctactatgtagcaagtgtattctcatttaagccatcctcacagaaagcctgttaggaaaggtcatgttaattttacagaacagaaaacttagcctttttttttttttttttttttttaaagacaggttcttgctttatcacccaggctagaatgcagtggcatgatctcagttctctgcagccttgacctcctgggctcaagcaatcctcccatctcagcctccctagtagctggactatgggtgtgttccaccatgcccagctaattggtttttctttttttggagacagggtctcactctgtcacccaagctggagtacagtggcatgatcacagctcactgcagccttaaccacctgggctcaagtgatcctcctgcctcagcaacccaagtagcaaggactacaggcgtgcacccccatacccagctaatcttttgtttatgtttttagagacaagatctcactatgttgcccaagctggtcttgaactcctgagctcaggctatcctcctgactcagccttgcaaagtgctggaattacaggcatgagccaccacgcccagccaggaaacttagtttcgagatggaaaatattgattcgagtgaatagtagaagtgaatttgaactcaggacactctgagtttaaaagtccattctacacttagccgtctcctgttactaaatagaaaaagttcctttagggatcaacaagaatttgttaagtgcctgccttttccatggattactttttaacagaacaaatttacttaattttgttcatttttcttcatgtcttgtcaaaaaatgatttaccatccttatatttcaatcattgacagctgacaagaacaattaaattcttgccaactatagctattttttccttaagatgtggccttaaaaatataaatactgtaaaataataattatttttgtgaaaaagggttttctttggataatttaaatgcataaactttttgtgttgatgtagtataattgtcaaattatttaattggacacatatacttaaaataatgttaatattatataatgttaatttacaaatactgcttttgtagctaccctcatatttcatgatatttattcaaattctatgggcatttttttatatataagcatcatcatcaccactagggtcacttttttttttctttttggttgacattgtaaagactaaataattgaattgaataagataactactcttgtgttaattaaggaacaggctaacttagaaagaccccagaatataaggtgacagtgggcttctctcatggaacagtctaggtgaggaaggtgtttctgctaaagtcatgttttctagagtccatccttttcgctggacattttatctcaagccacagatattcttcacagactagtaaaaagtaatgtttgttgagccaccaactgtgtgctaggcattttctcattgctttacccataaactcaaccttattatccctacgctgtggagaaagtaataatcaaatactatccctatctaggtgtcattaaggacagttgtaattttttcatttgcttattttttgttttgttttggtttcatttgtcctatgtatgtatattcatcatcttcccaagacatttttcaaagtatcttttaaagacaggtttataaggacttttaatacttgcaattgtgagattatacagagctctaggaataatcatgtcttatcattgtcttctttattaaccagttttgacaagtaaactctgggagaacctgaagcatcattgactcaggttatttaaggctaatctgtcgaaacagtgtattgaaaatgaagtatttgaggaagcaccctgtaataggagaacttttgtaactactcaaatataaggcagcttcctttatgataaaacctaaacttagatttttgtatatttctgatatatgtatcttatggaaattttaaattttgtatctcacctacaattttatatttctatccctactgccttcggagttaggaaaatgaggtattattctgctaatcagaaaagtagcagacgcacattgaggcagtgggggattgggggcaagtatgtatgatttgccttattttgggctcataccagtttcctagaacctcagtctatcatctaatgaaaattagccttagctaccataacatcccatgtgtggaaaaatttcaaattttcaaagccttcctggtaatgtaatacccaggatactagagttagctttctaatctagcttcagcaataatagaaaatacctgaaaagtcaaatccttttgtgaaacatggccgtattttgtttacaaatgatggattctactttttgcagatgtgtcttgctgaatcagggctctcttatccctgccatcgacttacagtgggaagaagatcttcacctgcacagacccgggaacagtcggaagaagtaagcctgtttgccagcttttctttgaacagaaggcccatcccccacctacctgcgcacttccctttttttttatctgccagagcaatgaacagataaagttaatgtagcattaattaaatctcggtaaattcttgaaggcagaaactgtccatgcaaggttactactaatgtgctccttctcgctctgttagtttcatgtttcaacagacggaattcagatggattggttgaaatgatttttacttagaaccatcaggctaacaaagaactttctaggctgggcacagtcactcacgcctgtaatcccagcactttggatggccgagacaggcagagcacatgaggccaggagttcgagaccagcctggccaacatagtaaaaccccgtctctactaaaaatacaaaaattagccaggtgtggtggcagacacctataatcccagctacttgggaggctgaggcatgagaattgcttgaatccagcaggcagaggttgcagtgagccgagatcgcgccactgcactccagcctaagcaacagcatgagaatgcatctcaaaaaagaaaaaagaaacttttttttgctattgactgtgtagttgagtagattcattaggattgaccccggaagtcctttaactcattgggttggagcacttactatgaagcagacactgtgcttaatatctttagataacaaagatgaataacactatacctataccaaagtgctgagagtcaagggtgatagataaaataacagtggccaggtacagtgacttacacctgtaatcccagcactttgagaggccaaggtgagtggatcacctgaggtcaggagttcgagaccagcctgaccaacatggagaaactccgtctctactaaaaatacaaaattagttgggtgtggtggcgcattcctttaatcccagctacgcaggaggctaaggcaggagaatcacttgaacccaagaggtggaggttgtagtgagccgagattgtgccattgcactccagcctgggcaacaagagtgaaattccatctcaaaaaaaaataaaaataaaaagataataataatagtgatggcataatataaaaaatgcagtgatagtgttgcacacaggggtcctaaagaaacaaagagaaggggcagataagattgaacacgtttgtttgtgtgttgtgcctatttgggtctaagtgagcctaaagaatatatatatatataattttttttttttttttgagatggggtttcactcttgttgcccaggttggagtgcaatggagcgatctcggctcactgcaacctccacctcccaggttcaagcgattgtcctgcctcagcctcccaagtagctgggactacaggtgcccgccaccacgctcagctaatttttgtatttttaatagagacggggtttcactatattggccaggctggtctcgaactcctgacctcgtgatccacccccaacccccaccccccccggcctcccaaattgctgggattacaggtgtgagccaccacgcctggcccaagcctaaagaatattataaggaaatatttaaattctgttccatggctacaaacagcactttcatgcccaactctgaccatggttataaggaaatgggaaagagagcatggatgttttaacttatttaagaaatatttattgagctcttactatgtgctaggaaaagtcatcaccaagacttcaaaagtgtatacaatggaggtcataactaaatagcacagatgaactttatttaaactataattttttttttttttttttgagacaggatctcactctgtcacccaggctggagtgcaatggtgcgatctcggctcactacaacctctgcctcctgggttcaagtgattctcgtgcctcagcctcccaggtagctgggattacaggcacgcaccaccacacccggctcaattttttgtgtttttaatagagacggggtttcactatgttggccaggctggtcttgaactcctgacctcaaatgatccaccctcctcagccctccaaagtgctgggattacaggtgtgagccaccacgcctggccttaaactagaattttttaagacagagcatgattcaagtatttaaaagcttaggctagtaagataaaaatttttttccatttacattctatacaaaatgtggttgctcatttttatttaaactgcctatatattttggacacccattatggaagctaccacaggacttctccagccatcctttgaatacgtatttatatcacttaaacatgtgaaagagaaatggagttatgtaattgaagttgtagtctataatcatcctgtgaaaattataatttgccactctggtttttaacattttttagaaaaccacagagaaggaagtgttttcccctgctaataatatgactgtgctgtattatactgtactatacttggtctccaaaaatgtttattccttttcaagagaccaaaccatttttttttaaagcactttatctcactagcccttgtgaaagaaagataatattgagtttcactgcttggcagaaattgccggacataatttaatgagatatttctttaaagtgcttgagtctgtttttaatggctagagtaggtcatacttccactctttaatggataaatccactaacattaaaaggtggccaactagccccaaccaaaatttttaattattctgtgtcctatctgagaggtgacaggtaactgtttcacttcatttattttcttctctcaccctcactattatatgtgttatttgggtggtcccatcagcagagagaagtcagttccatatagtgaagagcagtgtttgtgaggctagcacactatttaggttattttgagaaaatggtagtgtgggattgggaggctttgccaaactaaaacattcacaacctcggtaatatcttattattactgaataataatatcttattattaggagttttgccctcctataataaccagtttcatttttgagcagctttttctgttgtcttccttatattaagttgaaatatgtgtaattgtaccttctacccagtgattctactgctgtcttccggttctactcctacatgactttgtgtgttttaagacaatcatctttctttctttttttttttttttgaaacagagtcttgctctgttgcccaggctgaagtacagtggcacaatcttagctcactgcagccttctccccacgggttcaagcaattctcgtgccttagcctcccaagtagcagggactacaggcatgtgccaccatgcccggcattttgagtagagacaggattttgccatgttggccaaactggttttaagctccttacctcaagtgatctgccctccttggcctcccaaagtgttggggttacaggtgtgagtcaccgtgcccagccaacaataatcattttgctgttgactttcttaaactttgagttaggaaggaaatatttgagaccagcagttaaattcaagttttagactttatggattgtagttatatttcctttagctgggagaattttgattcttacatcatctctctggccctacagacacagtttctttacgatcatttaatattttttcttctcatcctccccttgttcctgagcccccgtttaatgatttttccatatttctggatacctagctaggtaacaatttatcctcagttgcttgggtgagacagtgtgggggccttgttgaccctggctccttgggaattgttcagttctcagttgacagtgaagaaggagaagaaatccaaaaacttaacaacaacaaaaagttttaatgtaatgttaaaagcatcagtttataactatggttaaagaaacatttattgaatgctcactatgtactagtcagatgaatataaattgataattttatattatatgattaatgagaaaattgaggcaagcatgagatgctaggggagcatagataatgggggtgggttgtaactttcaagaatgtttgcaggcaagaactttgtttgtctttctcccctctgtagccctaacacctagcatagtgcctggcatgtaacagacacagaatagttatttgtaaatgaatattttttaaataaaggaaataaaaaaagactagaggaggtgacatccacattggattataaagaatgagtcacagccaaataaagaatcaaaggaatcatattccattcattccattcagagaaaaaaagcatgatttgatgtagcaaatgagaagagataagtgtaggttgctgttagtgcagaagaaagtcgggggaaaaggaagataagagatgaggtgaaagtgagtaagtcttgtatgacacattgagaatttggaactgtagaaagcagtaaaagccttttttttttttttttttttctgagatggagtctcgctctgttgcctagggtggagtgcagtggtgcgatctcggctcactgcaacctccacctctcgggtgcaagctattctcgtgcctcagtctcctgagtaactgggattataggcacccaccaccatgcccggtgaaatttttgtatttttagtagagacgaggtttcgccatgttggccaggctggtaactcctgaccttaagtcgtgatccacctgccacgcccttccaaagtgctgggattgcaggcatgagccactgcacctggccagcagtaaaagacttttaagtggggagtgatatctccccacaaatacacagtttagtgaagagcgctctgctgtgcacaggctagatttaaaagaaacaagacagaagacagagaaatcaggtatgagtctgttgtactagtgcaagcaagagataatggaatcctcaatgtaatacagcacatttacagaatgaaggaaaaaaacacgtcatcatctgcatttggtaacattcaacaccctttcatggtaaaactagaaatagaagaaaactacttcaacataatgaaagacatatctgaaaaactcacagcaaacatcatactcaagggtgaaagactgaaaactttttctctaaaatcaggaacaagataagaatgacccctttctttctttcttttttttttttggagacagagtctcgctctgttgcccaggctggagtacagtggcacgatcttggctcactgcaacctccgcctcctgggttcaagtgattctcctgcctcagcctcctgagtagctgggactacaggagtacaccaccacacctggctaatttttgtaattttagtagagacagggtttcaccatattggtcagactggtctcaaactcctgacctcaggtgatctatccgcctcagcctcccaaagtgctgggattacaggcgtgagccacggcgcccggccaagaatgacccctttcaccatttctatttgacatagttctggaagttctggccagggcaattaggcaagaaaaagaaaaagaaataaaaggaaggattaaaataatctctgttcactgaggataattttatatgtagacaactccaaagattacatttttaaaaaactattggaactaaaaaatgaattcagcaaaataccaagatacaaagtcaacacacaaaaatcacttgcatttctataaaccaacagtcaacaagctgaacagaaaattagaaaaacaattccaatgtcaaagcatcaaacagaataatacttaggaattaactaataaaagaagcgggagacttgtactatgaaagctaccaaacattgctgaaaaattaaagaagatataaataaatggaaacacatttcatgtacatgggttggaaggcgtaatattgtagtgcccaaagcagtctacagaaatccgtatcaaaattccaatggtggttttttgcagaaatagaaaaacttatccaaaaattcatatggaatttcaagggaccttgaatagccaaaaacaatcctgaaaaagaacaaagctggaggactcactcttcctgattccaatgtttagtaaaaagatacagtaatctcaacagtacagtgctagactaacatatagcccaatggaatataatagagagccccaacataccagcatattatgataaaatggtttttgacaagggcactaatcccattcaatggagaaagggaagttttttcaacaaacggtactgggaaaactggatatccacatgcgaaagaatgaagttggacccttacctaatatcatatgcaaaactaaactcaaaatatatgaaagacctaactgtaagatctaaaacaatacaactgttaaaagaaaacatagggcaaaagttttatgacattggatttggcaatgatatcttggtatgacactaatggcacaggtaacaaaagaaaaaatagagaaattggacttggtgaaaattaaaaagttttgtgcatcaaaaaacactagcaatggagttaaaaaggcaacccacagaatgggagaaaatatttgcaaatcatacatctgatatgggatcaatgtctataaaatatagagaactcctaaaactaagtaatataacaacccagttaaaaaatgggcaaagacccagagctgcaagactgctactgctgtagttgttctggcctgggaacacagcccagcagccttgacagtctctgggtgtgtgacctaccactcctctcccttccccacctggagtcacctgagctgctcctgcttgggtctagaatccctcctcagcagacttcgtatttttcaggtgcctaagcacctgaaatccctcctccccagagccaccccagctgctgcccctgtgggttctttggcccagggacacaacacagctactgcatgtgtgcctgaaaacagctctgtgaccactcatcacaggcttcaaacccaccactacatgtacctgaggcttaccccagcagctaggctactgcatgctgccagccctggctgtcacagttttatgtctataagtaggtgatcttgccccttggctcctgcccctaccactgtgcttgcaatcacagatggccctgcagctgcccacatatacacagatagtctaattcctgtcacctaaccctagctggtccctgcaattgaggataagcaagcttccagccctgaccatcccacatgtgctcttacagtcttgcccatctcctgtttctgtctccagcacttaccccagtgcatgaggctacatctggatctgctgccagaggcatgtctgcagccagcctctacaccagaggatgtgcatttcactggctctggccttcattgttgctagccatggccctttgttgctggacacagaggcacagcagaggactccagtagcccttgcagcctctgcagacctcccacaacttttgccgtcaaggatcacacaggtgccaatgtcacagactcttaactgtctaggctgacaagactcagtgtcccccctagacctcaagtcaccacacacacacaccacttggtatcttgtgcccttagaccccatgccacagcatgccccagagtgcctctctccttctctaccctctctccacacccacaggtgaaggtctctccttactgatggcagcccataaagtctggaagaggtaactttttcatcaaatgcacagacacctttgcaagaatacaaggatcataaggaatttcggaaagatgataccaccaaaggaaccaataaactctagtaactgaccctaaagaattagagatacacgaattgcctgacaaatagtttaaaataagttcacattcagcctgggcaaatagtgagaccctgtctatacaaaatatatgaaaattagctggatgtagtggcacgtactgcaacttccatctcccacgttcaagtgattctcctgcctcagccttccaggtagctgggattacaggcgtctgccaccgcaccaggctaatttttgtgtttttagtggagatggggtttcatcatgttggccaggctggtctcgaactcctgaccttaagtgatccgcctgcctcggcctctgaaagtgctgggattacaggcatgagccaccatgcctggctgacatacctagtttttaacatagtgccttgacataataggtagttggtgaatgttgctgaaaggaacatctatttcaattataagcttgctttaatgccagttatgagttctaaatgtttaccttaaacggtttagttatcatctcctccaggaagtttttcctgattcctaccccctatgatttaggtcctctcttctgaatttacatgtcatagcactaatcactctgtgtataatatatggtgctccttaagagaggatatactgtatcttccacataggtccaaacagcgtagcacttaacagtgatttgtaaatgtttgttaaatgttaaaggtaataaatgaatgcaataagcataatcactaattttttagctgtttttaaaattatgaataaatactttttctggatttaaagaattttagggcagccatgacagataccgagagattatctattctcatcagcaaacattaatgaaaaaaagtttatcttattttttagaaaaagctttttctaacctgttagatggctgataaaaaaatatgaagagactgggagttccttatacataattaagtagttcattcttgcagatatttcaataattcatatttgaaatatacttttttcaacaaaattggctttttagatacctccctttgaagatgttgtggttataggattttgttttctggaattttaagaggtttggggattctctactttgtgaagggaaaacgaataatggagacacatggagaatattaaaatcactatcttagtatgaagtaaggtcctgttgttatagaaggagctaatgtattgaacaggatttggagaaagaggatggatgtgggacagtaaagtaaaaggggtaagtatagaaagaagtatatatagaacattcccttttttctcccctgtgtctcccaccccttgttcttaacctgatgcctcaaaggagggggtgagtactaggcaagattaagcaaagactgaattgatagcttacctgatagaggatgtgagaagatttgtcatactcgtcctttgtttcttttcagttgcctgtgaatctggctaggcactgtaaaagaacatgtggtatatcttgtaaatcttgagcctttacctatttaagactaagcctcaaatttaaaggcaacttcattctccagatatttgactacctgaaacacagcgggaactcaagcactgttgtcctagtaaatgtgttgttttgtggaggaggctctttcactgctctaaaatgagaaagcattgtggatttttaagctgttgactagcttaaaccaggagatcttagatctacgaacaaactattaagggaggaggaccagtgtttccgtgagaagtagagttaagatggcaggtaaatgcttcagggaaggaccatttatttattcatgcaacaaatgtatcttcattatcttgtctattcaaagcattagaaagattgtcttaaagttgagagggaaaatatgattatgattctctgcattaatgcttgggtatgcccaaggaggaaatgctgacatttgacactaagtcaaatgagaaacatcttgactttctcatttggaactcttagaatcactagatgagcagttttaaaaagtgtttcatggggtcctgagatcctctggctataccccaggtgtcaacagatacaaggaagaaaaggccaactccaagagcattaagctccccattgacctctccctgtatcaaccagagtagtcctacttttatgtattgtaatattttgtttgggcctaggggagggaggaaaccctatgaaaataagttagaaaaccgccgatgacagatttttaagatccttccagctttaaaatctatgattcaacaactgtctaacctctgacattccctctagctaaatttttatgagtcttttatttttgagccagggtctcactctgtcactcaggctagagtgcagtggtgcaaacaaggctcactgcaaccttgacctcgtgggctcaagtgatcctcctgcctcagcctcccaagtaactaagaccagcggcacaccatcatgccagacttttttctttttttttttttttttttttatgtagagatgagatctggccatgatgcccaggctaattatgagtcttatattttgtttctattaatgcttttctggcaaaatatttatgttatattaggttattctacatagactgaaggatcagtttccccattttataacttaagtacatagtgccacattttaaaagatagaaattttatttactaagtaatatttatagactttatttattgaacataggacagacaagcatgtagccagatatcttgcttggaccgtcttcttacctaaggcatgaatattcagcagtatttacagcccagtccaaaagttttatatctcagtatttcagaatcacattctaacctagagaataacagcctagttctttgaagcagatgtttttaataccttttcaattgatgttgctgaaaacaaaataaacagagcatattcatcagtgctcagcaggtagtaaattctcagtaatttttactgaattaaaacattattattacaactcatatgtaaaacattattattacatctcatcttcagtttacaaagagctttcatatgtagtgtatttcatgttatccataacaatgtgaggatagtgtaccatatttcacaaagagaaacctgagaaccactgcagtaaggaagtggaaagtttagaaatgctaccattgcctccacctgccaaatataaattaatgtgagctttttgagagacgcataacttactttgtctctgacttctccagttgtacccattttctcatttgttttgcacttacttgtatactatatgctggggaaaaagacaaaaatccctgtctttatttagtttgtaagcattcttcatttcccgaaggttggagaccttcggtctacaggtatcacagaaagtttaggaagtatgtaagccttaaaaggaaaaaatagtaagctttactctagcaaatgagtttatttgataaaaattttataacgcttatgtcctgttgttattattataacttattcttagaatttgataggccaaaatcaatatgaaactaatcaggactttccttaaatagcaaatcaccgatgttcatatggttagtgatagcgatggagatgactttgaagatgctacagaatttggggtggatgatggagaagtatttggcatggcgtcatctgccttgagaaaatctccaatgagtgagtattaatagctctttgggtccagcaatagaattctttcttctagtacacaaacttatgaagaacattaaacttaaacatctcttactgacctccaggtttgaggagataagataatagagagtaggcattcttcattagaaccagagccttttgaatttagattttattaaactcaaaaattctcagtgcattaggaaaattcattaaaaatgcaaggtagtgtaacttttgttttacatgtataatgaattatgactgtctctctttaaacctagaggctgattaacaaacaggtgtactttctgtgaccgatacttgtttccccacatcttattagagatatcagttttaagagtaataatgttacttttctattcaacggtacccatctttggaaggaaaaaagtaaactaaatgtaccatctctttcacttccacttacaagatgtgtactatagaataacaagacatgctacgtgcaaaatgaccactaaaataataatggcctatttactttgtgaaattagagaactcctgtgggcagaaatagatgtgatgtttacataaaattggttattttcccaattaatgaagtctttaaaataatatcagacccatttaatataatttagtcacaagatgtctatttcaagaaaacattgaaatcctaaatgacaactgggcacatattttaaatgcttagcaggattgtgtccattggtttttcaaaatttatgagcttggaatattttaaggttctttttgattctggtttgatgagatctaatatatgttgagttaaactatcccctcagatatatcacagaagctaaaatttaattttatttcctctttattgattgaatatatttcttatatgtgggattagatgttatgtggtttgtttttgtgtctatttgttttgtttttttgtttttgttttttcttttgtttgttttttagtgccagaaaacgcagaaaatgaaggagatgccttattacaatttacagcagagttttcttcaaggtagggttaggacattaactatataaatttgatgctgttttatgctactgtgatttttcttgggcaattttaattatagattgtttaaagtttctccttaaagtattcaaaggatatacttgttaatttatatagtcctaatagtgaaacacataaataaccagtaaaccatttatgccactttagagatagattcaacttatttctgtatgtttatggacgttcaataaatggatcctaatttaatatttttattatattcccaaaggactaggatataggatagtaatttttagtatatcttaggacagtcaaatggaaaatcctttaaaataatattaaatttaaaaatactttaaacattttaaatccaagtgaattttttcctttatttttttcttttggaattgctttacatttcttccttaagtgtcaaatataaaatattttatatgcatttgagagtctgctgaggtattcaaatataaagagaattaatgtttaatcctcaatttggtgtaaatgatattgttttagtgatattttctgttgaaatataatatggagacttttaaaagaaacagttttttccttctattggaattctggaataaatgaactgaagtgggaaaataaggctaatgtaactagtaaaatcatatgaaagtgagtaaccaagagtttcttcttataaatggcatggttttatagcacttattaaattcatttgctaagtgtacttaaaattccagtattttagtatatcagtataggccaagaagaattctaaaaaccaataaagctcatttccaagcttttaaagaaatgtttttatgtttagtatgcactagacattagccccaacatttacttaaaagtcattgattagacttgtgaaatctgaagtgaatttgaaaagtattttaattaatagactcactttttcctatagatatggtgattgccatcctgtattttttattggctcattagaagctgcttttcaagaggccttctatgtgaaagcccgagatgtaagtacagtttgaccttttctgattaaaaagtgcatcccacaggtttaccactagggctgaggcaatgcttaaatgttttctgtttttgtttttgtttttttccaaaaacatggaactcttcacgaatttgtatgtcatcattgtgcatgggccatgctaatcatctctgtataagtccaattttagtattatgtgctgctgaagcaagcaccgttttctgttttcattttgagattggagactttatttgtttctggttcatctgctaacctagtcttcaccaagatacccatttcacaagggacattaatgtgataggggtactgctggctcttgcagaaggccttgtgaagcactgaaatagggtttttttttaaatgggaaaaaaggtggatgtgcttagaagggaccaagctacatatttgtattcttttcagttacgcaaatgactagttcttgatagatttgttctttaaacttttcccaaaatgattattctgtgtagtgatatatatctaacaactgcaatatttttccccaaaagtcactttgggcccctgcccacccccccaaaaaaaggttttaaacatagaaatggactttgtgatcttgaagtctataagaagaagcccataacaagaatttagaagataagttttgagcaagaagattctaatcactatttgtatgttgtcacagcagtcaagacatcagcaatctggctcctgcctatctatgtagcttcagctcttcccattccctgcctcacacttaataaataaatctggcaatagtgtaccatttgtattgccccataatcttactctttcttcatgcttccccactgctagaaatgcctttcattctgctctttacctggatgactcctcctcctcctctgaaacttaccttttccacctcctccccttctctcacattggcagcacctacccctttagcacttcccagtgaaaaaccctctgcttatctcttattgttacacttaacacagtgtttataattatccattctacatatgtcttcccaggagttttgattttcttttggcagggactatcctttatgtccctgtacttagtaaaaattcagtaaatgtttaataaatcaaggaataaagaaagggaagaaggaaggaatagtgtgtacatggagtagaggggaaagctgttggaattaaagagggcaaggagtttgagaacagagtgcaaggatgcctctgagatttctattttctagagtatgttaaattctgatacaaagaaaaattcatttaaaaataaattttaaaaatcaaattccaagatgattaatcaaattagagctataattgacagtctaatgaatttagagtaagaaacttctttaccctaagaatagcagaatagcccttttaaaagctgttttaagcaattatgtttcaactgttcaatctatataaaaatggctgtttttaaagaattgcatgtttatggcaatatatgtttatggtgttcataaatataggtttatggaaaatactgggctggatgtgatggctcatgcctgtaatccagcactttgggaagccacggcgagtggatcacttgagctcaggagttcaagatcagcctgagcaacctggtgaaaccccatctttacaaaaaatcatacaaaaattagccaggcctggtgatgcatgcctctagtcccagctacttggggggctgaggcaggaggattgcttgagcccaggaggtggaggttgcagtgagccaagatcatgccactgcactccagcctggataataggtgatattctttcttggaaggaaaaaagaaaataccgaaaagcaaagagaaagtattctaacacagattaactgttaactttgttatgctctttgcatattattgtatgtttagttgaccatatatatggatttttagtataaaatttagtcatgttataatcctgtaataacagctttttttaccttttaatattatatgatcactttcttaattataacttcttttatagtattttaactttttattataaaaaattatttaaattttaatacagaaaaagtactatagtacaataaatagccaaatcccctatacctacctttaataattaggaaaattttgccatatttttatcttccatatataggcatctcaaagtcttaatggagttttaaggcttaatgacttaaaaggattaactgctacagattgacaaaagagcagcatttgaaatttatttatatttttatacttatttggatttgtgattttgatgaataaatttttataaatttttgtttcagttcctctgattaaaaatgacaaatgttgactggaacagaaaataaattaaaaatttattcaaaattcacaaaaacaaacaagtataaaataaatataaataattaaaacttcaaataaattttaatagtttttagcagttaagcttttgaagttattgaaacttaaactgcacagaaacatttagggtatactgtatatttattattttttgctaagccatttcaaaataaattatagatgtcatactttacccctaaaaacttcagcatgcattttccaaaaataatgatattctcctacataatcacaataccattttcacatataacaaaattaacgataattctctaatattatctactatccagtgcatatacaaacttcaccagtcatccccagaatttctttttagctgttttttttggaaccacaatccactcaaggatcacaagttatatttgagtattagatatcttaaataccttttaagcaagcaccatctctccccattttttcctcctggcgtttgctttgtgaagaaatcagaccggatgacttgtagatggttccaaattctggatttgtgtgattgtttccttgtgatattatttttctgatttcctgaaaaatggatattaggtctaaaagctttgttagatttaggtgacatgctttgtaaaataatgctgaatattttattttaacaggatttttaatggttatggagtctcattgtatggccatgttgttatatttaaacaatcacttattagacataaatatgtttgaaagaatatctaattatagtttcaaaataatgtatttttcaacttattctttgataatagtgcatttctctgcttaccagtagttgaagtaaccagaaaatgtcacagccttttgtaacttaaactgtagctcccaaaataggtatagatatttttaaaagcccatttccaaagcttctgtaagatatactatgtatacctcacacattttagctttaaatgcagataacttacacttaaaaatacagtatatcgtagacaaaagaacttttactaagtgtcttgtacagtaaattggcatttggatttattcagactgataatcccctgaggaatataagctcttgtttattaactcctggatatttctaatgaaacaattgattgtttgcttttcttagtgtctaggtgttttagcagatgaaaaattattggttcatgtaattaaatattttgcttcctattagatttgtaaccaaaatccactgacctctctggactgataaaaatgtctttatttctttgtccagggctttcttctttcctcatttctcttttccaagttacagatcaacagtttatgtacagtttattacatttctataaactaaagtttaactccatgagagataaattattcaaaattaaatctaaacaggttcatttattgaagtcatcaagcagattgtatacatcttcttttaactgtgtacgtatagtaattgtaatgttacctcagaattctgtgatgctctgtggtttataaaacatgttcctatacatatctcatttgaactccacaaccaaacagtgaaatagggatatataatcctcatattcccattttagagatgagaaagtccagaaaagctacatgacttgcctacaacacactgatagtaagtagtagggaccaaataagagctcacatgttccatgacaggtaaatatggtttacactatcccaccacacttgagttttcattgctaactgctgtacttcaggatttaataatcaaacttcatctctccttttcatatttcacacttgagagttaaaacagattttgctcaagattattttttaaaatttttgaatgaatcgtttttcagaaaacagtttgctcatgttcaaacattttaaggcaaatatgacggatactgtggcactcttactaaattttcttcatcttaaatatcacatgtttaatttaaactgtgggaggggaggtacattaattttaccagggcaacagatgagcctcaaacaccagcattcttcacttgaagtgagaaattgagttccaagagtaaataaaaacaagattgaaggtttaaatcctctgctaggctttttgaacttatatactcattaaatgtttattggagtggtgggattacaaaggatttggggagcttcatcaactggtatatagttaatcactaagtaaaacactacatttgataaagtgtttctcacgatgccacattcaatccatcttaatgaaaactgcttcaaactgatttcatttgagagcacttggtggtgagagtactcatcgttctttttgccttttttcttgaggaatttacagtactgtacgaagcagagcttccaactttggtaaagtagttattctaagttttcatgtttcttttaagtatatcgtgacaaagtattgacttctgataatgtactgatcagttttatgacttccttccttgcccttaactatgaaggacactcatccagttgagggctataaatgtttatcacatgctctctaaggatctgggaaatagaggtttcctgcttttgctcagtctaatgaggtaaataaaacaatataaacaatccatatagtataatataccatagaagcaaagagaagaggtaccttcaactaccttagaagttcaggggaaagatttcttttctcttctcttctcttttcttttcttttccagatggagtctcactctgtcacccagtttggagtgcagtggcgccatctcggctcactgcaaactccgcctcctgagttcaagcgattctcctgcctcagcctcctgagtagctgggactacaggtgcgtgccaccacgccctgctaatttttgtgtttttagtacagacggggtttcaccatgttggccagactggtcttgaactcctgacctcaggtgatccacccgcctcagcctcccagagtgctgggattacaggcatgagctaccgcgcccagcctagggggaagatttctagaggacgtacctctgacctgaatcttaaatgatgagaaaaacttaggcaaataacagaattctaaacagaaggaagaacaaaagtaaaggcaatggaagattaaagtgaggaaacgacaaccagtttggtattactggagcaaaaaaatgcaggacggagttgcattgctaggcatgatgctgataaaatcagtgggggccaaggcatgaaggggcctgtgatgccctggcattagctgacatttaaaatctgtttttaggctgggcatggtgacttacacctgtaatcccaacacttcgaggggccaaggtgggaggatcgtttgatcccaagagttttagaccagactgggcaacatggtgagatccccatctctacaaaaaaaaaaaaaagaaaaacgaacaaacaaaaacagttagtcaggtgcggtggcatgtgcttatggtcccagttactcaagaggctgaatcaggagcatcacttgagcccagaaggtctagcctgcagtgagccatgtttgtgccactgcactccagcctgggcaagagaacaagatcatatcttggtgcaggggtggtggcggggggggggcggtgcggagatgagtcttttttttccttggggcctccccacctctcatgcctactgtccctgaattctcttcttctacaccaccaaaagtaccctggagaatcattagacatttatagtaactaaaaatcaacaggaataaaaatctcaatggcagggcttatctcccatgtgaaggattgttcctttcccaagcatccctttgggagtctgagctttgatattagtaatttcattacagctccaaagatctgacttcacaccagtgctttttccaaatattatacataaattaagggactcagtactcaattgctgatttcccacttagtagctctgtggccctaaacaagtaatgagcctatgtctaatatggaaaaaacatgatgatgatagtatttactttatagaggttgttttgagacttaagtgggatgctacccataaatgcacccagcactgtggataagacagatggtgccattaagcagttttggacaaatttgagaaatgtttgtaaaataacaaaactgattttctcattcaattatgaactagttctaggaacagtttcagaaaggaattttgagaaccccatgaacatttctaccacaaaaattagtagttcacgtttaacagtgctcttagttatcaaattttattatatttattttttaaatcagcccattttaaagtcatgctatttctactgcttcgtgttgaaagaaatctaaatgccatcattgctcattgtcttttaagaaaaataagttctatacaaatttgaggccacagctgtagttggtaagtttctagctcaccacacaatatccagaaaaccaggcaaacaaacttctttgtgctttggaaaatatgcccagtctgcttatcttgtctgtgttattttttccatttaaattccttaaagtcaggacaatgtcttttatagtaattttgtatgacagctgggacagcatcctgcacatgtgtgaaataagacttagaatgctaattttttttttagaaaaatatatttgaattatacaaataatgtatttgctgtaagagaatgaaaatacagatgcattttaagtagaaaatgacaccacataattccaaacctgaaaataaccactatttattaaatgcttttactttctaaatgtgatttttaaaaaaatctataaacatgtatatcagtcaaaaagctgatatagtttatataaatacaaccataccaaacctgctgttctgtaattagatatttctactaaatagtatatttgttagtaccacttagaatttgcctttaattctccaattatcagatctgcctaattaaaattgcaaaaatctttagtgcccatattaaaattatttcttaaattagttcaaaacttactagtttagacatacactgccatttggctgggcgcagtggctcacgcctgtaatcccagcactttgggaggccgaggcgggtggatcacgaggtcaagagatcaagatcatcctggctaacacggtgaaaccccgtctctattaaaaatacaaaaaattagccgggcgtggtggcgggtgcctgtagtcccagctacttgggaggctgaggcaggagaatggcgtgaacccaggaggcggagcttgcagtgagccgagatcatgccactgcactccagcctgggtgacagagcgagaccctgtctcaaaaaaaaaaaaaaaaaaaaaaaaaaaagagttaatacaactctatatgcttaaacacagcttgtttttatgatatataatattctacttagaaacctgtttgtcagacaatatttgatggtattaaaaagctactgaacatgtatacccataaatcattgtaattcttatgattttcagtaagaatgcattattaatatatttttaatgaaaaattattaatttatcttcaagtctttactgctatactctgtcaccttttggaatgtggaagtagatataagtaggctatgggttcttgttctcttcctcagtgtcctaaaagtgggggcgaggagtacacttgacattcgcactccttttgtcatgcttgtttaacaggcctattgctgactaggagtagtgttatccctccccatagagaatagtaaagggttagaaaaatccttcctgcacttttaagagactactgtaccaaagtccttagtactgtgtctaaatgtttacctggaaaaccaatgagagttggcctgacactgcctacttccttgcctacccagtccctcttccagcctccccaaagagcatgcctgcttctctgtaacttgctgtaagagccaatcgtttcagcttctcatgtccttattcataaaaacttttgccacatggtggccttcctcaaatatattgtattacctgagtattacagtctaagcaatgaaaactgataaagatctatacccaatgaacatctgtcagcttattttgagagtttgattttactttaggcttttctttttttagacagagtctcgccccgttgcccaggatggagtgtagtggcacaatttcagctcactacaacctctgcctcccagtttcaagcaattctacctcagcctcccaagtagctgggattacaggcgcaccccaccacacccagccaattttttgtatttttagtagagatggggtttcgccctgttggccaggctggtcttgaactcctgacctcaggtgatccaactgcctcggcctcccaaagtggtgaaattacaggcgtgaaccactgcacctagggaaggctttgttttgttttttttttttttgtttttaaccctctgacttccatatgacagtgctccctatgcaagattcagatatctgtgtcctcaagatttcagaatgctatcccaacatctgctcagaaagtgaggggaaaaagacaccatcctggcatctcctcatcttcagtagctgactttttctttttggaacctctccaatttggttgatgcttgttggtctctgaaatcacattcaggagctaaacagggctaagttttgtgattcttttcacaatacaacctgcactctggtgttttactctttaaagataactagcttggagttctttgaacatatggggccattgacattgctgggcctttcccaaacttttcctttgttttttatcttttttactcttctttttctcactctcacgtatatttaaaattccgcttcaggccaggcacagtggcttacgcctgtaatctcagcactttgggaggccaaagcaggcagatcacctgaggtcaggagttcaagaccagcctggccaacatggtgaaaccccatctctactaaaaacacaaaaattagccgggcatggtggcagctgcctgcaatctcagctactcaggaggctgaggcaggagaatcacttgaacccaggaggcggagtttgcagtgagctgagatggtgccatcagcctgggcaacagagcaacactctgtctcaaaaaaaaaaaaaagaaaagaaaaattcagcttcagtcacagagaagtcactctctcctgcttttactgtggtttgtttgtttctacttatagcattgatgtcctacttttaaaattcagctcaagtatcaccttcgcaggccaggtgtgtaatcccagcattttgggaggccaggtcaggaggatcacttgagcccaggagttcaagaccagcttgggcaacatagtgagaccccatctctattaaaaacaatttttttttaaagtatcatcttcataaagaagcagccaatctgatgttcatgcctagaacccaggacttcctctattactactcattactactgatttgccagccttacttcctcactactcccatctagaaaagagttttaacagacttctgaccttcagaactgtatgccacccaagcacaaaagtgtagtgactttcccaaggtcacatagcagggcaatggcaaagcaggaatttgaatccagatagtgtggcttcctactctcctgcttgtgttctcacattgcacttatcttgagtcatgattgtatgctatgtggtacctatgaacatccatatacaagaatagcattgtagaagttggcaagtactggaatgatccaaattagatgctggatttaaaacaataaataaaacagctacaaaggacatgtgggagtacttgggggaaatttgaatatggactgtttattagatgatattgtaacaatattaaatgtcttaggtgtgatataaatatgatgattatgtaagggaatgtattattctcaagacatttctttagggtagaagtgtcatagtgtctgcaaacattcagatgtttcagggaagtattaaaagaatgataaagcaaatatggcaaaatgctaatgattggtaaatctaggtgaagaataaataggtgtttattgtatcattgtatccattgtttgtatcaatgagccatctccaaacttaaaaagtgatagtgataatgattctgattactgatgataatgatgagggaaaaggagaacagaaatgggaaggagagaaagcaagtcaggtccaatttacacaaggaaattattttatactatagttttaacactgaaaaaaactatgaactacattgtaccattcccagaaattgtcatatcaactttaaaagcattgaacatgcagattatggatattctggtactcaaaatacaaccctttctttttagttcatcagcaaatatttccttagtatctgctctctgcctggcttattttgagacacagcacatttcttccagctctaatattctatggttctgtgacactaagagtctaaatacaatagctactgtagctcaaggccaagtcacattggttgctgtcagctgggcatttcttaagcatcaacttagtaccttagctcctggatttgaatgtgaagattagtgaggcaccgaactcagagacacaataagcatcccagacactattgccagtaggaaaaatgaaggagctgcttaatctttaatacattttcatggccattatttctcttgaaattgctttcaaaaccctttattttgcatggatagttcaggaatcttcatcctaacagctacctttcattcagcacctactatgggccaggccttgtaaataggtacttaacctacattatctgcgatgcttacaacaacccatttgccccatggtcacacagctgctaaatggcagaactggatttagaacagagctctctgttactttaaagcttggagacttccttttgcactgtgttactaaaacttagattacagagagggaatcaggagaatgtagcttggttgtttgcctttgtggtctgccagacttagaccctctctgccaaattagaaaggacaaataaaatatattctttttaatgccccaatattatcatttgttagatggtatacaattaaacgtttgcctccgcacattctttcccacaactttttgagggtaaggaaactgtttcattcatctttatagtctcaatcgctaatacataggtactcttcaaatgttattgaactaaattattaaatgggccaaaggaaaaactggttatagtaatagaaatcaaaacattttcttactcgttttctgtggtactgctttcttcacgaaagcagttttctgattagtttgccatttcaactcttccaaattggttgatatgcttaatccagttctcactcttttggcctgtgcttaattgagctcagtaagataatcagaaatctgagtctggagtccatttatctgtgactgtaatttaatcagatttatatagcctaaatttactagcacttccatactattgagtctttatattttgcttatttattgttataaaagcagcagaaaattttttgttgaaagcttatgtcagagaaaagattattttaaaattattagttttccttttgaaagctactttggggtacccacagcctgaagattctcttgtgatactctttttatcatctcctttctcacattcagtctaaagcttaaagtgggaattttttttttaagtgtgttttcctggcatctcatgtttaacagtgtcaggggtttgtgtccctggaacgaaaactgtttctccagagtcttttttctctcagcttccagtgaaaagaggggcgaggcgagccagtcgcttaccacaaagcagtgccaccacaaaggaaagattaagggtttagagagaggtcaatgtgggtttttctctaactaaacactttcctaaagtttccttgtggaaaaataatgaagtcatctcagagtttttaaagaatttttatttctttttcaccgtctgcattcgcttgtcttctcagcatggatgtttaatcttcctaggctttgtgaattggcccaaatgaataagtggtgagctgtctctctaggagctagaggcttattctaagggcctaatcactgagtaaacacatctttgccctccctctcacaactgcgatataatagtcgagattctagcacagtaacctggatattgcagggaccaatgctttgaaatgcagaatggttgatcctccaaaacagacagtgcctgatcttcgcctgtctctttcttcttttttaaattaaatattgccaaagagatgccgttttattgcttgatattgtgcattagtgccctggatttccaagtttagtttcagtcaacactgtcggctgcacttatagagaactctgcatgttgggtttcttagtagcctcttcggcacatgtgtgtttggtttggaagagcatttaaattaaatcagtgagatagcaatgtaaatcactaatctctttcccaaagtctaaatgttccattgcagtgttcttgagagaaataggcattttaaagatttagccattgccattgtttagttagaaatatgctgatttaaaagtggacagctctctttttcccactgtctcattaaatgtagttgctgagatacgatcaagctgaattaggggttgacatccctctgtctgttcagttagagagctcctaagaagaagagttctgaatttgttaatggtgccaggttcacattactttccctaaagcatcagaattcttgattcatttactaaaactgattttacattgccattgctattgggtatcttttttgccaaggggctgtggcttgtatcagtgttcttgtttctttcatcaaacaggctgggacccaggctagtttaaagatgcaaagaagactgaaagagacctcattctctcttttgagaaatttagtctagaggggaaactggtaaacagttataatactaatggaaggagatagaggcccaggaaaggaagctcttaactctgcctgagggaatcacggaaggtttcatagaggcatttgttttgagccttataggatgagtaggaatttactagataagtatctctctaacaatgtatctgattacaaacttcctagaaggctgatactgttctctgcagacatcaacatagatgaagaaaccccgagtctttcttgttcaccattttattgccactgcttcctgctgagcctgacacaaagagcatttcaacaaatgcttgttgaatgaatgaataaatgaattaacacatagaagcagggtgggatcagctgagctacttatacccaggagtcctgcccttattcccattacaagctgtctctgagtctcagcccaaagcagtctggcatcttcatgttatatgagtgcttccataagccttgactacagtgtggttgatttccctgctaccactgtagtatcagagaaaaaacacttacttggacttggagttagacaatctgagagccaatcctcgttgtattagttactaactatctgtgacatttgggacaagtccgctttctaaacctcagtttcctcatatgctaatggggttaaggatgctattttaaagatttattctggaaattaaagtagataatggttgtgaaagtaacagtgtctcctattcatagtagatgcttttagaatcttaatctacctaactgtggctaccctcatctattacgaaatttacctttgaagaaaacaattttaatgatgattactattactattatttggattctttatctagataattcctaacatcagatttcattagcctttcatcagcatgagccttatatttttctgtaagtttccttcttttgttcagaatcccacacagcaaattttcatttgctgtcatcacattcttatttaacttgaagggaaagatactaagcttccttgaaattttcctttgacagaatttcaaagattggtttgtatgttgtctttaccataaaatttcatctttcctttccctggtaattgtgagtattgttaaactcagctcttctttgaggtagtaccaagaagttagtcaacaatttaagctctttaatcattatagtcattgttggtaaagctaacatgttgcaaaccatcaatggctacttatagccattgtttttattatacctattaccttgttcagtttcagtttttagttttaattattgcattgagtatccaactatgacagaagacacatttaagagaccaagtgtcatttattgaaagcaacttttattatggcaaaagggaaagaataattttctatatgaagagccacagtggacattttctgaaatataaactagaaagaatgcatgtgaactgaatatttttctatctcttcaaatgtcaattacatgtcacatgctgataaataagggcttaatatgagaatacattaaggactttaaaattatctatagaacaaaaagaaaacttgatttcagaccttttcctttcaaatggaagagactatccattgttcagattaaaaccataaaaaatatgtaagaggaattttgtcattctgttttaaagaatattttttctctgtattgttgaacagttcaaagttaatatttctctttacatatatctattaaatgaaaagaatagtaaatccatttcctttaagcaaaatacaattcctttgcaacttcatttgagataggcttgcacatgtcaacagaaatctgcaatagcagtctgcagaattagatataatcatcccagcctttttaaagtgtaagaaagtaaaattttttgatattttagatgctttaggaactccaaaatgtaaagtactctcttagggaatagcatttaatttttgtctttgctgttcatatagactaattatgcctctctaaaatttaagaaatcttacattagtggatattttaattgatcagatttttctcctcttttcagagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaaggtaatactgttgttcacaagttacaagttgggcttctattaaaaaaaaaatcattgtgtttatcatcatcataaacatttttcatcctcagcattaaactctctaccattgcatttcattagacaaaagctgctcgttgcagctaacacatgcagttatttgcaattgtgaaaatgtaccttaacttataaaaactttttaaattcaagaataacctgaaaacaaaaatacatttctcatcttatatttgcagtgcaacagacatttctaatatgtttttgaacttttagagaaacctgatgtttttaatgatgttcagaaaaggcaaaacaagtctaatatataatcctagtagtaagtttattttttaataacttcagtgaagaaggcaggactttctgcacaagtccagtggagttggtaatagcttaactctagcatatgctaattgatgtaatcgctttattgcacacattcttttgcacacagccaacaatacatccatattctcaatagggaaaaaaaaattcctttcctagttgtcaggatgagtttacttagtttgttaatcatagtatcttcaagtgattaacacttcttcatattttgcctatttcagtttcccatctgaaatatatttcatcatgtttaattacacatgtggccgtaacatcccatgatgctactttgggtgtgttaacacaatcataatcacaggctgctggttcatgaacagggagattaaattaattcatttcaaggcaagcatattttagtcacctaatttaaacgattatagaacaattagaaaccatctgatttgtctttttgttattttatggctcactgaatttttggtcatcattcagactttgttttatttaatctgaatcagaaaagaacatgattctttccttaaatgtgaggcaaaataatgttgaagctatttcataatctaatacttcatttctttaagcaaatggttaggaaatttcatgagatgacttcgttttgccttggaaatattccctgttatacataaataaagaatctttagcacctgtatttgtttaaattaaatcaggttattattcacactcagttaaaggtgatgaaaagcagtgccaaaaacagataaaaatgccacatcgaaggtctttcatgaggcaaaatacagagactggagacttggctaaatcttttgccattcactggcagtaaggaatctcctcctttccttttatccacaacttgatggagaaggaaacactatttctaaaccatctgtagtggctaagttcagtgggctacctgctgttattttgttctatcctccatttaattccttagttccttttattttacaatgacaaaaaattgcagtgtagtttcttttgaaaaacagtgtttgagggtttcttttttttatgatggcaatcaacagccatgtaattgctttgttatgttttactaaagaagtctgttaagtagcacaactttgatacactagtaataagagtttgcaggttacagagacacctgtggtgaccaaagcgacagaagctgcttattagaaagagccagtacagctgtgtcctattaactccttatgacacttttttaaaaacactaaataaaggtgttgtttaaggctttagagctatttctcaatgaactgcaggactgactattaagtatgataggatatttcaatctacattttgaattaagcaactgtcatgaaaatttgtaaaaggtaatattaaagactgaaaataggaacatctaggaattcaatttaataaacatttataggaaccacaaatggggcaataggggaatggaattatttctataatttaagatacttggcatccttattcaaaatctattaatagttctgtccatattacaaatttaaaaggtgttatatttctctatattaaagtaacaaaagataattactgggtactgagtttaatacctggttgatgaaacaatctgtaaaacaaacacccatgacaccaatttacctatgtaacaaaccttcacatgtaccctccaaacataaaagtttttttaaaatgtcaaaaaattaaaaagcaagtaataaaaaaaaaacaaataaaattacatagctacttttgatccatcattactactgttaaggcaaatgggaaaatacacattttataaacacaaggtgaaaattcattagaatgacatattcccaaaaaggggattgactttgacatatgaaactgtaagataattaattaggctggtttattgcttaaaaaaagggtttaacttaaccacaattttcttgccacctatcatatcacagattcatctaaataaaattgtctaattgggtttcctactgtattatctttcttggatttttacaccacatttatccagaggtgtttatcatgaaaactgattgcatcactcattagatgcttttaactttgagtaacaaaacctcaagctttcactctcaattcagtagacgactgcttgcactaatatttattgatccatggggtacatgtcaaaaggtgttatgacatcatttgcatatgattagcaagctgaaatggggacatattaatatatggaaatacagaagagatttctaggcatcacaagtaagattgttgttttgggcttccttttaactgttatttctttatgatagatgtaagtttggaaataaattcctggttaatagcttgcctcgtcccatatctggttaacctagttcagacaggccataaaaatttagagagtcctggacctgtaagccatttggatgtttttgtagtggtttcctaggactaccatctgatattatagctgaggatgttgatatccaatatgggaagagacttgccaagcagatatacttttgcttaaggattactctgactaagcctatagaggcattagttcttcaatcacagtatactgtggatctctcatgtatgtaggagataagtgaaggatattaaactaagtgaatgctttgatgaagtcaccagaatatgagtatcacttgctattataaattaaatttcctaatttctctaacaaattggaataagaaaagaaacatttctatagaatgtcataacccctgtgatgttgatgatttggatttttacacctcttaaatgattctaataaccttctttcttagtggaatacttagattttccagcccactgtgtacaaaatatgttggaataattcttaggttgatcttagaacattccaaatatgaactgagacatgaaactttagctgtaatgattaatgtctgtcatctcccctgctaaattgtgatctcctgaagagcttattcattttgttggtttcagtaaacaaggcacttttttaaattctaggaaaaagaaacccagaaagcatttagcaaatgaatgtatgcatttatttccatccaagaatgttgcttataatttcaatattgcatatctaaattggaggttttttccttggaaaatattgtacagtcttttgggccaccttatctagttggatttcagagccattcttaaaacagtgacaggaagcccttggtagtcttgagaagtgctaaaggtataatttctttttttttttttaagagacaaggtctcgttatgttgccctggctggagtgtgtaatcatagtgcactgcagcctgaaactcctggcctcaagcaatcatcctgtctcagccttctgagtagctgggactacaggtgtgtgacaccatgccccgttctaatttcttaaatattggtttgaccagtagttctgatggaaatagtaggatgtacctgtaaaagaaagagctaaaaacagataggtaatagtaaacaagaagatcttgcaaatcacttcatagttatgcaggattggttccaggacctcctgcagataccaaaatccacagatactcaagtccctgatagaaaatggcatagtatttacatataacccatgcacatcctcccatctactttgagtcgtctctagattacttataatacctaatacaatgtaagtgctatgtaaatagttgttatactgtattgtttaggtaaaatgacaaggaaaaagtgtacatgttcagtatagacacaatttttttctgaatatttttgatacttggctagttgaatcaacagatgcagaacccacagatgcagaacccacagatgcagaagaccaactgtgtttcttatgtttgttcattgagtaaacactgaatatttaatatgaaccaggaatggtgctgtcatctgagaatgaaaggtggaacaagacacaatcctaaccctcaaaacacatatagtctagtaggcaaaacagacataagagctaatatataatatgaggtatgtacaaggtactttaggagtatagatgaactttatacagagttgctgtacccaagggggtcaaagagggacttgaaagagatgatacacataaagatgaagttagaactttactctttctatttagagatttttatattaccatagtagcattcctagtcttttgggtggcagattttgctcttctttactaaagggcattggtgtttaaagcctcataattacgtatggggaacaaagggtcagtggttgaaataattgaggagagaaggaatagagggagctggctagctaatataatcctctataatctgaaccagattgagaattaaagtcaaccagccaacatggacaaatccaaagaagatgttttgttaatgattcatccagcattggcatatgtctacaggcagacagtgaagcagggataagatattcttttggatatgtaacatgtagaaaaccatcatagatttaactaataaaaatattgttagtacaatgtattcttaatgaatgagtgcttagctatgaaagaataatttcttaaaattcaggacaggtatcacttctgggaagtcttgcctctccccatccttctcttgcctcagtcagggttaaaatgcatattctgtatgctcccataatatatctgtactaacttgtactaatagcactcattacattgtatggtcattgtctatctccctgctaggttgtcagctccctgagggagctatgtctgtaatcccattggtttacacaacttccttccttccttccttccttccttccttccttccttccttccttccgtccatccgtccatccgtctgtcctagatggcgtctcgctctgtcacccaggctggagtgcggtggcgcaatccagctcactgcaacctccacctcccaggttcaagtgattcttctgcctcagcctcccgagtagctggaactacaggtgtgtgccaccacgcctggctaatttttgtatttttggtagagatggggtttcaccatattggccaggctggtctaaaactcctgacctcatgatccacctgcctcagcctcccaaagtgctgggattacaggcatgagcccctgcgcccggccacaactaccttttaaagagtaagtactatattgataataaatcatctctaataggcttattgaaaaatagcaagagagtaccagtttgagtaatggcaagaatattggaaatacagctacattcctctaattgtgtgatcttcccctgtagccactaatggtactaatatatggtactaaagccttcattctccttacagaatgaactaaaaatgttcagactggatacttgatcttctgctggcattgtagggtcccagaatgtcatggtgtacgctcatatgcctcaggtgctcccaggccatctggaaagtggcttgaattccaacccagatgagttcatcctggttctagagtttcttccccagacttcaccaaacctctgtgataccccagaagtaattggcctcccaaattgggccattctgggatggtactgaaccttctacaatggtgggagaactgattcaacatgtcccaggcccggagtgctagagtggctacacggtggaagagaccaagcattcaggcatgttctattagaacaccatcagaattaaccataaatagtactatgtaaagcaccagcatagtaagtattaatctgtttccctctataaaggctgtgccctccaggctgagctgtggattcttagctgaagttgcttcatcaaggaaagctacatcacatatgtgacacaatgaaccaccagtattaaccagtaataagtgggttagtgggtatctcttgttctgaataggagggtccacaaagcaaatataggtgctggtttagattatctaattctagaacacttagaatcaaacattgaatttgactggaatagtgccaactgggtaatcagctggctatgagtgctggaaaatgaattgcttatgtaagtacctgagatgaaaatgttttgcacatcagtgtacatgctactaagtgttaaatcaggcattgcacactatttctaagcagtgttcatagtagctgtaaacagttccccaggagttgccaatagtgcttgggttacacaggttgcttgtaacatacacatagcattgtattaaattttgtacacacatttaataccaatattcacagacagaattctgtgcctgtcagtattagcttttgaacttaatgcccttgggtgtggtatttcaggtcactgcaaacttccgctgctgtgctgacaggtacttgttaggcttaatattcaagtgatagttttccacattacttaatctttggcaagagttaattgacttaaagcacttattatcagtaagctgtcttcacatgtactttccatctcagtaattagccatattcacagtggcttacccttaattccaaactactcagtggttcatgcctggctgaagccttgctgaccatgttactctaaccctacacttccatttgatctggcaaatatagctcaggtgtggagtctgcatgggagacacaggagtattaatttccagctgctaccctaggtacaaatatggattctgcagaggtagctgataaaacagatgaacatgttgtggtcagggtactaagacttcaggagagccttcgtgccagatttccatataattttctccaaacttctttattccctttatgcaacattttccttccagtacttttaaaggaagtgtattgccatcctaaacatcccaggtcaagggcttaattaatgctttaaaatgaaggttccaaaacaccaggagagtttgtcattttctccctggtttgttttgtgaagagggaggagagaaggtgaggaggaacccctcctgttccatgattacatcctacccactcattttctccttttctcttctgcttttgatttttagtggcggtcttaacagaatgtcaagatcaatttgcagcatggtttaactcaaggtttgcgttctgccagcagcaattgtccctgcaaacaatgccgtgtgttcttgtaacttcagaagcttttagagggatcatggcaagggcagcatctaatgactttattagtgtagggtttcaaaatgggctcagtaattgttcatatctctttgtcagcaagtcataattactgctcagcattgtccaagggtacacttgtgaatagtttcctaatagtactgaaaggaaaaaaggaaagggagaatggataaaagtgatggcctcttacaattgagaataagtcagtctctatatagttgatggctaaactgtttatagtacattcaacattcttaaaacagattatccttttttttttttttgagacggagtctcgctctgttgcctaggctggagtgcattggtgtgatcttggctcactgcaaactccacctcctgggttcaagcaattctcctgtcttagcctcccaagtagctggggctacaggcgcttgccaccatgcctggctaatttttgtatttttagtagagatggggtttcaccttgtaggtcgggctgatctcgaacccctgacctcaggtgatccacctgcattggcctctcaaagtgctgggattacaggcatgagcctcctcgtccggccaaaatagattatccttttaaaaatgttctttgagataatttaaaattaccaatttacgagccttttttactctgatttggatacttcctacactcctacctagtactacagttataactgcctggttgcacatgcatcgtatttgaatcaaagcatttgtttttaaaaaagagctcattttcctctgcactaatctaattaatgctattcaggaaatatgcatttaactcagatacagttgtcaataaatagcctatgaaaactgttgttagaagctaagatacaaaggtgatattattggcaagccattccaaaagaataacattttaagtttctatcacattctatttttctcatgcactagatctttcttataagtctgttggtgttctccttggtcatctcccaattactctgtgttttgaatattttttgaatattctaggtatcttgattatgagagtcacagaattaaaagaatcatcactgtctcaagatgaagtttgaggttaattccaaacctttccctgtttgtgatctgttgctgaatccttccccattctgtaacccgtcccccgaccccaccagtgtactcatgtatagttatatgcaaatagttactcccaatagctggttatgcttgtattttagaacatacagtttttatattgatataaaacatgagtaatctaatgacacattccaaaaataagataaatatcttattctaaaaataagataaatatcttattctaaaaataagatatttaggctggatgcggcggctcacacctgtaaccccagtgctttgggagtctgaggcaggtggatcacttaaggcaaggagttcaagaccagcctggccaacatagtgaaaccctgtctgtactaaaaatacaaaaactagcctggcatggtggcacatgcctgtagtcccagctacttgggaggctgcttgagcccaggagccagaggttgcagtgagccgagattgcaccactgcactccagcctgggcaacagagcaagaccctgtatctaaataaataaataaataaataagatatttataaagtgaaatatcttaaatatatatatgccatcgtgtattttgcttttcttcttgcctgaaattaaaaaggtctgaaaagatttgtttccttaactgctctcattaataatttttatattgatgatatttcggcagaccttttactaaataatatcacctatgccattgaaattggtagcacatttctcctcttctataaacactgatagtaaaacagtcagagaaattataaaagaaacatgttagttcagtgatataagtaatttggttcctctgacatattttacagtgtttgcttgtcagtctgcatagatgctaaaagatattttaaagcccaacaatcttaatgttctaatctgccaaatataccaccaaaaaaagcaaagtttctgttagtctggaattggagagtaaggtggaatcctgtttctgatgtgttcaggtaattattaaagaatagattgggtgtcctttccttaagcatatgtttgtgtctctctacttaatagcattagggtaatagaggagtgacagatagttttgtattattcaaaacagagttaactctaaagactttttaaaagctgtttgacagtttatctactgttggctaactcagtctgtagctacagcaacaatttaagaatcctaaatagattgctttcatgtgcttttcttcccctcaatacatgatcagcaccaagaaagtccttttcagcaaatagttttctacacacctcagctaaggaaggaatgaggcaaggttatgtgaaaaattaaaaagccttgattgccatacctcaaatctgagaaattacatagcctagtcccagtaataaatgagctactggattctctgagcagctctcaaataatttactgtctcagcaacaaattttattatgtggctattaggaaagctatgtattaacttgttagttcttgaagcagacttgtacacattaaaatgtgtcagttgctgttcttaaagaaaactgattttctattttattttatttattttattttattttattttatattattttattttatgtttgagacaggggtcttgctctggtgcccaggctggaatgcagtggcacagtttcaacttactgcagcctcaacctgctaggctcaagcagtcctcccacctcagcctcccaagtagctgggactacaggtgcacaccactacatccagctaatttttgtatctttttgtagacacggggtctcaccatgttgccaaggctggtctcaaattcctgagctcatgcaatctgtccacctcagcctcccaaagtgctgggattacaggcataagccactctgcctggccaattttctttttaaatttcaatagatttaggggtacaagtggtttttagttacatggatgaactgtatagtggtgaaatctgagtttttagcatacccgtctttcaagtagtgtacattgtacccaataggtaatttttcattccttacctccttcctattttcccccttctgagtcttcagtgtcccttatacctctctataggcccctgcataaccatagttagcttccacttctaagtgagaacatgatgacctccagtttcatccaggttgttgcagaagaccttattcttttttttttttttttttttttggagatggagtctcgctctttcgcccaggctggagtgcagtggcgcgatcttggctcactgcaagctccgcctcctgggttcacgccagtctcctgcctcagcctcccgagtagctgggactacaggcgcccgccaccaagcccagctaattttttgtgtatttttagtggagacggggtttcattgaagaccttattcttttttatagctgagttgtattctattatatatacacacaccatatatatacacaccatatatataatatatacacataccatatatatacaccatgtatatatacacacacctaattttatatatatatatgtatacgtaccacattttctttatccactcattggttaatgggtacttgaagttgattccctatctttgccattgtgaattgtgctgcaataaacatatgcatgcaggtatctttttgatataatgactttttttcctttgggtactcagtagtgggattgctgaatcaaatggtagatctacttttagttcttggaggaatctgaatactgtttttcatagaggttgtactaatttacattcccaccaacagtgtataagagttcctttttactgcatctgtgtcaacatctattagtttttgactttttaataatggctgttctgctgttcttactggtgtaaggtggtatctcgtggttttaatttgcatttccctgatgattagtgatattgagcattatttcatgtttgttggccatttgtacatcttcttttgaaaaatgtctgttcatgttgtttccccactttttaatgggattatttgtttttttctggctgatttgtttgagttccttgtagattcttgatagtaatcctttgtcggatgtattttctcccattcttttgctatgcagaagctttttagaagctttgggttttattttggggggtgtgtgtgtgtgtgtgtcagagtcctggggtgtgtgtgtgtgtgtgtcagggtcctggtgtgtgtgtatgtgtgtgtgtgtctcgctctgtcacctgggctggaatgcagtggcacgatcttgactcactgcagcctcgaccacctgggctcaagtgatcctctcacttcagcctcctgactgaagtagctgggactacaggctcatgccgccatgcccagctattattattttttttttgtagagacaggggtttcaccatgttgctcaggctggtctcctgggctcatagaaaccacaatttttcattacaactgttttctcattgtttgtgcagacagacagatgtcaatcatcatagaatgtagagcaattgagaagtaaggctcagtcaggctggaaatacgaaaaacaagatgatattagacaagtagtataacatttctagatctttctttttcatctatgaaaagagagtgactcacctatttgacctgagacctttgtctgtaatattctgacttggatacagttgttttcagtagaaaaatgtgaggtaagcaagggttcatttttaaaataaattttggtgaggtttgatatatcagattataacataagcatgctaccctttccagtttgtaataatctgatcagagtgattttagtggggtgtagtgaagaagacgacagtaattttcttcctctttcgttttgtaacaaggaatatctgttaaaagtatattagtagctaagagcaagactatagtacggctttttaagaagccaaactacatgatgacaactacaaccattaattaagtacctacttaattaattatagtgccagacactatataaatgtgctaatttaagactctctctctctctctctctctctctatatatatatatatatatatatatatttacctcatttaatcttttccacaattctgcagggtaaatagcaagatcccatttcacatgtgaggaaactatttgtggctcagagaggttctgtgaggtcattgcaatggctataccagctataaatcccaatgctacctgtgcttttctaccacataatgctttttttcccatgatcttgccatgctgaatgattcagcaacaaaaatgtactagataattatctagtgtgcaaagtcctgcaggaggtataagggaagtccatggaccttttgttcaaggaacaaataaacgtgaaattcacccagtcttagagttagggattagacgtgtccttagcagtacaacttgcagccacccaggcctttttttctataacatgcttagctgatgttgctccagcctgtgcttgaatattgccaagacagggaaatgaaagcttcaaaagatagcttttttttttagctgctctgaaaactggaaatgtctttactacaatgcttcttctatagagagcttcctcaactttatcctttttggttctggttttgcagttacctgatataagcctaacttctctatagcattataaccttttatcaatgtaactctagttctcatttttcctattttccctgcctcttcctaccaaatataattagttcttttcactgttcttcatatgatagtgtgtctagacccagccccttctaaaggtgccgggatcaagcatagtgctctagaggaggtttgtctggtgctgtgcacagttctatctgaaattttattgtgggcttctgttgaactcagggaatcatctaaaaccccattgttttccagcttgagttgatgctaaaccagatttctgccattctttactaatgcagttgattgacaagatcatttggggttcagattctgtctattgaccttcacaagttttatcacccacaaatgagtcttaagtccttatcatctctactcctgtcatcattcttgataatcctctcggttcctagacatgttctccagaaaatttttcttcttctctgtatttaccacatttagatggggtcactaatagaaactatattgcctcatatattttgatttcaaacatctggctctgatcaccacttcctaccactcctatttatttgttcaagtatcactggtcttaaagatttttttatctcctcatgccttccaatctattgacctttctctcaccccatctaccctttcctatatccagttttcatattcctcatcctgtttagattttgaggttcatcgttgtaatttccttgtgatactttaaactctctctgttacactcattttgttagacccgcctgttcaccttctgtatgcctgtacccttgcagttgaacacagctagagaaaatcacactgtcttttctcttctcttttttctctctctcttttaaataaacacaagcttcaaataagcacacaataatgctgggcaagcctactgggatttgggattctctagttagttttctttgcctaactgagatatctatttcatactactcttcattccccaaatatatcattcccctctctacctcccctcccagctgcccccactagttgcttgagaataaaagaagttatcagaaagacagaaatgagcccatttttctatcctgtctatatattccttcagaaaggtctgatgaacctttctagagaaggcttcaccatcattctttttcatagcactttcatagaactttccataataagccattacttttgcttactttaacatttattttctatttcttccaatgaatataagctttataaggataagagttatatcaatcttttccacttttgtttcctattaaaatgctaaataattatttgttgatgttataagaattcagagcatcatgatgattaagaatatgaatgagctttggatttattcagaccacgattggaattctagctatgccactaggccaccatagtgactgtggtgggtgagttgcttaaaccctctagctgaagtttttttttttttttttggaaacagagtctcactctgttgcccagtctggagtgcagtggcacaatctcagctcactgcaacctccacctcccgggttcaagctattctcctgcctcaacctcctgagtagctgggactacaaacgcacactaccatgcctggctagtttttttgtatttttagtagagacagggtttcatcatgttggccaggctggtctcggactcctgacctcaggtgatccgcccgccttggcaactcaaagtgctgggattatgagcatgagccaccgcacctggcctgcagttttcgtaccatgaaatggagataaaactacattcatcagagagttattagaactaaatgggatgattgattttaaagtctggtacagagtaagtgctcagtgcatttatctacatgtaagtattttatttgtctcagatatttatgaaaatgttaacaggacaaagccagctagtaaactatttgagactactctcaatttggtagcattctacagattgaatttcctgatgacaaatgaattgtctaccttagcctgtatttctgaatcttatctaaaggatcttttggaacaccttattatatgccttactgaaatccagatagtcaaaatttatggaatgctgatgcattcttagtctaggaaactcacagttagttttgggaatagtatgttcttaagggcctatgctgcctgccattcatcgctactgtattctaattgttcataaaccatctttctaagtgactttttaaagttttgtgggtattgtgagcaagtttactggtctgtacattttaaaatcatggtatttacatgtttttagggacacagattcctcatgatagttacttcattatcattaattttagctttttactgtctcattcattctaccatctattcatttctttatccaaaaaagtattcattaagctgtgtaccatatgtgtaccatatactgtgtactatataccattaaactgtgtaccatatactgtgcttgaattgggaaaacattcttgctcctcttattttccctctgtatatatgtctgggttttttttccatttagcatttacagtttgcctcctttaaaaaattgacataatagctatacgtaatctcataatctctgtacatacaatataaaataggaaaataaaaaataaaattggatgaaaaccaattaaaagtagcaaatagatatgaatatttataagcacctgagttgaagtttagctgtagaattccagcagataaaggagagaaaggacatgtcataggcatataatcatttattcatctgtccattccatatgtatctattgtatttctcttatatgccagatcacacacctgagagcatttacattttaccatttacagttctcattttctgacatatggaatcataatagttcttctcaagatttcctgacactgaagtcaagggagagttttgttgcatgattttatttgagagtccttaggaaaagtaatagacaataaacttctactgttgttttgcagaagacagattattttaaatagttttttaaaatataaatcccctgtaaaagcagagggctttgtatttaatctttttttcagtaatgataattctttagggagtttaggtgatgtggtccttaaatactcctttatgattacctaactcataacaggtataaagtttagaggaagagcctacacagtcaacctgtctattcagctctttgtgttaaacatcagctgtctgaattgagcttaataagtgctgggttacaatcagctcttgcttgaaagctttgatgagtgactaagatgccaatattctgttttcctggtcacttatctgttaaagactttcctcctgtgggtgagattgcaactgaagcactcccactttttttttttttttttttttttttaaagacggagtctcactctgtcgcccaggctggagtgcaggggcgcgatctcgattcactgcaagctctgcctcctgggttcacgccattctcctgcctcagcctcccaagtagctgggactacaggtgcctgccaccatgcccggctaatttttttgtatttttagtagagaggggtttcaccatgttagccaggatgggcttgatctcctgacctcgtggtctgcctgccttggcctcccaaagtgctgggattacaggcgtgagctacggtgcccagccatgcactcccacatttttatatccattagggtgatagttgttttcaaatacatgaggacattatgtgtaaatgtcaaagttccaagagaaaccaaccaaccctgaaataaatgatgctgaaacattttatataatgataaaaatcacaaagtgtccaaatttggctgtgcacagtggctcatgcctgtaatcccagttacttagaaggatcgattgagcccaggagtttgtgatcagcctgggcaatatagcaagtctgtgtctcttaatttttttgtttttgtttttgttttttgagatggagtctctctgtgtcacctaggctgaagtgcagtggtgggatctcagctcactgcaacccccacctccccggttcaagcaattctcctgtctcagcctcccgagtagctgggattacaggtgcccactaccacgcccagctactttttgtattttcagtagagacggggtttcaccttgttggccaggctggtcttgaactgacctcgtggtccgcccacctcagcctcccaaagtgctgggagtacagtcgtgagccaccatgcccagccttaaattttgtttttttaaaacttagctgggcatggtggtgcatgcctgtagtcccagctactcgggaggctgaggcagaaggatcgcttgagcccaggagttcaagccttccgtgagctatgatcatgccactgcactccagcctgggcaacagagtgagaccccacccctttaaaagaaatccaaaacaaaaaacaaagtctctaaatttggcagctagaaaatttagggaacatgacaacgttaaatatatagatagatttaaagtagagatacatatactttaaatctctgctctgagtaggacgttatcttacaatgatgttggtgcatattctagaagttatgcagcagtataatacagtggcaagcatggtgtaaagaataacttcctgtttagtgatctgagtctgagattggtgctataacttattttaggaaacatttcaccatacctttaatttggagagatgggggtggaaaaaccaattttgactctgaagcacacaaaaagaaagaaaaacaagtagaatttattaatccacagaccaattccaaaagtaggtattattatcttcattttatagatgagaaagctgaggcccttaagttatccaaagaaacagctaatttacaaaatcagatttgttcgactccatagtctttgttcttcccacaatactatgctgcttgcagcaattcctaatttctctaatatattaatatttggatattttataccttttctaagtcacattttcagtcagtgggtggtgacaggatgaaattatataaaaagtacagtttgctaaaaattagacagtaagtttagaatcataaacttgtggaccaacacctgcttattttgagggttcaagtggcctgtggaggtggaaacacagtgaaaagggccctgaagactgtaattattcacactgactgtctttgaattaaactgatttcaaaagtagttggaagagaaaaaggaagattgtatggtcaacattgtcatagtgaagataaaggttattgaagcatgaattggcccattcatgcaacaaatatagtaggtgctaggaatacagaggtgagtaagcaatggttcttctactagctgtcctaggagttgcaccttacaacatcaagttctccctgacttctaagcacccgttcctttctctgattttccccagcacttcatctgaaccactaaatgtaggccccagtaatatactagattacatttactgtttgggggccttgatttatcaaaggcaaaatattcttactatgctaaagacaaaaaccatgtcttatctcgtcatatatttggtgggccctcataaatatttattggttggtaaaaggcaaaaacacagaagaaatgttatatggcattaaacataaattggctctcttattcaggccctggaaagtgaatcttttctttgcattgctagagaaggaatttctgcatttgataagagattgaattagatgttctctattatccctcctaagagtctatgatcaacacttgagaaaaagtaaacaccatttttatgaagaaattttcaagtacttaaatgtttatgttcttacttagtggtaagaaaaagccaattattatttatgattattgttcctcaaaaaacttaggataaattgtctcctatagattagctatacccttgttattaaactttaagtgcctcaaagccttttgcatttgagttatttctagatggcaacaaggagaaagattaagaaattacattgcttttgccgggcgcggtggctcacgcctgtaatcccagcactttgggaggccgaggcaggtggatcacctgaggtcaggagttcgagaccagcctgaccaacatggagaaaccctgtctctactaaaaatacaaaattagcccagtgtggtggcacttgcctgtaatcccagctactcaggaggctgaggcaggagaatcacttaaacctggaaggtgggaggttgaggtgagcctagatcacgccgttgcactacagcctgggcaacaagagcaaaactccatctcaaaaaaaaaaaaattacgtggctttttaaaactctgactactaatctattgagataatttaacagtttactattactggaagcctcaggcagatgagatatgcttttttaggttaaattctcccaaaatctcatcctgtgttttcttaacattacctttggtttgttctccaacatgcttacaatatgtgcatttgcatcgtgaggcattatattgtctgtttagaaaaaaatttgaggtccgggtgtggtggctcatgcctgtaatcccagcagtttgggagggtgaggccagtggattgcttgagcccatgagttcaagaccagcctgagcaatgcagtgaaacccatctctacaaaaaaaaaaatacgaaaattatccaggcatggtggcgcttacctgtagtcccagctactccaatggctgaggtaggaggatcactggagcccgtgaggcggaggttgcagtgagccaatatcacaccactgcaaaaaagatagatttgaacagaagactcatataaaatagaaaaatatgtttaacactgttaaaggtttgggattacatgcagtttttcttcatgtaagggacttgctcttttaccagttttatgattggctaacacattcacattaatcaaaattcaaaggcataaaaaggtatgtaataaaaagtctccttcttaaacccatatctatgtgaccctccccagaggcaacattcttatttatccatccagaggttattttgtatataaacaaattaatggccgggcgcggtatctcatgcctgtgatctcagcactttgggaggctgaggcaggaggatcacaaggccaggagttcgagaccaacctgaccaacatggtgaaaccccatctctactaaaaatacaaaaattagccaggtgtggtggcgcgtgcctgtaatcccagctactcaggtagctgaggcaggagaatcgcttgaacccaggtggcaaaggttgcagtgagctgagattgcaccaccgcactccagcctagacgacagagtgagactctgtctcaaaaacaaacaaaaaaagaaaccaaattaatatgtatttatttttccccagttttacacaaatggtaaacacaatttaataccttccttttatcactaacattacttcataaagatattccatatcagttaataaagaaatctatttaatggctacatagtatctctttaaattccataatatactataattttatttaaccaagattgattgatttagacacagggtctcactctgttgcccaggctggagtgcagtgtcatgatcatggctcactgtaacttcaaattcctggcctcaagcgatccttctgccccagcctcccaagtagctgggactataggcatatgccaccttgccaactaatttttttattttttgtagaggcaggtctcactttgttatccaggttggtcttcaactcctgggcttaagcaatttcctccccccaccttggcctcccaaagtgctgggattactggtgtgagctactgcatccagtaattgatgggttacacccagtattctgctgttacaaacatccagtaattaactgtgtgtacataggtgatttccacatgaaaatatatctatagactaaatgcttgtttaagagtatgtgtgatttataatttttattggcaaattgcccatgaaggaattgtatcagtttcacttatactaacagtgtatagtagtgactttttcctggttttcctgtaaccttgccaaagccagttttttttctttactaatctgacaggtgaaaaatgttttttttttcttttttctttttttttaaaatatagctttaggtgggcatggtggctcacacctgtataatcccagcactttgggaggccaaggcaggtggatcacttgagatcaggagttcaagaccagcctggccaacatggtgcaaccccatctctactaaaaatacaaaaattagccaggcatggtggcacatacctataatctcagctacttgggaggctgaggcaggagaatcactcgggaggcggaggttgcagtaagccaagatggcatcactgcactccagcctgggtgacagagcaagactccatctcgaatatatatatatatgtagctataattaggagcaaattcaatatgtgtaattttgcatatctttttaacatgcttatgtgctattactatttccatttctagaaactttattttttgttgatcttttacttactagtttgtaagaattctatatataatgagtaaattagcctcttttttgtggtttggaattcagaaaatttccccgtttgttatttatcttttggcctagttatggtgtttttgtttttgtttttttctgtggtgtgtgtgtgtgttttaccatgtaagtttaataaaactcatcaatttttgtcttttatgcttcactctgctccaactatagtaacctccttgttacctttcaaatatgctagatactttccaacttcaatgtcttttatttcctgttctctacacctgaaattctcttccctgagataaatatttcatttcctccttcacctcttttgagtctttgatcaaatgtcagcgtttcattgagactttccctgaccactctattttatattacaacctccccttccctgctttgttttccctccatcacatggagctcacagacttttgagatatttattagtatttttttcagatcagattggagtttacccatacaaatgaagcaagtgggaattaatatttttaaagtggttgactcaggagactagacacttggtccagtgaagctatcattgcccaaaatatttttatgatgatttcttttaagaactgccttcagagacagattaaagtcttacaaagagagtcctgtgtccagaaagcaatgtgtctcaaagtgtggccattaatcacttgcatcaaaattacctggggtggggttggagacgtattaaaaaggctgtttcctgactcaaatctattgaatcaccttctctgtgggaatggggctgaggaacttgccttttaaataaattccctaggtgatttataggccactaaaggtttaggatcactgcctttaccttagtttcccctagcttagtcatatactctgttttcctaacttagtttagtttaaaccaaagatttaggattatgctatggtttgagcatccccaccgaaactcatatgggaaccttaattcttagtgtggaaatgttgggaggtgcaacctttaagaggtggagcctaatgggagatgcctgggtcatggacccaccatgtccttgactgttctcatggtagtgggttctccctcttgttctcattaagctagtttagcaatcccaggaatggatttcttcccaggagagcaagttgttataaagggaggatgccctttccacatggatccacttcccccttgacctttcgccatattatgattaaatataaatgtatttaaaagaaaatagtgattttagttttgtatccagttgtaaatgtttaaaattttgtggtattgtacaaatgcagcatctataatgtattgtcttattttctaaatattgatacctgcccattcattttctgaatggaaaaaaaaaaacagtgacagtgttggtttagtcaacaaatctttgctaatgtatcttcctgtgcaaaataaagtctcatagagctggcctgtagctataaactatcatttttaatcctaaaagaaatgatgataaaagtgttaaatattattatgcatttaataatagtaaaatagcgaccaattttaagggcctaccatattttaggcacaagtccaagtgttttctgtatcttaacttatttcatccttacaagaagacaagtgttttaaaggtaagtgttatttccactttatacctgaggctcttttaaactcatgggaatcacactgaaatatgtagtaatcaggaacccttaaatagagtagttgacagttttgtgccctctattttttatcaaatattcttccttttacagcacctggtatacggtaggtaggcagtgagcatttgtggaatttcatctcccttcccctaaattgctaggttccatttaatatatattttatgttagagtatagcttggtgaaagccagtgacttaggtaattatgacttaagttgaaagaaattaaacaatatcctgttttgaatttaaacaagattactttttgccatatctgatttattagtaatcctggtttccgttaacaagatagaaatatctatgcttcagcaatgaaaaattttacaagtgattaatacatgctaaccatcagatattctgtttatatttctctccaaactttagattaaaaccatttcatcttatcttaccagttttctaatagcaagaactggaaaatataaaagtatatctgacttatgattaactatttcatttcactcattgcctcaacccttccttcatccttctctcccttcttcccttgtatcattcccttagtgagggcatttattgtcttttcaaatttgtaattttagcatttggccttgggttgatttggcaactcgttagtcccctcctcaaatgttctatgatgggcaggctgttcaatttattcagaaattgtattatttaaaaacagagccatttccctttgttgtagagtggtttgcccttgcttccccactttgggtttgagattgcaggaatttacttatggaaaccatttatcactttatgacatctaactctgatgaatgccatgtgcagttgggttgacaactttggccctgccactggatgcactggtacacttttatctcttcaaaaggaagaaaataccacaattatgagaaccatgcattttatctttaaatgactggtttttccccatctattttccttctaatgttttgaactgaattttttgctgctggtagtgttataaatggtagccctgtgcataaatgatcttgggaggaagaagcagagtctcctagccatgagaaagatttgacatctgtactgtgaagtaccaccttcttgttaattataatggaatgaattgacaagtaggaatttttacaatttcatactgtccatcagccctacaggctcttgatgattgcaatttgaaaatctcaaacataattcatattttaggaagattgatcagattaattaaaattttaagtctctctttgattagaacaaattgttggttaaggctaccataaagtgtcagctggttgtgtgattcctgtgtatctcccaactacttccaaaaaattagagtgattttccaataactagcagaaaattgatcactttgttgttgtttttatataatttattgaatggctgtgtgctttgcgatctgcaccgcaaacatgctttgtatagtggtgaaagttttgttatatattattttatacccaataagatatctacattttcataattattttatcttcttgctcattttcacaaaaagaatatgggaagtacacaatttccaggcaaaattatgttgagatggaatccttaaaaccactgaacttgcctgcttttccctttttttttatttctcttctctctctctctttctttcctttatttctttgttctttctttttttggtaggtatcctgtttagctagtactagtacttaatagcacttatgggcagataatttgttatatctgcttaattaatccattggtgtgaaagcaacaaggacttactcccttttgtgggaaatgacattccaactatttttttgacatcttttatttttgaggttgccaatgatcaggccagagtcaagactgactcaaaatattttagaaaaaagcacaaaaagatcctaattttctaatctcacgatctatacatccctatcgatgagttaagctatatgggtgtgaaatttggcatagaaggttaggctgcttgagcaccttttatcccatcatagttgtggaatgtgagaatttgaattttgatggtggcactgatatgaaattgccatgaggtctggttattgctcttctgaatgtgtatttaaacctgccttccaatgaacttattgcaatggtgctaacttaacactcttgccaacagttctagtggcccttagcagcacctactttctatagtcatagcacagattttatggaggattcagtctaaatttctgagatgaatttctatagacagaaaatgtattggctttaaaaattaagaggtttgattctgttttgaatttggatatcaaatgaatgtgaacacatgacattttaatgccgtttgtcttttcaaatagatttaccttctaatgcatgtgatgacaggactttgctcatcagctagaacatacatttcagaggagttgttacctaaaatattatcataaggcataagaaaacacacgatttaagttgcctttcatgaacataattaagaattaataagccagtaccagtggctagtccccagaatttccactgttttgccttttgtgacctgtgttattaaaagtccattatttttacagactttattaaattggatcttattaaagcattctatatttgcatttggtctttcataattcattattattatgacatttactttttaccatcagatctgaaaacatatcataagctacccttttctcttgaaagaaatgctaatttcaaacagtcctctaatagaagagaaaagctttatcagttttttcatttattccagatcgtgttaagaatactaatgctagacttcagtatgctaatatctcagagctttttttggtcaaaagcttagaattattatttttatctcatgctaagtatgaaactagaagacctactactactggagaaaacataattgtaaagtacagttgttgattctgaagacttgtgaaaacgttgctaaattctgttttttaggatgatgctagtcaatttatctttgcacaacactatattattctatttaagaaattttatcctcttgaaattaatgtagtttgtttttctcatagtttaaaggtagtgttgtagtgtttaaggctaagaatcctgccgggtgcagtggctcacacctctaatcccagcactttgggaggccgaggcaggtggatcacaaggtcaggagttcaagaccatcctggccaagatggtcaaaccctgtctctactaaaaatacaaaaaaaattagccaggtgtggtggcgggagcttgtaatcacagctactcaggaggctgaggcagaaaattgcttgaacccgggaggcgggggtttcagtgagccgagatcacaacactgcactccagcctgggtgacagagagagactctgtctcaaaaaaaaagactaagaaaagaatcctatgctgtcagccccagacagcatttagggtatgcttcctgcttttctatatgataatcacttctgtattatgtcagatatgtttgaaaactcaatatagcaagattttacatattgatatcaggcaggctgtctaatttaacataactaataacacaatgagttctttgttgaagtactagtaaatctattaaactacaaagcaaaacttactttgtattttgtctccttttagatttctcactatgtgcaatagacactttggcagtgttgtggcacaaaccattcggactcaaaaaacggatcagtttccgcttttcctgattattatgggaaagcgatcatctaatgaagtgttgaatgtgatacaaggtaaagtacatgtcacaaggagagtaaagccttcctggtatgtgataactttatagtttttccacccaagctgacaatatttctattagtaaatatctttgcatttgaaaatatagaatatcctgaaaaatgtcttcaaaaaatataggtgctataaaaaataatatgctgcatgaaaatctaaaagaaacatcttaataaaattgcacaacccttggggcacaggatgttcaagttaaatgttcagaattgctaaattgtataatctatcaattaggacataatcagttgtcaagtgtgacatttctatttatattgatttattgttataatgttgattaattggaagaagtacttatctttagttatctagaaaatccagtcactgtatattgaagattgaatttttcacagtgacaattgtttcttcttatttgtatgattccatgtttagggtgcaaccctgaagcatgaagctgtgggatgcctgtgaatttaaccacagtgcacattctttaccaaaaaagaagtgaatgattttgttttgtttactgttagtaatgcactccaagggttggtgtaaaatattaccttgttcattacaaagcttaggttgaacagtatatcttctctatgccactggggaaaagattttcaagtgcctcaagctaaaactatatctggtatactaatttctgcctccatttaagtctgattgggaggaggggatatgtgtaaattgcagtgcctttaaaacccaaataaaaccagacctctagcattttatgttttctctataactagagcattcaatttcataaacagtgtttaaaaagacctccaggggaactgatttgcatagggtaaatggataatgaagataacacttcattcctgctttccctgtcagaggcaatgttgcaagaactagtgtttctcaaggtgtggtttgtagacatcagactagacccttttaggatatctgtaaggtcaaaattattttcctaactgtaataagacttttttttttttttttttgccttttttactgtgttgacatttgcactagtggctcaaaaggaatagtttataaaaactcttggcaccttagcacgaatcaaagccataacacaaaactgcaatagtagtcatattcttcattgccatgtatttagttaaaaaagaaaagaaaaagccttaagaatgtccttgatgaagcagtaaaaattattacttttattaaattttaacccttttaatagtttatgtggcacaatgggaggtatgggtaaagcacttctgctgcatactaaagtatactggtggtctggaagaaaagcactggtgtggttgcttacactgaaatacttgctttttatttcttatagaaattatttttacttgaaaatattactgacaggcaaactatgcttatgtagcctgggtagttgccaagatgttttctgtgattttttttttttaatatcctataatgaagtgtgtcagcattcagcagagaaatgcataactcagtgaaccaatattttacaaatgaccaatgtatgttataaaatcatgtatagataaaagatcctttcaaagggcaatagattttaatgtaacagagtacacagatttcattgatacggtttcaaattccatgtgcatctaatttgaagaaaacttacacttgtcagtttaagtgtattatcaaagaacatccacatttatgaaaatacttgtcccttttccaactacatatctttgtgtgaccagattttcttcgtaaatttcaaccagtacaatatattgtaactggttagtgtagatgtaggtacgagaatacagaatacggttgttttctattaagcacacacattacagagatttgcaaaaatgttacaatgctgctcttctcactaaactttttcttttggaaaatagtcatgtttcataaaaatgtaatatttatattaacatgtaatgggtttattattgttacttttaaatggattgataaatttattttaaatatttctattttaatttctaacacagtaaatgttaatagccataatccacataaacaaaagttctttggggatctcagtaatttttaacagtgtaaaggggtcctgagaccaaaaagtttgagaactgctgcaatcaactataaagagtaagtttgccctgaactgcattaactggtatactttttctctgtctttgatcaataagggcttaaatatgtagtacctacaagtccagtttggcaatggagccttccagttagggctaaaacatagctgataagcagtgacttaagcctaaaaattagtggtcagtatgtagtcaacctatacaactatagtattttcccactgatgattccagtgtactccatatagtacccatttcccatgctccgagtcttagccactacagtttttaaataaaacatagaaacccagagacttgcccaataataaaatctacattggttaggtgtggtggcacatacctataatcccagctacttggaaggctgaggtgggaggatcacttgagacctgggcaacaaagcgagaccctgtctcaaaagaataaaaaatctacactgaaggtgctcctaaacttcttttgtcatctgtcatatctattaatattaactaccaatgatttgtatatactttacgttatctccactccttctaagaacactacatagtgttatctccattttgagaaaaggaaattgatccttagagagctacagtccatttattcacttattcatttatttatttattgaataaatattcattaaagcctttgtcatgtgccaatttccaggtactagattatatagcttataagtaatggaattagagttagaactctgactataaaaccagttctgttttcttagtgccaagatagcatttgtcctgtaactcatttactgagtgagtagtactgatgtgaacaaattagatcatttcttttgccaaggaccatagatgttccctaaacccatgctgccaatggtcataaggataattagggaaaggaccactgaaagatcatgttagtcaagccctctggaaaaatgccagcaagaatgtttggtctttattgtcctgtaaaggatggccattgcattaatggagaagaagatcccttctcaagccttggagaaaacctaactctttctgcctgtaggtttgagagaagagaattgtcatatctttatatatcctcatgaatttttcttttgtaggtacatcccaagcaaataacaatgacttaaatgtgttcaggaaatggcacatatgtgctatatgtttgttatggactcggttggaataaaatgacattaaagaaaatcaaacattaaaaataccttctttataaagatcataagaatcatttaaaagcagctgaaagggagaaatatcaattgggcaaaaaaagaaatctttttttcagaaattgaattactatttctttcactggaggatttttgatgatagaagataattgtaagtaaaggtaatagactgaggtgggcggcaaagaggacaggcttcgagtcagcctcttctggtttcagattctggcctcaccacttaaccagcttgaccttagtcagagaggtttttttgagctaagactcatttttcttctctttaaaaccaaatcataatgaatccttcatagatttgttgtacagattaaatgagatggtataaaagtgcttagcctaatcagtgatatataaacaattggtagttgttgctagtgttattaacaagatatgttttcataatttgacagaacttttgaacttcatgatttggacattcttctatatagtgctaaaagtccttctcattaagaaactgctccctcaaatataacttccgaaatttcaactgccagtatactactatttcttattgaacatatgaaacatttcaataaaaccacaaaagtattttaactgtaatttttttagactgattattcctttctggttaattctagaatgactttccagtttctaatactttaataatttgaagttatatataaaatgattataaaagtttggcaatctctatatgtttttagggaacacaacagtagatgagttaatgatgagactcatggctgcaatggagatcttcacagcccaacaacaggaagatataaaggacgaggtaaggttatgcagatctttaataggattttgatgagattttaataggattttaatttgtcaaatgatgatacatgcctatgatatgatcgataaataaggatgatgaagatgcatttccaaatttaccaagggtttttatgctatggagtttacctttcagtccattctttttatgaccccaagacccaataatttgttttaatttatgtactatttacactttgctagatttggggtgggtacaggaagtcgatttgcaagaaattagttcagaagcatgtttatagaagaaactgtagtccaggaaattatgtctactatatggattttatcactcagttttatggtcctcttactctttttaaatattgagattaattagcaataaacacattttacatttgaatatatttttgaagtactgtgagcattagcaaaagatctccagcattctgaatttctcagcttccttaacatattcaggtgttttctcaacctcctaaacatattcaggtgttatagataacatgaacatagaacctcaaataaaataataataaaaacattatcgatgacaatagtgttcaatacttacctagtatttatcatgtgctaggcactgtgctaagcactaatcatcatctcatatgatcctcaaaataacccgtgaagttgtatatcaatcagtgttatggcagtaaatagacacttttaaactaggttatttaagaagagtttaataaggtgaccatttttaaagatgtgggcagggttttcaaaaatcaacagaagaggctgggcacaggggctcacacctgtaatcccagcactttgggaggctgaggtaggtcgatcactgagttcaagactagcttggccaacatggtgaaaccccatctctactaaaaatacaaaaatgagctgggtatggtggcatgtgcttgtaatcccagctactcgggaggctgagaggcaggataatcgcttgaacctgggaggtggaggttgcagtgagccaagatcatgccactgtactccagcctgggtgacagagtgagaatatgtctcaaaaaaattatcagcagaagataatatagaccccaaggctaaagggaaccattatcatctctaggcctgaaagcctaggagagggtgctgtatggagaggactgcttctgacagagggatatagccaaccttggtggcctaatagagaggaaagtagggaatagcttcaccttccttctctaatcttctgctagtatccctattaatttagcctaattagaagctggaaggtaggagagcctccatgggcaaaaagctgtgtagagaacatggatcctgagggggtaaatggcagataatctagcacagattggtatgattatctatacttttcagatgagaacactgagagtcaaaattaagtagatttgcccaaggccatatagctggtaggagctataaataattatctcaagaagtcattattacgtggatcattcaagaaatttctggatttagaaaatagccttaaaatatgaaacaaatattagcatttgttaatttgagatgttatgttcacagatattggtaagattatcatttttaatttatgtgttttaaatttctttttaaaagatttccctagaacacgtaagggagagttttatttctgaacaatgatgaaaagtttctaaggatagttttaatagactatcctttaggtattgcaaatgtgaaacatatagacaattttaatatagccctgaactattgtattttagtttatttatcgctgtattacattaaactgagagcaagagtcataccatattcatctttgtaagtctgtcccctaacagtgtacttaggacaaagtcagcacttagtaaatgtttgttaagcaattgaataaatgaacatttgaatttacataaaataaagtaacttgaaaaaaaaatttggttacaatgatataaaacctggccagggctcgggggtggctcacacctgtaatcccaacactttgggaggccaaggtggatggatcacttgagctaaggatttaagagaccagcctgggcaacatggtgaaaccccatctctataaaaaatacaaaaattagccaggggtggtgttgcgtgcctgtagtcccagctacttggagagctgaggctacagggagccatgttcatgccattgtattccagccagggcaacaacgtgggaccctgtaacaagtatagcccagcacagtggctcacacctgtaatcctagcagtttgggaggccaagacaggaagatggcttaaggccaggagtttgagatcagcctgggcaacatagcaaggccccatctctacaaaaaaattttaaaaacattagctgggcatggtggtgcatgcctgtagtcctagctactcagaaggctcaggtgggagaatcacttgagcccacgagttgaaggctgcagtgagctatgcttgcaccactatactccagtctgggtgacagagtgagaccctgtctcttaaaaacaaacaaaccaaaaagataaattttaaaatatttttaaaaaatgaaacccaatatatccacattaacaaatatgaaaatttggagcactgtaattagtttatagagttttaatgctcactaggtatcttctattgctataaaaatatggtttatactttttcttaatagtcaatgtttcatttactctgaaggaaaggcattcagatacatggtagaaagatgtttatctgttactctataaattgacagtgacattttgaaataatgaagtactgtacttagttaggaatttgtaataataggtgttttgcctttcaagattacatttatcctggaacagaggcattgattgacaataattcactaaaaacattcttcagccatttaaatcttgagtctcattagtaccagatttacagattatgctgtataagaatatgaatacacaatatttgcatgcttattcccagttcatttttccatcttaatttgtgttccccataatgcactggtaaagaaatttactttaattcctttaatactgagcacaaaattgaatatgagggttacaggaaaaatccaatgctccatataattgaaatttttattgaaatttaattgcaagaggtaaggatttctctttgtttttagagtgtcttcatgaaagttatagctcaagttataatagagttcctaagaaaagcatttctaactttaaagacttcttttggactatacatagaccataatgatttggtagctgctgaatatgtgacaagaaacactgtcccttgtaattgtgaatttgcctttatttttaaaaaattagaaataagacttaagtttgaaattaaaattaaatcagtgaacaggtttggaggctggcttcctaggcctgaatttatttaaatttaactttaaattgtattcatcactttgatgattccatagcacaaccggaaatacctatgtttaaaacttttgttaaataaacccaagcctgaaccatatttatacactgaatcactcttcagtggcccagaaaggactaacctttatatcactgattgctctatttttaaccagggtatatacattatatggatctctgtttttgacagaactgcctatagctttctctcttagacattttcattagtagtatttggttttgtaaaggtttacaaagtacctaccaagtacatatcactggatgaggtccttgggacaaagaaatcttttgctttaatgaggggctattggcaaagagtgggtgaggaggaaaacaagtattactacattacagtagcgacattttagaatctatttttgcctaaagcctgattccaaataatagatgcttcctaacatgtaaatggattgatttttttatatgcactgttttttaagctacctagaaacctctgataatcaagagtttgtgatacttagtttgtgatctatttattgtttcatttgtttattcattcaacacaaattagtttataatcctctatcctgcttgcaaggattactcacttccaggcttacctctctgattaacttgtatctgaacaatagctcggtaattatcacaatccagatgttggagatcagggcagatttcaagggcagttacatcattctcatctctaggaattctaagaatacattagtggaacatgggcaaaatatgccagaggggcattctaggcttattttaaagggttctaatttaggatttaaaaacagcattgccacactgtagggaagataacgtttattacctcacagcagcctttttgttgccaaaggaaattgttggctttgttgtttgctacaagtgtgtaactttttcccctaagctttgtcttagtctgttttcagcagtgcattccttttcctttcctttgtttaaaatctcatcaccatcataccccttctgtttgcagagctaacaatgacaaacagaatactgattctggcttctgttgcagtttgttttttgttgttgttgttcttgttggttgtttgtttcattttttgggtacacagtaggtgtatatgtttatggagtacatgaaatgttttgatacaggcatgcaatgcgaaataagcacatcatggagaatggggtatccatctcctcaagcatttattctttgagttacaaacaatccaattacattctttaagttattttaaaatatacaattaagttatcattgactgtagtcatcctgttgtgctatcaaatagtaggctttattcattctttctattctttttgtacccattaaacatccccacctccccccaccacccttcccaacctctggtaacatccttttactatctatgaccatgagttattgctgttttctttaaagcaggaataaatcatctcaagacacagagaacaaaaacaatctcttggtacaaaaattaaagcaaaacttactaaacagacctttaaaaggagattttactcttagtctttaaaaaatacacacacacacactcatacatatatacatatatacatacacacacacacacacacacacacacacacacacacaccacttcttaaagctagcaaaactactcactggtcagtagttctgttaagagaattttccctgagatagctgtatataaatttatatgtgagattaaaaatccaaaaatacgatatttttaaacattagaattccactgaaaatgctaaaattataaaagttctaatatttaaaagtaacttcaaggagaaagggctgtgttaactgttgatgattaggttactaaatggttagccaaccacaccataggtgcctttctgaaggtagctacattctgcttagaaaaatagttacttatccagtgattattctcctttctgaggcccaaatcacagaaaattaatttctctcactttgatttatgtattcatttcataaatatttattgagcttttagtgtataccagacactgtgtagggcctaagaacacagctgtgagcaagataaacaaggtccttaggcttacaacccagaaattccaataaagtttatcaactaatcaggtggatgaagcccagggagcaactagccagggtgagccagacatgttctcaagctacaaggcaggtggaacaggtaagaatgtagataataacagctattcttcagcttcctgctacatgctgggttctttcttctggggcaatgtttctcagtgtgattcctgaactactggagtacctatctactaagattcccaagcagttagatatgaataagcaacaggttgatttttgttcacatttatttcacattttgaatgtaagataaattatattcttccaaatcccatttaatttatcacatctgttacaatttattagactgttaatagataataaggattgattgcattgattgttttgtcttggcaagcattcatttaacagaggtgtttgactctgacatctgaacttcatgtcattcatatgttattgtcagatttacattcatttttccttgcttaagtcaattatattcttagcttcccaaaatggatcatggctcaacaatggttcattgaaacataaaagtaatgatgaatatagtataataaataactgcaaaccagtacaaactagtgtagttcaaactacagttaactcttaaacaacgtggaggttagggtgtcaactcttgacacagtcaaatgcaggtataacttttgactcccccaaaacttaactactaacagcctactgataaccagaagtcttaccaataatataattgattaacatgtattttgtatgttatatgtattatatagcgcattaataaagtgaactagagaaataaaatgttattaagaaaatcctaaggaagaagaaatgtattgcctcttcattaagtggaagtggattatcataaaggtctttgttcttgtcaccttcacgtagagcaggctgaggagaggtggaggagaggttggccttgctgtcttagaggaagcagagccaaaagaggtagaggaggtgaaagaggaggcagaagaggcaggcacactctgtataacttctattgaaaaaactctccatgtaagtggacttacacagttcagacccttgttgtttaagggtcaactgtggttcaacattagtatagaaataattcaaggaactccagtaccagtatagaagatgccaaggcagctgaatctgagtgtgattattttcatactagtttccataaaagaaaatttgattaggaagtgaatatataaaaattgatcatataagagaaagaatccatttacccctagtgtcagtgtttcttagaacattttttgataaaagcatgagcccttcaaagtttttgcttcattattaagtaaagcctaatgatctacctctctgttaaatcaatagaattttttttagaacagaagaaaaataatatcactaaagtaaaaaatctattgctaaaagcagagaagatgcaaaatcccagaggagaaattgtttataagtacactcaaggtaaaaatggatgcaaaccctgctattgccaagaaacttgtaaagcccctgcaaaattggccataagaagctaatgctcaaaagagacagcaggctgggtgcagtggctcacggctataatctcagcactttgggaggctgaggtaggaggatcacttgagcccaggagtttgagaccagcctgggcaacatgtggaaaccccatctctacaaaaaatagggaaaaaaaattagccaagtatggtggtgtagtcccagcgactcgggaggctaaactgggagaattgcttaagctcaagaggtcaaggctgcagtgagctgtgattgcaccactgcactccagcctgggcaagagtaagaccctgtctcagagagagagagagagagagagggagagagggagagagggagagagagagagagagagagagagagagagagagagagagacagcagagtaagttcttgggttaaatacttcatcaaatgacactgttggatggcatatacaatggtaatggggtggtcaatggaagagtgataagtatattgtgaacactactagagagatactttacagttggatgaaactactaatgtgtgcaaagtaagaatcagttcttgtcatatgtgctgtatgaatgttgaagaggtggaagtagtcatcactctttattctattatcagtgagaaatatatattacagaagtttttcacttagtgattattttgcaagctgagttaaattttaaaagatgaggcagaatcagtactgttgactaactacttcaaaggacaccacgaagaaagtgaaagtacaacccacagattgggagacaattactgtaaatcattaatctaataataagggacttgtatctggaatatataaagaactcttacaactcaataacaaaaagacaaattatcccagcaacaactggcaaagggttcgaaaagatatttctccaaggacgatatacaagtggccaatagcacatgaaaagaagctcaacattattactcaccaggtgactgcaaatcaaagccgcatgaggtaccacttcatacctgctacaatttgtagaatcaaaaaagtcatcaggggcccggcacagtggctcactcctgtaatcccagcactttggtaggccgaggtgggcagatacttgaggctgggagtttgagaccagcttggccaacatagcgaaaccctgtctctacttaaaatataaaaatctttgctgggcatggtggcacgcacatgtagtcccagctacttaggaggctgaggcaggagaatcacttgaacctgagaggcagacgttgcagtgagccgagatcacgccactacactccagctgggcaacagagcaagtctctgtctcaaaaaaaaaaaaaaagtcgtcaggtaacaacaaatgttagcaaggatgtggagacatctgaaccctcattggctgctagtgggaatgtaaaatggtgcaacagctttggaaaacagtctggcagctcttcagttgattaaatgtagttaccatgtaatccagcaattccactcctagttatatactcaagagaaatgaaaacctgtgtccatgtaaacatttgtacatgactgtttatagtagcattattcataataaccaaaaggtggaggctgggcacagtggctcatgcctgtaatcctagccctttgggaggcagaggcacgtggattgcttgcagtcaggagtttaagaccagcctgggccacacagaaaaactcccatctctatgaaaaaaattttaaaattatttaaaaataataaatattattattatttttaatagagatggggtctcgctattttgtgcaggctggtcttgaactcctgggctcaagaaatcctcccacctcagccttccaaagtgctgggattacaggtgtgagccaccatgcccagcctagaaataataaataattttaaaattgttttggccaggcacggtggctcatgccaccatgagcaggccaaggtaggcaaattgcttgagcccaggagatcaagaccagcctaggcaacatggcaaaaccctatctctacaaaaaatgggatatgaaagctaacctacaggtcaaaacaggagtcattaaactggatataaataacctttgtgaaatatcgcaaacgatatcaattaccttctactgtttagaaactatcattagtattatttaaatgttatgtttcatttttattatctaaaagttatgatcttaaaaattttcctaaagtttgtggtttgcatctgggtgagtatcatgtactcagtattaaaggaattaatgtcagcttctttaccaatgaattatagggaacacaaattaagatgaaagagtgtactggaaatatacatgcaggtattttgcattcacattattatgcaacataatctgtaactctgatactaacaagagtcaactgacacagaaaaaaaattggccaaaatccacaccctttcatcataaaaacacacaattaaataggaaaaaaagggaacttcctcagcataataaagcccacatatgaaaaacccacagccaacatcgtactcaatagtgaaccactcaaagcttttcttccaagatcaggaaaaaagcaaggattccaacttccctgctgccttttgacataggactgtaacttctagccagggtaggaaaaagaaataaaaggcatacagattggaaaggaagaagtaaaattatctctatttgcagatggcatgatcttacatgagaaaaccctagagattccacaccaacaaaaaaactgagcttaaaacaaagtcagcaaacttgtaggatatgaaattaacccatacgaatctattgtatctctgtacactagctgtaaggaatctgaaagatacaaacaaatggaaaaacatttcatgctcaaaggtaagaagaatcaatattgttaaaatggccatactgcccaaagcaatttatagattcagtgttattcctattaaactaccattgagattcttcacagaactagaaaaaaacttttaaaatacatatgggggccaggcacagtggctcacgcctgtaatcccagcattttgggaggccgaggcgggtggatcacctgaggccaggagtttgagaccagcctgaccaacatggagaaaccctgcttctattaaaaatacaaaaattagccaggcatggtagcaggtgcctgtaatcccagctacttgggaggctgaggtagaagaatcacttgaacctgagaagcagaggttacagtgagccaagatctcaccactgcactacaccctgggcaacagagcaagattctgtctcaaaaaaaaaaattcatatgggaccaaaaaaaagagcctgaatagccaaagtaatcctaagcaaaaataacaaagatggagggattatgctacttgacttcaaactatactacagggttgcagtacccaaaataacatggtactggtacaaaaacagacacatagaccaatggaacagaatagaaaactcagaaataagaccgcacacctacaactatctgatgtttgacaaagctgacaaaaacaagcaatgggttaaggactccctattcaataaatggtgctgggataactggctcaccatatgcagaagattgaaaccggactctttccttacaccatatacaaaaattaactcaagatagattgaagacttaaatggaaaacccaaaactataaaaaccctagaagacaacctaggcaataccattcaggacataggcatgggcaaagccttcatgacaaaaatgccaaaagcaatagcaacaaaagcaaaaattgacaaatgggatctaattaaactaaataccttctgcagagcaaaacacacatcagcagagtaaacagacaacctacagaatgggagaaaatttttgcaaactgtacatctgacagaggtctaatatccagcatttataaggaacttaaatttacaaataacaaccccattaagaagtggccaaagggcacgaacagacacttttcaaaagaagacatacatgtggtcaacaattatatgaataaaaatcacagcatcacaggtcattagagacatgcataccaaaaccacaatgagataccttctcacaccagtcagaagggctattattaaaaagtcaaaaaaaaaaaatagatgctagcgaggttgcagagaaaagagagcgcttacacactgttagtgggagtgtaatttagttcaaccattgtggaagacagtgtggcaattcctcagagacctacaggcagaaatgccattcgactcagcaatcccattactgggtatttacccaaaggaatataaattgttctgttataaagacacttgcatgtctatgttcattgcaacactgttcacaatagcaaagacatggaatcaacctaaatgcccatcaatgggagactagataaagaaaatgtggtatatatacaccatggagtactatacatccataaaaaagaatgagataacccacagaatggaagaaaatatttgcaaatcatatatctgataagggtttaatatccagaatatattaaatatattaactcctacaacacgacaacagaaaattaaacaattcaattaaaaaatcggcaaaagacttgaatagacatttcttcaaagatatacagatgaccaacaagctcatggaaagatgctcaatgtcagtagtctttggggaaatacaaatctaagccacaaataagatgccacttcatacctagaaggatggctataattttaaaaatggaacataagaatttatgaggatgtagacacaaatttagaacccttgtacattgctgattgggatgtaaaatggcagctgctatggaaaacagtttgttgactactcaaaaagttaaatatagagtaaccatttgaaccaggtattccactcctggccatatacccaaaagaactgaaaacagggactcaaataggtatttgtgcctgaaagttcattgcatcattattcataatagccaaaaagtggaaataatccaaatatctatcaacagattaatggataaaaatatggtatatccatacaatggaatattatttagccttaataaaggattgaagtactgataaatgttgcaacataaatgaatcttgaaaatatgctaagtaaaataagctagacacagaaggacaaatgtatgattcatcaataggcaaatttttgaaaacaatcaaataggcaaatttatggggacagaaagtagatttgagtttgccaggaactaaagatgtagggtaaattgggaagttattgcttaaagggtacagagtttctttttgagtaatgagaatgttaggaaatagatggtggtgatagtttcacaacattatgattgtacttaatgccactaaattgtatacttaaaatactatattgtatgttatgtatattttacaataataataaagagcacaaataatatagttttcaattcttgagtgcagagaagcgacaggttactatgggctggaaattggaaaagttattgattcttgggctcagtacttacggggtactactgggaactgacatagagtggaaaggatttgggctctgccttcatgaactttaatcctgagcagtttgttactctgtattaaattccaaacttttattttgtagggaagtaaggagtcaggtgaagtatcttaaagaagagactaagcttgtgctgtgaattgctagggccaagcactttgttagatacttcctttaaatcatctcttctagtttttatgataatcttaagagatagtaattgcccccatttactgaggagagaggaaactgaggcttatagaggttaagcaatttgcccaaggtaatacaactgtgtaaaggccagaatacacacttacaggcttttgatacctcatgatcccttgtaaaactgaggtacaattatattaaagatttatgggataaactgaatcagtgctcttaccaagattaggtaggatctgagtgggatgatctgaagagcagatgagacattgccatattcgcaaatattatattcactagattagaataagaaagtttctcttaattgcgtacttctacttttgtgcatggaataatgctcacttttaaaaagatatatccataccgtccctgtttacatttgttgttcttaaagtgcctgctgatagatcagtttatccatgtctgacacctcacagtagaagttaataattgtcatatatgaaactgatgtaaagagatttgtgactcaacattggcgttacaattcagcacacctgttcagagccagccctccacatttttcccttttgcctgaggtgaagacttcttcgtggattacagtaacactttttgacaagcttagactgggtggagttgccatgtaatgacagaacacaattgatgatatctcagtaatgcattcttttttgatttgggctgtcaccatttattactgtaaaagcattcattgttaaatagctggcccaacctgtccactttttgttttcagtaatggcaaggcctaagaaagtatgtttaattttctagttatgaaatattagctgactttgggggtaatatatctagttgtattttcttttatgtaacatttaaaaagtagccatcttagtattttccaaataaaaattgaaaccttctaaagccttctcaagaggctattgagaccttcccaatgtcttaaacctgacaggcacctagaaacattttttcttcttatacagattcttttaaaaagaattggaagaaactgttcttgccttaaatataacactaacttgaattcctatgtttggagacagtcatattcctcatgaatttttatttcccatggggccttatatggccatgtttgcgagaatttgggagctgaaagtacactttcatgtgcattgtacctttaccttgtttactactaaactgagggactactactggttgtttctggggacattaaaaaaatagtgtgagttctcaccataaaaagcaataagtatgtgaggttatgcatgtgttacttagctcaatatagccattctacaatgtatatatagttcagaacatcagattatacatgatatatacaatttttgtcaattaaaaataatgaattaatatataaaaaacagtatgagtgccagtcctgttctttaaggaatttgtcatctaaagttggagaaccaaagcatatccttacaaaaagtatccctagcaaagatttgttatatgatctagaagaattcagaaggaacaatctttatagtcagaaaggactttaataaagagctaaagttttttggttttttgagacagggtgtcactctgttgctcatgctggagtgcagtggcacagtcagggctcactgcagcctcgacctcccaggctgaagcaatcctcctgcctccctcccagttgctgggactacaggcgtgcaccaccacacctagctaattttttgtatttttagtagagttggggtttcatcatgttgcccaggctagtcttgaactcctggactcaagtgatccacctgcctcagcctcccaaagtgctgggattacaggagcgagcccctgtgcatggcctaagaggtaagatttgatctggttctggaaagtacagtacagtttgcatgtgcagaggtaaaaggagagatgattgcaagattgggaaaacatgagcaaagaaatagtgtaaagaagttgaattcatgttggtccagtttgcagatcgtagacaatttgtgtagaaaaaatacagagaaggatactcagttgccttccattagtatttttgacatgtcacttttacctctccaaattactttatcctgattttcatgcctctcatgggggatactgagaattatctggcatttttcttccagttacagatttgccttgaccctggttattctttccaattacctatcatcccaggaaacaggtacttgcaatatggtatgaaaaacagcaatggcaataagtatgatacggaaatgacacaaacaagacttcttaaggagtaaacatttgagtcttaaaggatgatatgtagacatttagtaggtaaactaccattaatttgttttgaccattaaatctacacattttttagggacttgctatatatccgcattgtgctcaacaccaggagatatatggatgatgcattcctttagatgatcagtgacatgcaaacaaaggattgcatgtattatgacataaattccgtgatggagatacatgtagggtgttagagctgcctagcagagttaggcctcaccagggcaaattttttaaagctgagacaacaaattagcagcattgtggcaggtagacttgtggagaagtatcttctagaagaaagaagggtacttttccaattgatggttagattggaggagtacactatcagccaataacacacatcataattaagttagggatacttggttaggcagaaagattctaatttcagattagatatttcactttaacaatagccatacatacttctcatttcctattatactcatctttgcagagtatttttagcataaaccacaccaaaatgtgttagaggtttttggttttatgcctggacatatataggcaaaacgcccctatcaaaaattgtagcagactagtaaaaactattttctttctttccttccttccttccttccttccctccctccttccctcctccttccttccttccttccttccttctctccctccctccctccttccctccctccctccctccctccctccttccttccttccttccttccttcattccttcctttctttctttcgagacagtctcgctctgtcacccaggctggagtgcagtggcgtggtctcgactcactgcaacctccgcctcctggttcaagcgattctcctgcctcagccccccaagtagctgggatttcaggtgcccaccactacacctggctaatttttgtatttttagtagagacagggtttcaccatgctggccaggctggtctcaaacacctgacctcgtgattctcgcacctcggcctcccaaagtgctagaattgcaggcgtgagccaccgtgcctggccgtgaaaactattttaatagatttgcttttggaattatcaactgcccactgttgtttcactgaagaaattcactgcttgtatgctaaaatacacatcacagctttgcacagctttgggaatttcaatggatggagaacaaccaaagctattattcactgccgtcaagaatacaaagtggttcagccactctgataaacagtttcatggcagtttctcagaaagttaaacatagatttaacttatgatacagcaacctactgctcggtattattctagaaaaatgaaaacttagattcacacaaaaacttgtggctgggcacagtggctcatgcctgtaatcccagcactgtgggaggccgaggtgggcagatcacaaggtcaggagattgagaccatcctggctaacacggtgaaactccgtctctactaaaaatacaaaaaattagccagacgtggtgggaggcacctgtagtcccagctactcaggaggctgaggcaggagaatggcgtgaacccgggaggcggagcttgcagtgagccgagatggcaccactgcactccagcctgggcaacagagtgagactcagtcttaaaaaaaaaaaaaaagaaagaaacttgtgcatgagtgtttatagaagctgaagctgtgttcataattgccaaaactaaaaacaacccaaatgtcctttagtatcctttattgacctttggtgggttaaacgaataagcatactgctcagaaataaaaaggagcaaacttttgatacatacagcagcttgaatgtatcacaaaggcattatgctttgtaaaatatatcagtctctaaaagttatacactgtacagttctattatatgatgtttttgaaaaggtaaaagtgtagggacagagaactggtcagcggctgctagagagtattcaggaaagcgtggactgcaagggataccacaagggatattttttgtatgatgaaactgtttcgtatcctgattgtggtggtggttacatgaatctatacatacgttagaattcatagaactgtacattaaaaataatccattttactgtatgttcatttggaaataaaattaaaaaggaaaagtaagtttatttaatggactttaaaatgggttttaacaaaattttattgttctttcatttgttttaataactttttggatgcctttgataatggtgaccattataggcataagactaggccatttgcaaaatctgtaaggcaggttttattatacccattttatagaaaaggaaactgtaacacagagcatttaatgactttcccaagtcatatgctaattggaaaaatatcttatttgacagacaacagttgggattgcacaatctttcctaatatagactgcagccattggtgtgggagttctcaaaatatagtacagtgactactagtatcacaatcacctggggagcttgtttaaaatacattcctgggcctctgacctattgccagtttccaatttcctcttaaataaaatggggataataatagtacctacctgctattaacatgcactggtacctagtatgtaataagcactatgtaaataaaagtatctattattgctgttatttttaatctaggcttatctgaaaggaactttagaatttacttaatcttacttcattattctacagtttaggaaactgagacctatatgagttatttgcccaagatcacttacagagtcaggccttttgtgttgttactttttctccttttagtgttattttatcttaattcaaattaaatagttatcttataatgggggtatccagtatgtaagggcaggggctggggaaaaagatttgcaaatgattttgaattctagcattttgtttttaaatagcatttttcttttaaaaaatttgtacatgcacttttattagaaaaatactgccttaaattctctttttcataaatctcttacatgcacatgaatgtatttgattataccatttttgtagttgtaaaatatttaccctgaggaaaagatatactagaataatgatatgtaaatacaaagaatacaacctatggagtctgttcactgcaaatattccaggtgtaactgagacaaagaacatacactttgtaatcctgaactagtttattcatgctgcaaagcagtagatagattcaactttgcaaccaatccaaagtgtttgtgaaaatctcttatctggaaagggagtgaaaccttctatgcagctttttaatccaaagataaatttgaatgtatagctgtagatatctaattactgtttactggaagattgaactacaggatttcactttgaaagtcaggaccagccaaccatggagaacaaacctacatatgcttgagagccattttgcatttgcttcttagtcttttgtcaagaaaggagctgtctaacatatacctgcctactcactccctcttcactttggagggactctacccattcatgtgctatctctttaaccactgaatatagtttagttggtaaaatgcgtgcttggtatttcggtccaagaaaaattcattcagtgtctgccatgtgacaagtccaagccaaggtatacagggtaatatggtttctacctttagggtacttgccacttatctctaaaaatgaaaactcagtacctgaagctgttagagaccagattggttcaaaacggagggatatagtccacgaacaagtggaatggaaggaagttcagaagaataagagatgaggataggctaggtgaatctaaagagagatagggtttgaattaggccctgggtaaatggaagagtccatgactcatgagagataactgtaagttggtggttaagagtttgcagtgctatattgcctgaattcaaatcctagctcttccacctagcagctgtataatcttgagaaaaatcacttaatctttctgtgcctcacgtacttcagttagtagccacttgataagattgttgtgaagattaaatcagttgatacatgtaaagtgcttagactggtgcctgacatctagtaaataatcaggaaatattatctgcagtaatactaataatataaactaagtttggaagaatgagtaggaagaatcatttggattaagaaagaagaacataaaaatttgggtatgtgatacagcttggaagtgtcaaatggcttgggatatgtgggaaagaagtaattcaataaggcaagaaggggttgtttatagacagaagtgaggagggagaaggctgaaaatgtgcattagggcacatttttttgaaggtatgtctatgttctgctataaagcttgaaccttaaactgtgggcagtaagtattcatcgcttctcttaagcaggaaattagcaagattagatttgcaatttaggaaactaatttgataggtatgacatttgcttactcactttgttcctatctttatgataataccattttgttataatttctgttattttgtttgctgtctgaactaccgtgcttttcaaactatggtctttgagcatacctttggcttccaagctagacctactgaatcagaatctctgcaggtgggccagagagtctgtgttttcacaaatttcctgtataacaagtgatttctatgtatcttaaaatttaagaaccactggtttagtggaaagaacataggctttagaatacatacaaaacctgattcagttccttatgagatatacaccattggcaagttacatagccaattcaagtctcagtttccccatctgtcaagtagaagtaataccccattgtggtattgtgggaatgaaaagaaagagcatatgtaaaatgactaaaccataatagaccctcctatatattgacttcctttctaagcttatatatgtatctcatacaactaatgagagaaggaaactgtcttactcatcttatctccagtttctaacacagggcctacatcttgtaggtgtgcagtaaatattttataaatgtgtaagtggatgaacaaattgtatggggaaaaactggaagttaggagacttgattaacaggttaatgccataatctgtgagttagtgatgaccggatctaaactgaggcatcgttcttgaaaaatgtacaggctccatcctaggttaccaggcagatgtgtacattgtctctggattggtttagccttaacataaactctcactagttagccagtttcatctaaagcagacactgagatggcaatccatagtttgaaattctgtcactaaagaaattagtaagccagtcctaaatccagctttttagctgactcccacataccacttctatccagatgaaaaagaatcttttctaaacatctccatcagaaattccagagacttacattctagcaaagcaagacaatctcagttaggacttggaagttacttgctacttgtgaattcatctctgtttttatagtcctacacaaactattttgaaatttctctgtttaaaactgttgattactggagtttacaaaaataaccaggtagtctaacattatattaaaggctcaatctttgatataataagtagtaacctgaaagagtgtcatgtcagatttgccataatccttatttcactgtttttgagcaccagcagataatgattttacagacaaatccatttagcagatatgaacttataatgcagatgtatgtggaaccaaatgctcatttggtgttcattttttaaaaatctgctaaacaccaagcactgcttgggggtcagaataaagagataaatatggcaaagtctcttcagtttgcttaaggtctgaaaagagaaatagacatataaataaatggtgacaactctgcagaataatataaggctggaggtaaatatcattccttagcatcttgctcttctctaaggagaatccattgagaattaaatgaactaaacccatatttgtttttcccatacaattcattcagcaagttgaaacagattattccttacacacccaggaaaatcattccataacagtctgctaccctaattcaaggattgtatttgcactgtttggaaggaagaaaatgtagagatggagaaatacaataagcaagtaggttgaagataaattaaataacagaaagagctgtatattaggtatcaggaggtctgcattctaacaagctatgtgactctgggaaaatcacttatactttctgagtctcagtttcctcatctctgaatagggataaaagtcccttcctggccagcctaattgttgtgagtatcacatgtaaaagtgctttgtaagctttgaaatataagactttaaaggatttaaagtcttaggtaaaaatataggtaggaggatattcattagtacttagtacattttcctttgcaaatacttacttagttaatggtagatttggtgagataaacaaggaaatgagaactttttgcagaatggaaaccaaatgagaactttttgcagaatggaaccacaatgataagttaggcctagggctagggaattctttttttttgagacagagtctcactctggtcacccagactggagtgcaatggcgcgatctcatctcactgcaacctccgcctcccaggctcaaacaattctcctgccttagcctctcaagtattgatcgctgggattgcaggcatgcaccaccatgcccggttaatttttgtatttttttctggtagagacagggtttctccatcttgtccaggctggtcttgaactcctgggctcaagcaatctgcccgccttggcctcccaaagtgctgggattacaggcgtgaaccaccatgcctagccagtgagaattcgtttttatcacatagatgaggccttctaagtcattgctgatttttccttccagcctggaaacgcttagtacatttcagagcagagtcccaccatctggttttccatttgatcctcacagtctggactaccctaatgtagagcaaacctagaggcttgctctgggccctcatacaaaaaaagtaccttcctcctctatctgtccccactttctgcacttagagtgtgattacctaaaggcagactaagcacttatggacaccaacagagcagatttaccaaatcaatagatagacagtgaaaataaaaagagaaaccttgctcatgaatacaaagaatcaatatcatgaaaatggccatactgcccaaagtaatttatagattcaatgctatccccatctagctaccattgactttcttcacagaattagaaaaaactactttaagtatcatatggaaccaaaaaagagccgttatagccaagacaatcctaagcaaaaagaacagagctggaggcattatactacctgaacttcaaactatactacaaggctacagtaaccaaaacagcatgatactggtacgaaaacagatatatagaccaatggaacagaacagtggcctcagaaataacaccacacatgtacaaccatctaatctttgacaaacctgacaaaaacaagcaaggggaaaggattcttaataaatagtgttgggaaaactggctagccatatgcagaaaactgaaactggaccccttccttccaccttatacaaaaattaactcaaggtggattaaagacttaaatgtaagacttaaaaccataaaaaccctagaagaaaacctaggcaataccattcaggacataggcatgggcaaagacttcataactaaaacaccaaaagcaatggcaacaaaagccaaaactgacaaatgggatctaattaaactgaagagcttcttgcacagcaaaagaacctatcatcagaatgaacaggcaacctacagaatgggagaaaatttttgcaatctgtccatctgacaaagggctaataccagaatctacaaagaacttaaacaagttaacaagaaaaaaacagccccatcaaaaagtaggtgagggatatgaacagacacttctcaaaagaagacttttatgtggccaacaaacatgaaaaaaagctcgtcatcactggtcattagagaaatgcaaatcaacaccacagtgagataccatctcacgccagttagaatggcgatcattaaaaagtcagggaacaatagatactacagaggatgtggagaaataggaacacttttacactgttggtgggagtgtaaattagttcaaccattgtggaagacagtgtggcgattcctcaaggatctagaaccagaaataccatttgacccagcagtctcattactgggtatatacccaaaggattataaatcattctataaagacacatgcacacatatgtttattgcagcactgtccacagtagccaagacttggaaccaacccaaatgcccatcagtaatagactggataaagaaaatatggcacatatacaccacgggatattatgcagccataaaaaaggatgagttcgtgtccttttcaggggcatggatgaagctggaagccatcattctcagcaaactaacagaggaacagaaaaccaaacaccacatgttctcactcataagtgggagttgaacaatgagaacacatggacacagggaggggaatatcacacaccggggcctgttgggttgggtggggggttaggggagggatagcattaggagaaatacctaatgtagatgacgggttgatgggtgcagcaacccacaatggcatgtgtatacctatgttacaaacctgcacgttctacacagatcttaaagtataataataaaatctcagaacttaaagtataaaaataattaaaagtaatttaaaaaagatgacacttgggtcactagtctcctggctcactttactaatctgcctcaactgccatcactaattagggtgaagagatgactactaccatggctgttactgcttttgctgtgtttaaatgcatttggagagccttacataatttttcccatttgatgagcttattactcaatgtataatctaggaagacaagaaattaactttctagaatttggggactttttaatagataaaatatgtcttccatataaaagaatgtatataatacataggcagagtttaaaataaagtaaacacctatgtacttgacactgagttaaaaaatagactaataacaatactttggaaactgctttagtaaccctctcaaatatctttttcctctacatgtaatctctattctgactagtatattaaaattactcatttatgtatgtccttaaaaaaaagagaaacctttttgaaatttggtatttcagaaatcaaagtaatcattgtgagaaaaataagaatgttgtcagacttttgaaatgtgtttacagtttaagtattttcttctgaattccatctggtgcataatccgtggttaagacctctaatgttcttatttttggccctgggacacttatcagagccctgacacatagggactgacttgagtggtggggtgtaacagtcggttagggactaatggaaggatgcttcagagacctgaggctcatgttcatgtaattattcatgaatcatcccttgcttccccccctctaccatttccattttacctatagaaaaatgatgctatttagtgacagctgatttgccccaggtcctccctaaacagtccttaggggaaattcagctattttccctaaagtcacacatctagttattgaaaggatgaagattaatattattgggattattattaggttaatagtcatcaattacatgccatagtcccagatgctatgtgatatattgatttcatttcatccttctgttaatctagttactggagttttaaatttaaatttttttttttttttttttgagacagagtctcgttctgtcacccaggctagagtgcagtggtgccatctcggctcactgcaacccccgcctcccaggttcaagcaattctgcctcagcctcctgagcagctgggactacaggtgcacaccgccacacccggctaatttttttgtattttagtagagacagggtttcaccatgttgcccaggctggttgtgaactcctgagctcaggcaatccgcccaactcgtcctcccaaagtgctgggattacaggcatgagccactgtgcctggccattttttttttaatttagagataaaattgatcagtgttggaagcggtcaaggaacttgcccaagggcacagaaattaagtggcagacctagaattcaaagcaaggctgtctgtatttgaaagcccatgaccttttccctgtactgttcggccaccaagatgaaaggaggactggaatccaagtcatttggctggaagatgaatgtcctggtcctagtactccaggaagcccatattaccaggcacttcttttgcttttttgatatttatttatttattgacattctcactccattgcccaagctagaatgcagtggtacagtcacagctcactgcagcctcaacttcccaggctcaaacaatcctcccacctcagccacccaagtagctgggaccacaagtgtgtgccaccacacccagctaatttttaaattttttgtagagatagggtctcactgtgttgcctaggctgttctggaactcctggactcaaacagtcctcctgcctcaacctcccaaagtgctgggattacagacatgagatgctgtgcctggcctgcacttcttttgagtgccaattttaacatttttttaagcattgccctcatcatttatactttagatgtggaaagattaaaatatttttctctctctctttttcactacagacagctttgttgtttagccataaagtatcagcacttcattctttttatggttgaataatattccattgtatggataataccacattttgttgtttagccattggcttggtagccatcaagacagcagcttgtatggcctccctctataattttgataatttttttaggtgaaattcacataacagaaaattagccattttaaagtatacaatttgggccaggcacagtggctcacgcctgtaatcccagcactttgggaggccgaggtgggtggatcacctgaggtcaggagttcgagaccagcttggccaacatggtgaaaccccgtctctactaaaaatgcaaaaaaaattagcagggtgtggtggctcatgcctataatccctgctactcaggagctgaggcaagagaatcacttgaacctgagagatggaggttgcagtgagctgagattgtgccattgcactccagcctgggtgacagaatgagattccatctcaaataaataaaatcaaaaagtatacaattcaggggtattttgtacattcacaatattgtacagctgtcacatctgtctagttccaaaacatttttatcacccccctacccattaggcagtcactctccatccccacacacttacacatagcccctgacaacactcattttctttctgtcttgagggatttgcatgttctagatatttcttataaatggaatcatacaatatatgacttttttgtctgacttcttgcacttaatgtcttcaagcttcatccatgttgtagcatgtatcagtaattcattctttttgtggttaaataatattccattgtatggatataccacattttgtttatgtattcatctgtagctggacattcagattgtttccacattttggctattgtgaataatgatgcagtgaacattcatgtgttaacaatctcttttagttcctgttttcagatctttggggcatattcctagaagtacagttgttgggtcatatggtaattctatgtttaactttttgaggaaccaaaaaggaaccttctagagaggctgcaccattttacattccagccagcaatgtacaagggttccaatttctgtatatcttcaccagtgcttattttccctttaaaaaacaaaagtcatcctggtataaaggtggtatcttgtttgtggttttgatttgcatttcgttaatgactaatgtagaactacttttatgtccttagccattaatatatcttctttggagaaatctctaattctgacactttgaaaatatgtggtagtatgtaaatatcttgttttgtaagcaggattatcagaatgtcctatgacctgagaaattttcaaaaataagatctgaaatatctgaattttaattctatcctgattagaccataacctggggaaaattttttaaaaacctttcactgctcaaatcactaaagaagaaattgagacaagttcttaccttttttcttttttaagacagggtttcacactattgcccaggctagaaggcagtgacatgatggtagctcactgtaacctcgaactcctgggctcaaacagcctcccacctcagcttcctgagtagctaggactacaggctaatttttaaattattttttatgggtctcgccatgttatccaggctgatcttgaactcctggcctcaaggaatcctccgactttggcccccaaaaaacactgggattacaggcatgagccactgtacctggcagattcttaacatcttcctagtgcctaactagtccccgtaaaaatgttttcattactgaaatctctgcttcctctgttctcacaccagccaggtactaacttagaaaatgtaattatcaatttagctttgggggcagattttgaaaacttgactttaaattatcaaatatctgagttactttacttttattctttttgacatcactgtgtctacaaatttggcaggggcttgcttgtctattttagtgactcaggaggtcagttagttttccttgcagtttaattcagtgcacatctgttgaatacctactaagtgccctgccctgtgtccagtatgaaaagaaatatgtcatgcatgtagattatgttacaaaaggtagtagtcctggaataacctgacactccacacaaaaggataattttcctcggtagagctattttcccattcccattcccattcctccctattatcatttcttccagccgtcttttaaatgtcagaacttaagatagaggtaatggcagtaatggcaggaagaagaaggtaaagcaagaacatttaccttgcaaaggctattgacacttttgagatccatgagtttctacagcaggtaccttagctttttttccttttttctcttgttgtatatatggtcacttcttttctttcctcttttctgtcatctgtccctcaacatatgtgaggattaaataagataataatgtgtaaaataattagaagggtatgtatagtaagcattcactaccaagcatcaaccatacattaacttacgctgaaaattcagaggttaataaaagtgtcccagctaagtactcacagtctagtgagagacaaatatgtaaatatataattataataatacagtgtgaatatagtacagaagtgaagctactcaatccaggatttggggaggagggagtacctgtgattgcttagagcggacacttaggttgggcctgaaagatgaatgtgattttgcctgaaggagaaggggtggagagtattccaggccaaggataaaggatggacaaaggcagagagtcaccaaaagtctagtctgtgagaattgtgagagggcttgtttgggtcaagcgtagagtatgtggaaggggaaagcagacagtgaagctgataaaagtatctaaggccagctatgttaagattaggtgttcattagagtcattacctgaaacaaagctgaaataccaagtggttcagaatgtaaagttctatatataagcctctaagacaggtgggttttttgtgtctataattagaaattattcctccacttgtcctagatacctagaaacctgtccattattcctttgccctcatatgcttaatcaaatcatttttatctgtggtgcaaaatccttttcaagactttctactattggcacatgtaaaggctgctctgagacctttgactttaaatctttcacactagtgtcagaactaaattatagcttctgatttttttgtaatgaacagattagttactctttccatttgacctttccttttcctgaagctctccctagattttctaaactttaaatcccattaggattttattccctgcttagtgaaagttgaaagtttagaaggctgaaaccaacatttatattgattttaaaggtcagcaaagtttttctataaagggctagatagtaaatatttttggccttggggaccatatactttctgtcacagctacttaactctgtcattgtagcacaaaagcagccataaacaatatgcaaatgaatgaatatagccatgtttcaataaagttttatttacaaaaacaggccacaaatcagttttggcccaaagaccatacatagtttactaacctgtgattgaaagtaagcatttttctattgtcttatctgtctcctttcaggaaggaatcctgaccagagaagtatccacagaacatagtattcagcttttatcagtgaccattatatcatctctttgttacactcacatacacacacccccaaaattctctagaccatttagctggatataccacataacaaggctgccattttggagaggaataggtgtttggctgtctctctctattgcctttctcagaatgtatgctctcagtgaacatgttcctgtgtaaggaatttccatgtccatttgggaacctattgtgaggtgtctgttcaaaagcccaggtcttgtcttccaaactcctgactggctgctaaaggattaggtcccagttctggtatttaaccattcttctcccccagtgtggattaacttcccccattcatgtctttcctgaaagcaaaaataacatcccaaccactcttcagcagtgttagatatattaccttaatcaaaatattcttgctttctataagatcagtaagatcccccactcagaagacttctacagtcttacaagcagtgcttttcaaaatttaatctgcatatgataggagtcacctggaggtcttattaaagttcatatttctgatgcagttattctgaagtgtggggcccaagattctccttttgtgacaagctccaaattgatttcaatactgcttgtccttggaccatactttggttaacaaggttctaagtactatttctattactataacctagtcatccagggtcttatcattggatcagcagcattaagaatcagggctggtattctataggtgaggtggcttcagtgatctagtccttgactatgatgaggacaaccaatttatttgtttattcagtttaggagtttctttaaaactgggtgttaccatttgaaattgatgttgggtacttgtctttcatctatactagaaaattcaaaaacatgatctctttaggtatggttcatccactgtattctcttctagacttcctagtagatgcatattagatactcttgactgtgtcttccatgtctcttaacttctctttcatattttatttttctgtatctctgtgttgcaatttagataatttcttgagattactcacatttcattaattctccctttacctatgtccaagctactgtttcattgaaattgatgttgggtacttgtctttcatctatactagaaaattcaaaaacatgatctctttaggtattgcttaatccactgtattctcttcttttaggcttcctagtagatgcatattggatactcttgactgtatcttccacatctcttaacttctctgtcatattttatttctctgtatctttctgtgttgcaatttagataacttcttgagattactcacatttcattaattctccctttacctatgtccaagctactgtgtcatccatctattaattttttgcagtattaatcatttattttctaaatgtatattgaggtacaattgatatacaataaaccacacctatgtaaagtatataatttgacaagttttgacatatgtatacacccatgaaatccttaccacaatcaaaatagtgaactatcactctcaagggcttcctcttgtacctttgtcatccctctttgctgtctctgtctgtcaagccaagtcccacatatccactgaactttctgtcagcatagatttgtttgcgttttctagaattttattaaaaattaaaccatatggtatatactcattagtctggctactttcattcagtgtaattattttgagattctccacattgttgcatatatcaataattcattccttttacttgctgaatagtattccaccacatggatataccaccatgttacttttttttttgttttggttttagcaattttttttttttttttaaagagacagggaatcactctgttgcccaggctggaatgcagtggtgcagtcatacctcactgcagcctcaaactcttgggcccaagtgagtctcctcaggctcctatagctgggactacagacacacactactacacccagctaattgttttaaatttttggtagagtcaggggtcttgctgtgttgcctaggctgttctcaaactcttagcctcaagcaattctacctttgcctcccaaagtgctgagattacaggtgtgagctgctgcacctggcccattaacaatatctatacatttttttatggaaatggaatttacataagatacagttaaccactgtagtgtatacaattcagtggcatttactgtatttgcaatattgcacaactaccatttagcaattattaacagtgttaataggataatttaacctttatatttaaaaattttgcataactgcctttttaaaaataagagcaaggtgcagtggctcatacctgtaatcccagctactcaggaggctaaagcaggaggactgcttgaggccaggagtttgagaccagcctgaacaacatagcgagaccccatctctaaaaacatttttaatataataattagaataattagcctgacatggtggtgcacacctgtaatccaagctcctcagaggctgaggcaggaaaaaaaaatcacttgagcccaggagtttaaaactgcagtgagctatggtcatgccactgcactgcagcctgagtgacagagtgagaccctgtttctttaaattagaaaaaaaaagtttaaaaacacagcaaaatagctcaaatacaatatattgtatttttctttctgagtagcccatcatgcacacatacacctaagaaagcttgaatattcagctatactaaaatacagtattccaacagaccccaacactttattattagctaacctggatcttaaaacaggctgctgacatatagggcaagtccagcctccagcagccactgagcactatgatatggttatacaatttatacttgtgagtcaactgcctgaccttagttcctgtcaaacagtcaatgaaaccaatactgtacttttacctaattcactcggaatgctcatgtgcccccagtctccagtgaaaagactgtcagtctttgatacaaccctgtatgtgaccatcataatttttgctaataaaatcaagcgggctaagctatgaatgggtagtttcagttctcactaaattgtttcttctctccatatcctgttttaggagtgaggctgagcagtctcatgtaaccttgcatttccttgctgtcttcttgggttttaagagtctgccttgtgttgctgaccctaagtcactcagttctaagcacactcttcctttgagtctctaactgagagttggtctttattagagaactcagttctccaaacccagttatgattggcttaaagttgatgtgaaagccactgataaagggcttattatgcctattttttgaaatcttatgatgataaatagttacattacaacagaggttaccacacctgtctgctctgtacaataaaagccactactgctgctttctatagtgtttatatttttcacaattttttgaatgttcacctgttgatggatatttggattatttcctagtttttggctattacaaataaagctgctatgaacatttgtgtacacattttatataggcatatggtaatatggtcatttgtcttgggtaactacttacttaagactggaatgactggatcatacatacagtagatagatgcataactttctaacaaactgccgaagtgttttccaaagtagttttaccattttacgttcccaacagcagtgtataagagagttccagtgcctccacatcctcatcaacattttgtatagttagtcttttctttttttttttttttgagacggagtcttgctctgtcacccaggctggagtgcagtggtgcaatctcggctcactgcagtctccacctcttgggttcatgccattctcctgcctcagcctcccgagtagctgggattacaggtgcctgccaccacgcccagctaaatttttgtatttttagtagagacagggtttcaccatattagccaggatggtcttgacctgacctcgtgatccgcctgccttggccttccaaagtgctgagattacaggcgtgagccactgcgcctggcctggttagtcttttaaactgagacattctaataggtgtgtagtagtgtctcactgtggttttagtttgcattttcttgacgattaatgagacagcatttatttttcgacatgcttatttgctgtctatgtgtcttttgatgaagtgtctgcaaatcttttctccattttaaaattggggtccttttatttttgtattttgaaagttctttatgtgttttagatacaagtcttttacttgaaatgtgatttgcaaagatttttctctcagtctatggttttgtcactatgactttctttttcataaataccaacttatttcaatgtactctgcagtgaatattttgcatttagtagtagaattatagttttattgagggaacataatatacagagattttattgttgctactattcaaaaatatttcttactatatcacgataattcactagaataaatattagatagcatttccctggtcaagaaatgttttataactcttaagtctactgttagatgaacagcttataattgtagtaataatatttgtcttctacatacctcacatttaatttttaactttgatttttaatttttttatttttacttttatggatacataatagttgtacatatttatggggtacacatgatactttaacataggcacactcaatatcattttcaattgtctttaggagaaaataagtttaaaattttgatgaagtccaatttaaatattttttcttttatgtatcatgcttttgggtcatatttgcctaacctaaggtcactattttctcctatgtttcctttataagtattatagctttagacttcacatttggtctatgatccacttcagttaaattttgtatatagtgtgatgtatgtattgaagttatttttttcagagtcaggaagagatggatatccagtagttctagtgctatttgtttaaaaggttttcctttttccactacattgcctctgcacctttgtcaaacgtatgtgttgatcatatatgcataggtctatatctggactttattttttttccattttttttctgtctttacaacagtaccatacagaattactattacttcagctttgtaataaatcttgaaatcaagtagtataagtcctctaatttagttattttattttttatccataattcttttggctattgtaggtcctgtgcatttccacatgaattttacaatcagctaaccaaaaaaatttttggtggtattttgattggaattatgttgaatctgtagataatttggagagaactgacataaaaatattgatttgtctaatccacaagaatgacttatttatctctccatttatttatgtctttaatttctctcagcagtgttttatgatgttcgacatacagattgtttgcatcttttgttaaatctatccccaagtatttcatatattttatgctattataaatgatatttttaaactgtaagttctgagtatttgttgccagtatatagaaatataggctggtccaaatgcagtggtgtttacagctaattgaccacaaccagtaacaaatttctttgttctttctccactcccactgcgtcacttgactagaaaaaagaaagaaagaaagaagggaggaaggggagggaaggggaaggggttgcttgttatttattttatattctgcaaccttactaaactcacttactagttataatagctttttggtagaatccttagaattttccacatttctaatcattttatctgtggataaagagagttctacttccttttcattgtagatgccttttattaatttttcttgccttatcagatttgaaaatcagtcagtgtaatttatgatataatcatctcagtggatgcagagacggcatcagacaaaagctaatttattcctgataagaatttccagtaaaataggaatcgagtaaaatgtccttagcctgataaagagggcatctatttaaaaaaaaaaaaaaaaaaaaccctacagctaacatcttacctactggggaaagatcaaatgttttcctgctaagatcaggaaaaagggagggatatctgttcatatcacttctattcaccattgaattggcagttctagccagtctaataagcaataactccccattctccttcccctcagactctggcaacctctaatctactttctgtctctaggagtttgcctattctaggtaccttatgtaagtggaaacacaatgttgatcctttcacatttgaagcacaatgtccttaaggtccatctatgttatagtagatataagaatttaaaatctttttatagctaaataatattccactgtaggtatataccatattttgtgtatccattcatctgttgaacagttggattatttccaccttttggctattgtaaataatgctactatgaacatgcctgtactggccatttatacatcttctctggaaaatgtctattcaagtcctttgacttttttctttttttttttttttgagacagaggttcgctctgtcgcccatgctggagtgcagtggcacgatctcggttcactgcaacctccgcctcccgagttcaagcaattcttctgcctcagcttcctgagtagctgggattataggcatgcgcccccacacccaggtaatttttgtatttttagtggagatggggtttcaccatattggtcaggctggtctcgaactcctgacctcaggtgatccacccaccttggcctcccgaagtgctgggattacagttgtcccagcctttgaccattttttaattagcttgtttagtttctttgttgtttagttgttggagtttattatatattctggatagtaatcctttatcagacatcacgtgcaaatattttcttccattctgtggattatctttccactctcttgagtgaaaaaggtttaattttgatgaagtgtaatttctctgtttttttctttttatgctttcaatgacgtactaaagaaatcattgcctaatccatggtcatgaagattttcacctatgtttttatctaagaatgttatggttttagctcttaaatttgagtctttgattcattttaagctttttttttaatatgaggtatgatgagggtccagctttattcttttgcatgtggatatccagctttcctaacatcatttgttgaggagactgttctttcctcattgaatggtcttgccacccttgttgaagatcaatccaacatatatgtgaggatttctttctgggctttctgttctatttcatttttctatatgtctatcattatgccactaccacggtttcaattactgtagctttatagtaagttttgaaatcaggaaaagtgactctttcaactttgttacttttgaagattgttttgattattaggggtcccttgagattctgtatgcattttatgatgggtttttctgtttctgtaaaaaatggcattgagatacagtcaattgtttcttaaagagttttgagcccgggcgcggtggcacacacctgtaatcccagcactttgggaggccgaggcaggtggatcacgagcccaggagttcaagaccagcctggccaagatggtgaaaccccgtctctactaaaaatacaaaatattagccgggcatggtggcatgcacctgtaatcccagctactccagagactgaggcagagaattgcttaaacctgggggggtggaggttgcaatgagccgagatcacaccactgcactccagcctgggtgacagagtgagactccgtcacaaaaaaaaaaaaaaaaaaaaaaaaaagagttttgaataataaagtctattaatttacctatgaagctcccatttctagttttgtttattcccttgtctagacacaaagccattcctttatggtatccttttccttttacctgaaagacttcctttaacttttactgtaatacatatactattgatgaattttttcaggttttatatgtttgaaaagtattttaccttcagttttgaaaaatattttcactgggtatagaattctggggttgatggttgtttttgttttttgttttatttctttcagtactttagagatgttgcccaattgtcttctcagttgcactgtttctgatgaaaagtcggctgtcattgtttcctgtacatattatgtcttttcttttctccagctgcttttcagatttttttttattattaactttaagtaatttggttatgatgtgccttggtgtagtttcttcatgtttcttttgcttaatgtttgttaagattcttgaatcagtggctttctcattttcatcaaatttgaaaaaatttcaatgattatttcttaaagtaacttttcttcacctcacccccacacctcattcccagactccaacttcacttacattaggctgcaaaagttatcccagagataactttttttttttttttgagatggagtttgactcttgttgcccagactggagtacaatggtgcaatctcagctcactgcaacctcttcctcccaggttcaagcaattatcctgcctcagcctcccaaggagctgggattacgggcatgtgccaccatgcccggctgatttttttgtatttagtagacatgtttcaccatgtaggtcaggctggtctcaaactcctgacttcaggtgatccacctgccttggcctcccaggtgctaggattacaggcatgagccactgtgcttggtccccagagataacttttacacctcctcaccttgcttaagtccaaaatgagatctctggtcacagtggggcttctggattatcaagatggataacctaccttgtcaggttctgaattacttcatcatttacatctctcactttcagtttcctctttatttctggtacctagaaacttctctttctttatttctttctttctgacatgcttagtaatgcttttgaacatacttgttatgttttacctactatctctaagtatttatattgagagaacttcaggttatcttggtctgtatctctagagatagatagcagggccatgtctctgatgacaaggacctattggtagagcaaggagcagggtattcattccaacctgggcattcagaaaaaccaataagtgttctatgtgtgtatgcatttggtaagtatttgaaaaaagtctatagccacttcagtttaataatttggaattttgaattagtcttttaggagttaactgatgattactaatctttaacactactgagggtgtcataaattacatctaaatttctttttttttggttaaattcttactgtgggaaccatttggcaactcataaaatattttatttttaatagtcatcattttcagtgaattgtaataaaattcaatggctattgtctcggagatagaggactatgctgaactacgtagtgtgccacagtggggaaaaaccaggctttatggtgagaatgactgtgtttaaattctgattctgatacagatcagaactacagtaagatatcatctcacctcagttaaaatggcttttatcccaaagacagggaataacaaatgctggagaggatgtggagaaaagggaacccttgtacactgttattgggaatgtaaattagtacaatcaccatggagaacagtgtagaggttcctttaaaaactaaaaatagagctaccatatgatccagcaatcccactgctgggtatatacccaaaaggagggaaatcagtatatcaaagagatatctgtactaacatatttgttgcagcattgttcacagtagccaagatttggaagcaacctaaatgtccatcaataggcaaatggataaagaaaacatggtacatgtacacaagagtactactcagctacaaaaaagaattagatcctgtgatttgcaacaacatggatggaattggaggccattatgttaagtgaaataagtgaggcacagaactacaaacgtcacatgttctcacttaatttgtagaatgtaaaaatcaaaacaattaaacacatggagatagagagtagaaggatgattaccagaggctagggagggcagtggggtgtgggggaaggtggagtggttaataggtacaaaaaatatggaaagagtgaataacactggcctttgatagcacaacaggatgactatagtaaaaatcattgtacatttaaaaataacacaaagattttaactggattgtttgtaacacaaaggataagtgcttgaggggacggacaccccactttccatgaagtaattaatacccattgcatgcctctatcaaaatatctcccatatcccataaatatgtagacctactatgtactcaaaaaaaatttttttaactaaaaataagtaaattataattctaacacttcttaacaactcatcataatactcaggacagaaaatatatttaaataaaagttactagactgaagaatacttagaggcttctgaatttctagtatataactgttgagcactgataattccatttattcatccaataaatatatacttcagatgcttgtcatatgtaagatagtatgctagatgctataggaaatacgaagacatatgaaatagagtcttttacccctgggagtgtacagctcaggtagggaccagtgagacaaatacacaaatgagtgtagcacagcgcaatatgagagcagtgacaagtatgttacaaagaaagctgcctactggggctattacttacttctgagcaatccagcttctcactttggtgtggcaaggagtgtttgaatgacaagtagcccaagccatagcctaggcaacacgtaagacctgtttctgaatctcataatccagttgttctacctccacccaatcgatgtgtaaaaatttctagttactttgatgtgtcctcttagatttagcaaagggaacctctacaaggacagtatttgtagaatacaagagaagttccagaggcacatctacaggttatgagaacaaatttatacatgaagtgttaaccacaatacctgggattttctaaaaaatctgataatatagaataatatgggggaaacacataagcagttttctctctcaaaattggagatgactctgaagaggacagttggagaggcaagtataaaatctgaggaacagataagaagaaatgataaccattcaccaacaactaccaaacatacaagaagctatgaccatgataaatttgggaaaattcatcctgagccacatgcccaagccagcccatctgtcaggatggtcagagagagctgtgagtaagggaaagaacacacaacaggtgccaagatccctgtatttgatggcctttcatatctcctacagtctgttttacaacagagctgtttaccctcttttattataaactgtatttgtgatcatagggcttccagctgtgattgcttttagaaggtccgttttttacgtgtacatagtggcataacaagtcattcctgcccagccagtcaatttcaggctcagattgggccagccattttgtggatgagctatgtctttttctttaattgttgctgtaaacaataagtattttatgcctggaaagataatttatttaacatatgcttattaaacacctcccaaaactaggcagtatgtggaatacagagatatataatatagacaagttccctgcctttgtggagcttacagtgtcatggggtagtttagcattaaataaataattatgtgataattaattacaattatggtaagtgctttaaagggaaagtacagaatgttgtgagaaactttaatttgaaaggatgaagtcaggaaagtaaggtcaaattaaaattttaaacatcttgtgcatttcccccatttaaaatatagaaaggtaagattactctcatagttggttgattacattcaagagatatctaaatttgaaaagatagacttatccacagaggcataggattcttaggagtttaatccttggctaggtgtggtggctcatgcctgtaatcctagcactttggaaggccaaggcaggcagatcacttgaggtcaggagttcgagaccagcctggctaatatggtgaaaccccatctctactaaaaatacaaaaattagctgggcgtgatgtcgggtgcgtgtaatcccagctactcgggaggctgaggcaggagaatcacttgaacccaggaggctgaaggtgcagtgagtggagatcgtaccactgccctccagcctgggtgacagagcaagactccccctcaaaaaaaaaaaaaaaagaagtttaatcctttaatcgatgactgaaagggtagacattatcaggtttaacatgatttttcatattttgtagtataacaattaccttcaggccagcaacatctaattctttctaatttttatttgaaagattaggaagcaatgaaatgttcctattcataccagagcttttaggaattagttgaattattggaactagaagatgtattaggcttcaggaataaggccagtcttgattagctatctcacctaagagaatgctgagcatatattcagccttgagtaagcatatattggggagacaaaaaagtgagaaattaactatatgaaatttccagttttataggtcacaaatattggtggctttatatggttctgcctaataaataaatgaccaaaaagggaacctacactctagtgtagacaggtgtgggtatttattattaaagctaagtatatgtatattggctatacttctgaatataacaaatgggaaattctgttcatgaattaacttttaattttaaatgaattcgtgatttaaatatgggcagatggtataatcatttcagaagctaaaaatattctaagagattttcaacttagataacttttgttattcacacttcatgagtgtgaatgtaatggggaaatactaaattggtaaccagagctttagtggtgtggtgtggtgtggtatggaatgaggttaaccagagtattttgcttttggcctctttctacactgacccagggattacttcctagtctttgttctccctcccagtccttagttccaatactgacagtctccaagtttatctcagaaaaatcaggagaaaaggagaagagaactaataatgaaaatgaactaagtgccaggtcctttgctagatagtttgtatattattgcacttaattctcacagtgaccctataagacaaatattatttctgttttgcaagtgaggaaactgagacctggagaagttaaataacttatacaaggtcacacagtttgtagagttaggattcaaacattcttatttccactatgtaccatgctgctcatcttattgtttgtttgcttatttatgtcctatacactttaaaagtctcttatttaattataagttcatataggaataaaaaagggattaccattagttttttttctcttttttttcaaaaaaaagtaatatgtcaaaaaatatttgaatctttttctttaaggatgaacgtgaagccagagaaaatgtgaagagagagcaagatgaggcctatcgcctttcacttgaggctgacagagcaaaggtaggcttggtcaagtacttctgggataaagaactcaattgttcattatttaaatgccaacctttatcactttgatccctaaaaatactgggtttgcaatagagaaagctagatttagttaacagaaagaatataatcctatccatggttattaaagcatggttcattttgacaaaataaagtttgtttcatgaaaaatgagaacaaagatgaacctagtatctatctcatttgtttcttagttggtctatgatagaaaccagcaatttttggaaagctctttaggtgattctcatgtgcagtcagggttgggaactattgatttattgaatactacttaagcacctgcttctgtgttgagctttgaaggagagagaagtgaataggccacagtttctgctctcaaaggaagtttcacaatgtggtagagttgattaagtaaagaacacaagtagctgtaacataagccaagaatcctaaatgtcctaagggaagcactgagttctgtgagagttcagtgagtaggagtttcagtggaaatttttttccaggttttttttggagagccagggagtgggactatactgggaatgtttcaaagaagagatggtatatgtgaactggacagagaaagagcagtaggagggaagaggaaacagtataagctagcatcaagggtccagaatgcatggaggatggatagaggctgattaaatagctttagatttgggtacagggtagatagaaaaggtcagaaaggaagaccaaaggatgtcctgaaggatcttgaatgccactttacccagagctatcaaaggtatttgaataggaacctaacattatcagagacctatgctttgtttttgctttcatttccattcttgttctagaaacatttccgttaccacaatatacctctgagtcatgttgacaatgagcctttgaatgtcacatactctttctttcctcttttcttttttctctttccttatttctctctttctttgtaaacaagtatgtgttaagtgcttgttccttttctgttttatcaacagagggaagctcacgagagagagatggcagaacagtttcgtttggagcagattcgcaaagaacaagaagaggaacgtgaggtggggcataattttaagaaaagttattcaaaagctgggttgtatttccactgtatttgatactgaagctgttaacctaccttccttccttccttccttcctttccttccttccttccttccttctttctttttccttccttccttcctttttgagatagagtcttcgctctgtcacccaggctggagtgcagtggcaccatctgggctcactgtagcaccatctcggctcgttgtagcctccacctcccaggttcaagtgattctcctgcctcagcctcccaagtagctgggttgacaggtgcacaccaccatgcctggctaatttttgtatttttagtagagacagggtttcaccatgttggccatgctggtctcgaactcctgacctgaagtgatccacctgccttggccttccaaagtgctggcattacaggcgtgagccaccgcacccagctgcaaaactgttaatatttcttacaacttatttctctctacttttcctagactcattttagtatggaagacctaacgtttccttaattattcctgatctgttgtatggaactcttagaaaacttgatcttgtactagattcatgattttctataatctttgccttttgttgccaacaaatatttgttggcaaatatttctcatccttcctgcatattgtttcaccctaagaatagaaagattgtatctcttctcccttccacagtcttcactttacccaccaaaagatactgtgagttacttttgtaacatcttgcattgagctcccaaatatgggaaattcatttagcttcattgattttttccatgagttcatgtcatgtccatagcaatatagaggatttttcttcattcactcattttgcaaacatttttgggatatgtactatgtgctccaaatctgttagggaacagtgatgcagacatggatcctgctctccaggagttcctactcttataaaaatagaattataatactgtatgtaaacgttattatagaggtatgcctaaggtgcagtaggcacaaacagaatgggggtcaaatgacttcctaggctggcttcatagaaaagaacattcagaacttttttccagatgtaggattaatggcaagattcacttataaaaagaggaagccatctaacaagcaatggaaaggcctgaagggccctaactggggttgaggaaaactctgttagttattactctcagtcaaagtatgacaccactttcacttgtttaacaaatgttttttgaagaagacctgtgctgagcactgccagggaaacaaaggataataaaacgttttctgcctataagaagatattacatcttagagggaatatacagcctgtctaggagtaacagcaaatcaagaaaaaatgtgctaaatgacatagaaataaaagcaaaatacttagagagttcaaggccaaaggaaaaatcttttacagctgagataatcagacaatgtacagatgaagtaatatttgagtcaggtcttaaaagataagtgaaacttaactgtttggaaatcaaagtttattcatgtcaaaactgttgtgagtatctatcacatatatacaagatattatgcctgacaaaccctagtctgcactctgaggactgtcaataatggaaggtagaaaatattttgttgaatgtcttctgtgtattaaatagtttgctagctgctttacgtatgcttatcaattaaccattaaaacaagctacaaggttagagatttatctttataagtgaaaaaaactgaagttcattgaggagttacacatacaaaaatgagaacagctgagattctcatccaggactttatgactataaagctgtttctcatactccattccagtacaaaaccctatatcattgtgtccacaggagtcatatatgccaagtttcacaaaagtttagataagggagaaattagtcactatccttttaggctatttcaagaaatatagtttaggattcttgctcctttatgctgtcgttcacacatgcacacactctctagctctgtgtgtgtttgtgtgtgtattagtgtatcgtcaaccatactggcttgctaaaatgtcaagggtacacaattaactcagtgttctggatctaaagcttggcagcgtatgtaatttcatctgatgatttatctaatttaccatgagctgaaactttctttctttccaaatgtagataaaagcccatcatcttacagaagaccctataaacataattcagtatatgcattccagctgttaacatgtgagaggttggggtacagtgggggagaggacaggccatattttgcacctagtcattacttaaacttttctattgatatgctcccataaaatgcaagtttggataatactatgcactctattctcccttaaccaagtgtcacaaaggctcttataaatcccaccattaagaaatggtttattttcatttagtccaatcttatccaaacttatttgccccttttttaaatggaacaacaattaacatatcatggcaccctagtgtatcacaaaccactgtttgggaaaagctggtattgtgcaacctctgaagaaactgagacccagaaagattatatggtttacctatggtcaccaaactggttgaacacctaatctggatcagaagccgggtcacctgacttttcacagcaacactacctgtcttctaactggaaatcctaacccatataattacattgagaaacaagagtggttttattgttttgattatcttcaatattctaagatcctttagaaaaaagaagtattgaacagtaaaatcaccttggttgcagggaaattccttaatggttagcctcattttgctgtgtgataactgttggagtgaaatcaaacatctagaaaagtatattgatctggtcattggccctaataaggagaaaggctgtaagactattctgagggaaaaacaacagcaaagatctcctgttttattaatttatatatgtacttattctttccaaaatcagtttcaagaaacttacatgaatacatgcaattcaaagggattaagaaagagtagatatagaaataaaggaaaaggacaaaggaagataatgccaaagataagactaacatgttgacaacagataatctagcacaagcaccaaatccatgtgatagggtgctgtacatttgttccataaaatctgttctatacttatcttgggccaaaacaaaggaaaatatgatagtttacaagttttactttgtgcgtaacatcagatctgaaggctagtttctcagaatttttccacattttctagcaatgagattttagagcaacgtttcctatattcctgttcaagaggaagctgtgcaatgtagtgaatactaaccccaactatatctaatagctactgtgacaatggcaagttatgtgtgacaatggcaagttatgtatgacagctccttaaaactttttaaatgtaattctaaatcataaggctaaagtacaatatagtaaaatcatccctgcaaaggcccaaatactacattttttctgattaagggatggactttatagtaactagagaaatgcgtgaaatatatatactccaagaaagccttcctgagtactgcctttttctactgagtttttggtaagcagagaaattttcagctaaggtttttgagtctcagatcttttattcactcaatatttagcaaatatttagttaatctccttctgtgtgcaaattattaaatcaggtgctgtggacattatgctgtaggtgcgaggcatagtccagccctcaaggagcttactgtctaatgcaagagggtagacaaatgcaaaatcactacaggaaaagataccatacattataaaaaccactaaaatagcacaggatgtttatttggaggaagctgatatctaactaggaaggcaacaagaaagacttcacggtgcgcccgtagagatgtgaatttaaaaaaaaaaagacttcacagactttgatggttaaagatgaagtagaagagcattttgtctggactaatgaatagatggatggatggttggatggacaccaaagggaagtgcaagagtagtcatgaacaaaaggggaacggcacagggcttgctcagggaacagtaaatgaacaaacttagaacacagtcgaattattagagctatggctaaaaggcctgaattttggcgaatcttgggtgaattaaaatagatactaagctattcccttttgctgatggttctctagaaagaaaagttaatttttgcctgtctacccaaactgtttccttttatgccttcgtgccaccttaagtagaaaatattaagtaatattaatgactactaagtgggaaaacagaagaacatggaattagaaaccttggcacttcctcttcagttttctgtttcacctcacaaccactctacaaaattggtaatatggtttgactctgtgtccccacccaaatctaatatcaaattgtaatccccacatgttgaaggaagggcctgctggaaagtgattggatcatgggagcgccatttccccttgctgttctcatgatggagttctcacaagatctgatggattaaaaatgtggcacttcctccgttgttctctctctctctcccctgccaccatgtgaagaagggctttgcttccccttcgccttccaccatgattgtaaatttcttgaggcctcccagtcatccttcctgttaagcctgtgagtcaattaaacctcttttcttaataaattacccagtctcaggttgtttttttgtttttttggtttttttttttttttttttttttttttttgagacagtctcgctctgttgcccaggctggggtgcagtggtgcagtagcacaatctcggctcactgcaacctctgcctcctgggttcaagtgattcccctgcctcagcctcctgagtagctgggactacaggcacctgccaccacgcctggctaattttttatatttttagtagagacggggtttcaccgtgttagccaggatggtcttgatctcctgacctcctgatctgcctgccttggcctcccacagtgctgggattacaggtgtgagccaccgcgcccagcctcaggtagttctttgtagcagtgtgcaaacagactaatacaattggtaaggatgatattattattactgttttacagaggatgaaagtaagattatagcaggatttaaaaacctatttttggccaaacacagtggcacatacctgtaatcccagctacttgggaggccgaggtgggaggatcagttgagcctaggagttcaaggccagccagagcaacatggcaagaccctatctctatttaaaaaaaataataataataataatttcttttttttattatactttaagttctagggtacatgtgcacaacatgcaggtttgttacacatgtatacatgtgccatgttggtgtgctgcacccattaactcgtcatttacattaggtatatctcctaatgctatccctcctccctccccccaccccacgacaggccccggtgtgtgatgttccccttcctgtgtccaagtgttctcattgttcaattcccacctatcagtgagaacatgtggtgtttggttaaaaaaaacaatagttttaaaaagatatttttaagcctacttttaaatttttacctaacgtataagcctgataaaagcagaaccagagcttctatccagtattcattctacttattaatccaaattcaaagaatgaaggtgggaccataaattggttattaaggtaaaactgctctttataatttgtatttttatcttatgtaagttgcttttgtccacactgggccataattataatcatccctgtcatcatcatcattggcattatcaccactatcgcacaattaatatgtgctaaactcagtggtgatcactttataggcattaattatcttattgaatttttacaattcaataaggtaggtgccaatacataaatataccttattataattatggagactatatatatatgtatatccactatttcttcagtactttcagtttgaagtgttccgttgttctcatgaaccattaaaacagtccagaaattctagcttcatggtgtccaaatcacagcctacagactgttctttatatccagaagcaagcaaaaatcatctatttgaattttgatttaggaaatatgatcatttgccttacttactttatccagaaatgaggtcatagtagtagagtagtaagctatccatactctccaggttgccaggaatagagattgactgcagaatcgggtcaaatcaactgtctctatatgggatccattctactcctttggtgatctcatccagtattatgactattatattgactatattatatggctatattatattgtctatacgtttgactcccagatttatatttccagctcctccctttccctgaactccagacttgaatatctaactgctggcccatcatgtctacttagatgtctcatatacatcagaaacttaatatgttttaaattgcacaactgatcctaccctccccacccaaacctgctctttctgcagtcttccctatctcagtaaatggaaaatctttccagttgttagagccagaaaccttggaattatccttgacttatctcgtttacatccatatttaatgagtaaatcctgtgggctctgcaaatatatgcagaacttaaatgtttaactccaccactatcaccctcatctaagccaccattgtctgttatctggattactttagtagcctcccaacttgattccacatctccatttttgcctttcctatagtcttaataaatcctttaaaaatcatttgtcacatcatgtcacttcaaaaacttgcagtggcttacatctcaaaataaaacctgaattcttacagtaattctaatcaaatatctacaagattttctatagagattgataaactgattcttaaatttatatgaaaaagcaatagaactggaatagtctaaacaattttgaaaaagaaaacaaagttggacgttactagagtgcaggacttactataatcaagacatagtggtatttacaaaaaaaaatggacccatgaatcaatggagtccagaaatagacccacacatatatggtcaattgattttcaacagagatacaaaggcaattcaatggggaaaggatagtcttttcaacacatgatgctgcaacaattgaatatttatatccaaaaaaaatcccatagaaaaccagttttaaaatgcttcaattcatatattgcatcacaagcaaaaattaactcaaaatgggtaatagacctaaatgtaaaatctaaaactattcaagtcccagaagaaaacgtaggagaaaatcttcatgaccttgagtcaggcaaagatttcttagatctgacaccaaagacacaacctataaaataacaaatatgtaaattagactttatcaagattagaaacttgtactatttataaaatactgctaggaaattgaaaaaacaagccacagacaaggggaaaatcatatatctgatgtccagaatacaaaaagaactctcaaaactcaataataagaaagcaacccaagtattaaaatgagcaaaatatttaaaagacacttcatcaaagaaaatatacagaaggcaaataagtgcatcaaaatatgctcaaaatttttagccgttagggagatacaaattaaaaccacaatatatgtacaccttttagaagactttttaaaagaaaaagggacaataccaagtactggcaaagatgaggagcaactgaactcttacacattaatgacgggaatgctaaatagtacatccacatccactttggaaattagcttgaaactttcttgtaaagttaaacatgcatataccatatgacccggcagtcacactcctaggtatgtatttacacaagtgaaatgaaagtaacagtaaactgctttcacataaagcagtttacattcatacaaaaatatgtatgaaaatgtttttggcagctttatttgtagtcatctaaacctggaaacagctcaggtgtccctcaactggagaaggggtcatcaagctgtatgtgtatctatacaatggaatactactcagcaataaatagaaacaaactactgatatattcaacaacatggatgaatctcaaatatattatgctaagtgaaggaagtcatttatgtaacatttatggttacatttatataacattctggaaaacacaaaactaggatcagaataaagattagaggttaggagctagggatgaagaaatttgaacggggagagaggtaatagaactcttctttgttggtgatggtacttatgcaaatatatgcatttgtcaaaactcacagaactgtacatttaaaaggatagagtttgctgtatataaattataccttaattttaaaataggaaaataattattaattgtccttcccaaagccatatatgatctaatcacccctctcctttgtttccactgtaactttaactcctacccctctccccttgctcattccattcccgccacattggctgccttgctattcttcagtcaagccaggcacctgggccttgctacttactgtgactcctgcctataatatacttcttttagatctaaatatccatgtggaaccctctttcctttagacctttgcttactgaggtttacagtatttaaaattttacccctccccccaccttctaccagcattccctgcactccctccatagcactcaccactttgtgaaaaatgatatagtcttgtatcacctaaggatgggaaaatgtgtcattggcaattccgttgatgtgcaaacatcctagactttacttacacaaacatagatagtatagcctgctacacacctaggctattatatggtataacctgttgctcctaggctacaaatctgtacagcatgttactgtattgaatactgcaggcaactgtaatacaatggtaagtgtttgtatatctaaatgtagaaaaggtacaataaaaatgataaaaaggtacagtacaaaggataaaaaatgttgcacctgtgtagggtacttaccatgaatgaagcttgcaagactgaagttgctctgggtgactcagtgagcaagtggtgagtgaatatgaaggcctaggacattacattacagcggactttataatcactgtacacttaggccacactaggtttactttttttcttttttcagcaatgaataaaccttagcttactataacttttttactttatgtaaacttaatttttttaactttctgattattttgtaatagcttaaaacacacattgtacagctgtccaaaatttttctttctttatatccttattctataagtttttatctattaaaaatttttccttctttttaaactttttattaaaaactaagatacatgcacattaggctaggcctacacaaggtctagatcatcaatatcattgtcttccatattcacatcttgtccactggaaagtctttggggcagtaacacacacggagctgtcatctcttattataacaatgctttcttctggaataccttctgaaggacgtgcctggggctgttttatggttaacttttctaaaaaatacgtagaaggagtataccttaaaataacaaataaaagtatagtgcactaaatactaggcaataggaatttttcagctccgttataatcttacgagacctccatggtttatacagtccatcgttgactgaaaagtccctatgtggcacatactatcttttcttatgtgtgtctttgttgtctttatccctaccctactagaatgtaggctccatttaggcagaattttttatctattttgttcactgctattttgccatcatttagaacaatgcctgactcatagaagatgctcagtaagaattcatggaattaatgaatgttagctttagcctatttaacactgtgcctcagccagctataaaccgttatttatacatactcatagaaacctagaggttgttttgtgtgtatatatttatgtatacatctgtgtatataagtaaattaaggcagtctttgattcttattgtaagagactgttgtaagtgtgtattattctttctgtttaaaaaatgtaaccttgtagtgacagtcttttgtgggtatctattttcactgcctaatttcacttcaaaaaatagccccatttctcatccctcagatatgctttaaatactcacatatttttagtagaaaaaaaagtaccagatcagttcatatttctaacttataccaggtttccttgttttattacaaaccaaaaataatgcaaataaactatatttgttgagcaaatcaaactgaagtttaacactggtgttaaccatgactcgtttgagtgtaggtgtcctttatgttgttgttttacaacagtgtttgcttacaggaggcccttgctcttagccagtatgtttgaaactgaactactgatgtatttttgttatttttttggcagtagaactgttggatattcaaatctcaaggttgctgatttacctcgtatctcttcattgttttccacattggtccattggtgtgggatgtatgaggtctgttttctttctggggaaaagccctggagactgtatacattgaggagcagacattgtctgtataatgaatgaagtaacgagctactgttgtttattcttctgtaatataattggttgaattcagacaataatgtagcatctgttatactatgcagggaaatgtcaaaacagaaagcaagcagacaggtggattaaagggagaaaaggagagaaaaccaagaaatatcacattaagttctgatttaaagtaggcgaaaaggaataatcataacaaaaatgataacaccaacagctgtcatatgttgatcacagtattacatatagcatgaggatcaatgctcagcacttgtcactgagtgctgaccaagtgtcagcatttgctaagtggcgtcagggacagcgccaagatggccgattagaagcagagtctcccatcaaaaagaaccataattagcatgtgaatcctgcaccagcaaccaagtattcaggttctctcatcagaactgactaggcagctggcgtgatccagagaggaaggtagagcagtgtggtgtggcggcccacctaaaaacattctgcatcttatagaaggatgctgtgaggaagatgttatcggctctattcctatgaggaaactgaaattcataaagactgtcatttgcctaattcccaggatttgaacgcatgtctgtcataccccaaaacctatgtttctaatcataacattgcatttaattaaaattttttaaactgcactgtcagaagtcagaatactgactttgaggggaggtagttcccaggaaagggtatgcttctgagatacttgatcagagttgtagttttacagatatgttgactttgaaactttatcaagttgtacacttaagatttgtgcactttttcatatgtatgttatactttaataaaaactttaaaacaattacaaaatacatgattttgaacagaaaggataaagctttatacaatacaacactgactcaaattttgaaaaaagtttcaaatatataaaatatgcctgaaaaattaaggaagagtatctgggtgatgaaaaagttttggaaataaatagtagtgatggttgtacaacattgtgaatttacttaatgccactgaattgtacatttaacaatggttaaaatattttaaaaattagtggatataaactgatggtgatggctatcttgatggtgaatctacagattagttttaatgttttacttttaatctgttttttcaatgaatttatattacttttgtaattgggaaaaatgttttataatctcaaaagatatggttgtaaagaaccaccattgtggccaggcgcagtggttcacacctgtaatcccagcactttgggagacctaggtggatggatcacttgaggtcaggagtttgagaccagcctggccaacatggcaaagccccatctctactaaaatacaaaaattagccaggtgtgctggcacgcacctgtaatcccagctactcgggaggctgaggtgggagaatcgcttgaacctgggagacggaggttgcagagagccgagattgcgccatcacactccagcctgggcgacagagtgaaactccatctcaaaaaaaaaaaaaaagaaccaccactgtaactgagaaatagatgatcccattaacagtttagaaaatgtatataactctaatccacagaggtttatacttacaagcaactcatggtttccctttaagggacacatgtggaaaattaatctgaacagttagtgcaaggaggagtcatacctcagagaaaggagaagatgtttaattcttagttactagaagtagaggctatgagattcatattcttctagcatttattgaacacctagtacgtgcctacaatcatactaagcacttttacatatattatttcagttagcatgttagtttattccttcccttccaagtgcatattgagcatctactttgtgctatgcactgtatttggaatgagaagtaatacatgctcccatgccattatggagcttgcaggctagtaagaaggccaggcattaaataaataactatggtactaaatagtgaatgctgtaattgacatatcaactagcatttaattttgatatacacagatgttaatccattcactgggttactaatatatgataatgttactaaaatagtttaatatttggaaatactcagctgaaactcattgctgtcgcagaacaccaatatcaggtaaactgctactcatgctatcagaaaaaagggcaaaagtgactgaaaaaaaagcaaaaatatatttttaactgtatttcttatgtctccatttctgggcatcaatttccccatataaaaaatgagagtattgggctgtttgacaaatgcagccccttccagatctgatattctgtgcagatctcttcattataagaaaagcagctatcactgaagcctattatgtgtcagatgccatactgaaaattttatatatatatggtctatataattcccatctctgtaatcccctataaggtaggtggttattcagtgcctccagaaggaaagtaacctcagtcataggctagactagctttgtctatacattgcagaaattttgaatgatttaaaaaaaatagttcagtattagaaccaaccaaattcacctgcgtgacacacattacctaatttcttatccatacttgtgtctgagccaactttttctggtggttaaacattttttaacagataatttgcataggtcaaaatagaaagggcatatgcagaaaacacccgatggcacctcttccaccttggttcccctaccctttggagggtaccatttttggttctttttatttggggaaggttattaccttccaagaacccgcttataagccgaccaggtatatatttcttttttttctaaattatttctttatactgttattctcagctttccttccacttattttattggttttttttcactagcttttaaatttttttattaccagacactgataatttagcttttaaaatctaattcttaattcacttatttttattctttaatttataatggcatacgaatgttaaggctgtgaatttcatcagagcactgctttagatgaatttcatggattctaacatgaagtctttctcagggttctagacaaaaaaggttttagtgatttttatagattccaatgttgttagggacctcagagacaatctccttctaatggaatgtcacatgtgaaacaatgtaatactaaaacctggattcaagcccacgctagccatgagaccttccaacagtttgcttcacctgcttaagtcaaatgaagggtttggtccatctgtaggtccagaaatcaaccactaagatttggccaaatcccatagcgagttagtggcaaagccagaactaggactgtggtctccttctgccaataaacctgatatttgaagttctttccattttttaaaacttttcttttattgtggcaaaatatatatacagtaacttgccattcttaagtatacaattcagtggcattgattatattcacagtattgtccaaccaccaccactatttccaaaatgtttcatcaccctaaacagaatttcctcattccattttgacataaacataataatccagtattctgcagttacttctacttgtatttctcaaatataaatatatctctgtttgtgtgtgtcttttctgaatgcatctaatagctttaattcataccctagaaaggtatcaattgggtatttgatatgaatgtctttgatcacaaatatctgagcccttcagttaaaaaaatgccttttctgtgtagtttcctatatatttaataatatgtgtcatcaaggtggaatttattttaattacttgcctattggactaatattaagaaaatgaaaaatacattattctattgttcaagcatttggcttggctaataaatagggcagtgacttttcaatgaatttctagaaaacagcagctttttttctggtgtcttcctccccactctccatagtccagtccttctcacattttaacacctggtttttgctctccctaggccatccggctgtccttagagcaagccctgcctcctgagccaaaggaagaaaatgctgagcctgtgagcaaactgcggatccggacccccagtggcgagttcttggagcggcgtttcctggccagcaacaagctccagattgtctttgattttgtagcttccaaaggatttccatgggatgagtacaagttactgagcacctttcctaggagagacgtaagttcccatacctatctcaggaagtatatccaggtgggagatgtgccatcattaaagctgaacaaagtagttcaagaaaagtcccatggtgcaggcaactacaagacaaacaggagtccttctttgttctgcacaccattctctccttagcttttggagaaagtatggcttcccaggccagcagatatgtacccagtagcctatgtaagaaattaggtactagatcttccttcctagctgttttccctattccagcattccagtctttgctgatgtctcatctgtattcctcaaatgagatatatctgtagccctcagaatatacctgagaattgtatgtttaacagcttaacagttagatatcagggtcaatgaatgtaggttcactaagaatgagtcatgcaaaacaaacagtgttttgtgatttgatagtcttactaccctgggaagttacagagggtgacctgtattcactgtgtgcttgcattacagcacaatatttgatagtctctcatagtattctggggcaaagtagagagatatagatgtgttagattcattgctgattaaatggttgtgtccaaaaaatgttaaccaccatttccttgtagggaaccaagaggctctgtatttaatcttttattacttaccatatttgttggcaacctaaatgaagactttatcagatttatagattatgaaaaataagattcaagaaaaacttaaaatactgaaacttacacaaaatgaagctgcagaaatttcacagaaatgtgtagaaatagattcctttagtagaggttatggtcgaattaagctgaatacacgttaataacgcgttgtggctgccaacaaaaaagctagctcctgttttagaggtgtaatcccaaccagagattaacttaatggtcctgtttaactctgcactaagataaactacccactgggtgatgggtacaccaaaatctcacaaatcaccactaaagaacttactcatgtaaccaaatacctgttccccaaaaacccatggaaataaaaaatttaaaaaaaaaacaaactacccctgaaatagtctttaggcttcatgctgaaaaacgaagcctgaagaaataggagcatgtctggagcagggctggtaggaaggtgagggagctggaaatcatgtcatttaaggaacattacctctaaagaaggaaggaccatgagagatgtgattgttgtcttcagctacttgaaggcgtgccttgtaaaagagggatctgattttttgaggctgcaggggcagaactgggaccaatgagttgaaagttacacgagacaaatttggcatagtgtaacaaagcattttctaagaaaggaatatcttgtgtcgtgaagtgttaattttcctatcattggagattaccaaatactactcttttcagtaataacagatatatatatggagagggattcatctctggtattcctgctttatatggaatgggacttggacttgcttagctctgaaatatacaataaatcttctgtgattccattgtgatctaggtatagtaacctagcataccaaaacccagagtttcattaaggtacatctaagtccctcacattggctgtcaggtttgcaggatagagacagaaactagtaatatcccctctgggtggaatgaggatcttgccacttatttctaagcccaggagactgtagtggatcccaggtgctgactattgttccttttctcactggccctgcctactgctccaaggtcatcccctttatttgtatataaggcacacaaacatgcacaagggaacacatgcctgcatatgttcttaccacacagccaagtatgaaaactaccttaacttctgtcactgaagttgaactctcagtgtgtgaacatttaacaaagaaccattatcaaagtgttcaagatcagccttgttctcatacttaatgttttgtaatgaaattttcccttcaaagaccttaaaaaacttagagttaagtttgcccttcccaacccttagttttaagtcactccctttctgaacgggtctcatctttaaaaatggaagtactgaaagaaatagagtttaaggactttgcattttaaaattaaactttattttctttcaaattaatttttaaagcttattactgacagggatggggtgaaaatatcttaaaaggagctaggctttttgatcattattaagaacctctttccacagggtaaaactctggactgtggaaagttgctgttgaaaggaaactggggaaatgtgatgtgaaatgtagagtgttcttgggcctgctactatctccctgtggttgccagcatagtgcttcatatataagcatcagtaactgttgttgaatgttaataacctcaggctcccctaatctctggttccagaatgaacagaggctggtccaaatgagaacagatgctctaggcccacccagattccagacctaaactaagaaagcccacccaggactctttaggcctcctagagccaggggtggggtgagagttaaaggcccttcattcttctctgaattctctttcaagtcaaatgactagtgtttttgcaaggctattctgtaacagccatctgtgtctgcaaggattaggatctaatttgtaaaagtcatcttaaattacagccaaactaaagactgttaaaaagcacatcttaaggccttgcctctttaataacaaataatataagccttaactctaggagtcttaattgtgtcttcagccttttctccacaaagcagagactggtttctcagcagaggacctggtaagtgttcttctgtacctcccatgcctgccacccgcccccaaccaaaacaatacttcatgttaagatttccgagctgtctaaccatttactaaatgtctgctgagcataattccctgaactgagcactgtaggacaaccaaaatagccgcagacataggccttccccagaaaactgattcaagttgtggaagcattgagttacttggttttggggtttgtgtgtgtgtgtgtgtgtgtgtgtgtgtgtgtgtgtgtgtgtgtgtgtgtatgttttccccaattttgctaataacagttactaagagaaggaatagtatttatttccagagctctacctcctggacatgttagagccgtatgtacatcagtggcccatttgccttacttgggcattgccttggaaatgaggtagttgagtcctaaaagctgagtaatgacactcaccccactactcctcctgtaggccaactcctgtctctgagttagagtaagggattgctgccagctcccccagctcccctccagacctacggtagcccaaacataggcccttcccagaaaagctgattatcactcatgccacttggtaagaggttgtcagtatcccccagccttcctcctctgtgccacttccttatcttccgttttctctcctctttccttttctaccccttcccttttttccaatcctattttacctgttttatcttctcctccatctttccattcttcccttctccttatttctttatcccacaactcttctttctgcctactctttttccattttttgcctacccatatccacatccctcagaggagctctgtctacaattggaaagtgagatctttcaatttataaaatgactggaaagcactaggaaaggaggatgaggaatggcagatgaactctaagagtccactgatagcccatatgtattgccactgatataatgacacagcccctgttctagcctagggaacgtgcctttttctagatctatagatatgaatccccaaacagacagacatgcattcaggaataaactgttttcttatattttatatctaaaacaaagtaatgagggaatttatattttgccccagctttctaggtttttatctctgtaactataactcataatttttgtttctccctctaagacttaaaggaacaggagaatgagtataatcaagctccagcatggttttcctagagtagaccttcagtaaagttttgtttaaatgtactgggggaaaagcctttcaaatttggggtatacaaattccttcctctgtcacccatccacttttattatgctaagcaccaagctaaacactgcaaacacagtgaagaaaaacaatggcatagatctcacccttgtagaatttacagtctgaatccagaagctacatctagatgaagtttgacttgacttcatcgataacacatggatactatttgccaccataaggagatagaagcagtttaattcgcatttaattcatgtattctctcattatagcaaaacatttgctgtgcaaccgctcttgtttcagccttcataccaggtgctggtgatacagaaattttaaaaaaattgttactgaccttgaagagttcacgttatagtaaaaacacacatccaaaacaaattgcattgcaaattatacccacagttagaaggataagtaatttcagcaggctgtgataacggaaagtattataaaggaagttaattttacctgagccttgctcagagagatgttcagtgagtggaagcagaatagcaaagtcagaagtaaatggttcagtggtagttagtcttgcatgtgaatcccactccatcatactgaacattggacaacttacttgaccctgctgaacttttatttctgcatctttgaaagagaaatgataatatctgacagggttgtggtaagcgttatattaagtgaatataaattactatattcatagcacataaaacagtatctgctgtaataatactaaatagagagaagcagaagaggtaggaagggcttacagttaaagaaaatgtggcagcagtgaattctttctctagaacagtgatggatatcaaatttgagttacaaatatctagctgtaacccaggcttaagaatatatcattgaaatcttaatatctgatatttgcaaaggatctcagagatatgaaggccaatgctgccactttactggtgggagaatcaagggaggtaaaattaagcacttaagtcacttgaacaattataaaagcagagctgatactgacatccaagttttcttatgaccattgctttttgagattattgagtccttttaaaaactgttaataaattatagagttccattttaaaattagagtcatagaactagaaaaatcaacattagagaccacctagtaaatgcaataaattgcagctgcaagcaccagtattttaaaatattttgtactacaaaaaccttcctatggtaatacctctaatattgcagtgggattgattttcaatttatattagactaagttttatttttttaaaaaacaagagccagaaggaaaaactttaatgcaattgaatgactgtatcttaaaagctttgttctcaaaataagccaagatgaagcatctaattggtgaaatacatgttaaaggtactactgctgagcttgttccattcccctcagttattttatgtcactatatctggttatttgaaatttttcagtatccctaaataatcaagattcagataaaaagaactatgattgtgtaatggaacacaactagtatctagatggtcgcaacattaattttgcctctaaacttctctcaaatctgttcttttcttctctttccctctataccactgcccaagtcgtcatagcccaaattaaacctatggcttcctaattcatctccctgcctccagttttgcctccccacgtctatgctccccactgtctcttgagtgatttttttaaacggctttgatgatctctgtctctctcctgcttaaaagcctccagtgggttctaatggcctgcagaaaaagtccaaactccttaccatggcatataaaatcttcaaaatttcacaccgtctccttttctcacttcttctgattacctcctcagcacatgcatctcatcattaaaccacaataaactgcttgactgaaagaaacaagagacctcactaaggtacaaaatacattcacagaattatcccactcctcttctgtcagctttgggggataccaagacaggtgtggtgttaatatcattcagcagatggggaacatgaggtcttgacatgaaattacttgcttgagagtgtacattcaattaattaatgaccactgaggactgcagcccaggcctcttgattggcttattttcaaaagttttgttgtaaagaaaactggtcctggattatttgacaggacacctgaatttttaggtagaagtcatttgataaaaactgtttacataatatttacaacattcaaaaaaaagtaaatagcaaaaggtttaaaagaataatacagctgctgcttaaataggtctatatatgaaactctaatctgacacaacagcaacctaattaaagggaaaaatactagcaagggcagtttatatttctttaggttattcattttgtttaagaaatttattttctaaattgtaagttttaaattttttaaattttaattgttggccaggcgcagtggctcatgcctgtaatcccaacactttggaagtctgaggcagacagatcacttgaggtcaggagttcaagaccagcctggcctacatgatgaaaccctgcctctactaaaaaatacaaaaattaggccgggcgtggtggctcacacctgtaatcccagcactttgggaggccaaggtgggtggatcacgaggtcaggagttcaacaccagcctggccaagatggtgaaatcccatctctactaaaaatacaaaaaattagccaggcgcggtggcaggcgcctgtaatcccagctacttgggaggctgaggcaggagaatcacttgaacttggagggcggaggttgcagtgagctgagattgcaccactgtactccagcctgggcgacagagtgagactccatctcaaaaaaaaaaaaaaaaaattagccaagtgtagtggcgtgcacctgtaatcccatctacttgggaggctgaggcacgagaattgcttgaacctgggaggcggaggttgcagtgagccaagatcctaccactggactctagcctgggagacagagcaagactctgtctcaaaaaaaatacatacaaataaaattttaattgtcatataataattttatattgttatggggtacaatgtgatgcagttttgttgttgttgttgttgttgtttgagacagagtctcactctgtcatacaggctggagtgcagtgacacaattatagctcactgcagccccagcctcctgtgctcaagtgatcctcccacctcaccctcccgagtagctgggaccacaggtgcatgacaccaccacccaactaatttttgtattttttatagaaatgggattttgccatgttgcccagactagtctcgaactcctgggctcagatgatctgcctactttggctatccaaagtgctaggattacaggcatgagccactgtgcctggtgcaatgtgatattttgatatatgtattcattgtagaaagagtaaatcaagctaattagcacatctgtcacctcacctgctttttttaaaaggtgagaacgtttaaaatactcaatccctgctttggaatagggaaactgaggcacaaaagaggttaggtaacttgcccagtgtcatagtaaatatcaaaactagatataaaccttaggtatatgactgcggagcctgtgttcttaatccttatgccatcatgcttcctgagccaaataagaaataaatcagtcaggtggattatcatctagaaaaatactttcaaggctgagcatggtggctcatgtctgtaattccagcactttgggatgccgaggagggcagatcacgaggtcaggagatcgagaccgtcctggctaacatggtgaaaccccgcctctactaaaaatacaaaaaattagccaggcatggtggcacatgcctgtggtcccagctactcgggaggctgaggcaggagaatcacttgaacccaggagacagaggttgcagtgagccgagattgcgccactgcactccagcctggtaacagagtgagaccccgtcccaaaaagaaaaatactttcaatgtgtaaatgaagctcagtgttacatatttggaaagatttcatcatctctgatttattcatctcaccttataattcctatttctgggtcactgccagatgctggtaaaatatactcttagttgtatttcacaccctgtttatccaatacagttttattttgccagccactctgcttagtgccaaggaataagtcatggtcccacatttaagaatatttcagcctctcatacaaacagtcctcatactgcagttcatgcagtgggtccaaagaatagtcaagcaaaaggggcaatagatccctgctggcgtgggtaaccaagagagattgtgtaaaagagatagcagttgaacaaaactgagatagataggattttttggtagattgttatgaggagaacattctccaccagctagggcagcttgaggaaaaaggtctaatgttgaaaagcacaaagccatgtctatatggtagagtgtagaccagactggctgaaatgagggggctttgtctaataaagtcctgagaaaaggctgaagggggtttggggacaggatatataaaactggaataccaggcgaaggagcttggctttattccacataaaatttgttgagttacagaatgatgtagtcatccattattatcattacagtaagaataactacccatacattattccataatttacagatttacattacctggcacatagcaggtgctcaataaatgtcagtcctttgatctctttatactggcattatctaagcgctctcatccagtcttgtggcaataaatgtgatatacacagttacaactcacaaatatatatatccagtctaaattctctcctcaactccaaacatttctacatacaacgatctactcagtatctccactttgcatccagtaggcgtctcacatgaaacagtcagaacttaattcctgattcctactgtcccctaaaaacctgctcctcccatagtcttccttatctgattaaatggcagcttcattctttttgttcaggcaagaaaccttactgttatccttgactcctctttctctcctttctccaactcataagcaaaatctgttggttttactttcaaagtatacccagaatctacttctcactacctctacaactgaaccctagccgaagccactataatctcttattcaaattattataatgatatcctactggcctctgcctccatctgtgatccccttcaatcttgttttcaaaaaagacagcgatttttttttaataaggcaaatcacgtcacttctcttttcgaaccctgtaatagctccccatcagttcagagtgaaaggcctttctcgatctaacttgctggcatttctctgacccctctcccactcagtcatttccatttaccttggcatctttgctatttgtacaacaccatgaaacatgttcctacttcagggccttgcatttgcactttcttctactgaaatagtcttcctctagatagtgctcatgctctcacttccttcaggtagctgctcaaatactgcctttttattgaggcctttgctgaccaacccatataaaataatagtcttccttccctgccctctctgccctaccttccccaccctgccagactgacaacccctattcctcttatcctgctctctttttctccactgaactgttcactatctgacataataggtatatagttgtttactgtctccctgctactagaataaaagttcttagagggcaagaactttatttgttaactaatacattcctggcacctaggacagtacctgaaacctaactgacgctcagtaaatacctgttgaatgaatgaatgaatgatgcaaattaacaaacagcctgtgaaataataataatgctctcttctacttattgagttccccttgtatgttcccattatatgttaaagtgctaggaactttacaggtatcatgtaattgaattcttacaacaaccctatgagattggagtatccttactttacagttaagaaatcaaaagctcaaagaagcagatttcaaactcatgtccaaaaccttttataccaggcagatattatctccattttatagcttcaaaactgaaactgcaaattaagtgttttaaccaagatcacgtagccaagcagtggcagagctggcacttaaatgtgacggtagtgattctttctgttatatctcactgttaacctggaaagatgaattaacatggaatgaagaccaaagccagaagaataattaagggtgttgtagtctttaaaatgagatgatagaaataccaccaggcaggggaagattggagagatgattggatgtaaaggttaccaatgcctagactaagtatttggtaaatggcccatagattctcctgtcctctgtatacttggagtcagacagatctttgttctaatgctggcacttccacctgttagctgaggtactctgagtacatcatttctcttttctgtatttcagctacttcatctttcaagtgaggataatgtcatgtgtcctcacagataaattgtgatgataagatcaaaagtgataatgaaaatacttggtaactggcagagggccatgccatttgagttggtaatggctaaacttctttaatccatgtcccaaaattcactacttttgacctgtctctggccttttaaaaaataagtttttagacacattcttcattcttaatatgacagtgacttgcactttgccagttgcattataacagactcttccttggaagaaagtccactgtttattgcattccccttagtaaaatgcagtaaaaatgtgttctgagtcttggcaatgacagggagacagcatgatgatataacacaaagaaccaactattaggggggccttgggcaagtcacataaccacactaaactggttctttcacctgtaaaaggcagataataataaccacctttgcgctggatataagaattaagtgaaggccaggtgcagtggctcacacctataatctcaactctttgagaggccagggcaggaggatcgcttgggcccaggagttcaagaccagcctgggcaacatagagagacacccccatctctataaaaaataaaaatttaaaaataaagaattaagtgaggtaatgtgaggacacagacatggcacatggtacattcaagacatgtgaggctttaagatgtgtagaccttgtgctgggaaagaatagcacagctcaccaactagacctacctctgggtgtataggatgacatcacaccatctcactttcactcctactttcctctaaggaagcatattctgtcttctctcaacattacttttttccacaaagcaaaatcctctcagctagggttacatggaaatgtgaccaaacatccaagaagttttgagtgacttttgttggtagaattttctgcctagttttaagaacagttgggcctgagccttccaagaggtggtggatctccgatgtgaaagttttctttgaaatttttatggctgatttcaggacctcttcagtttttacagccttttccagctttcagttagacagaggaattaacaattactaatgttctgttccacgccagaccttgtgcagacatttcagaaagtattctgtcatttaattttcattcaaccctaaagcatagatagtagtcctattttacaggttagacaactggggctaagagatattaagtgctatttccagcaccacacacatagtaactgagataattgggattctaacctccaaagtctatgctctttaccctaaacagaaaacattttcatataatgtgttgggggtccccaagactatctctaagttcagtgatttcctgggaagactcacaggactcagcatataatcacacttgtggttatgagttgttacagcaaaaggatacaaagcaaaattattgaagaaaaaaggtacatgggcaaagtccaggggaaaccaggcacaaccttccaagggtcctctcgatggaatcatacaggacgtgtttaattacctccagcagtgatttgagacaacacatgtgaaatgttgccaaccaaggaagcttatagggactctgcccagggcttttattgggtgctgaacacataggtatactctgccagacatataccaaaatgccagactcccagaaggaaagcaagtgttcatcataaactatattgtttgcacaaacagtttaggcataatgagctactcttatcagttctgggaataatggtaacccttctcaaacccaagtttctagttgccaaccttgtaagcaggcctctcaaacagtagcagtcctgctgtgttaacctttctctgaatatataactttgttttttaagatattcatgtctcaaattcacttctggagtttactgctagatatgtaaggggacctctataaacagggaaacttcccaccttcgaacataacttagtcctgtagcaaagggtataaaagtagtctcagaagaatcctaacaagcaccaatcaacctgtattttcaaaggagattttcaagacatcatgagggaagcacaatccctagagatagccatcacctagtttgtagagtatcagcgtgttcaatgcaaatttgccccagattctataatggtctgctccgaacccctacggttgtccttgagcctgcagccactttcccacactgcctagggagaatactttcttcaaattggctactttaaaaaggggaggagttgttgatatttatttttcttgcttgttactataaacaaatacagatcaacactgtaaggatgatttatttaatattacctctcctcagtcacatttcataggcattgtagactgaatcaagaaaacacacaggttgtggagtcaaatggatcaactcttcactgagtgatcttaggttacttaatttcttggtaaaatggaagtagcaatacctgcttcagaggcatgtagtgagcatttaaaaatcgatataaaatgtttcattcatatatatgtgatttcctaggaagattcgtaggactcagcatataattatgctcagggctatgagttcctagagcaaaaggatacaaagcagaatcagcaaggagaaaaggtacatgggcaaagtccaggagaaaccaggcacaacctcccaagtttttatatatatgtgtgtgtgtatatatatatataaaatattgatatgttatatattggtattaatatataatataatatataaaatatatataatgtatataatatatataaaattaacacagggtaagaatctaatagtatagctggtgtgatggtaatggtgattatttttctccccaaccccattccctccttcctcttttttttttctttttttttttcagtgttttggtttcaagaagacaaagaatctttgtccaatatcaactgtttggaaactaccagttttcaagtaaagatatcaaacaatgtgccttacatgcctaataacaaaagattgagagtggtgttcaattagaaatatctagagtttaacatttgtcttctgttttaccaaaccagcagatttctttcataattggaaatattcctgagttactttatggtgtttttcctagtgtgagagacaggcgtatttcctcatagagattttttacctcatttatgtcagggccctctgggaattgctctgtataagttcatttagggcagcagctatactgtcttatttgcctttgtaccctcagtttctggcacagtacttacacaggtctagcacaaagtagaggctcgctgagttgtgggtaggtagatggatagatagatgaagaatgacaggtatacactttgaagggtgtgatgataattacaacacagtcttgtctataagggccaaccaagtgtggcagggcagatacgacaggagaagatcatcctggcagacttgaggcacatactgccaagctagatacaacatgaaaaatacacagatttggctgaataaaaagtcctctatcagtggtgcagactgtaataatacacctgaggttaagaaattagaatattattctataggctgtggggagctattggttttagaactgggaaatacagttgattcccattattcacagtagttatattgtataatgttgccacaaacactgaattagtggatactcaaccactgttcctaggggaaatacagggttaagttcttgtgagcctctcgtcacattttcatcaaccactcggtacataactttgttatatatgttatgtgtgtttctatttagaggcactttacttaggccacgtgctgtggctcacaccagtaatcctagcactttgggaggccaagacagaaggaaggcttgagcccaggaatttgagacctgcctgagcaacatagtgagaccctttctctgcacacacacacacacacacacacacatatacaaatacttagctgggcatggtggtgcatcctgtagttccagatacttgagagtgaggtgggaggatcacttcagtctgggaggttgaggctacattaagctgtgatcgcaccactacactccagcctgggctagagagccaggccctgcctcaaaaaaaaagtgtgtgtatatacacaaacacacacacacacacacacacatatatatacatacacacacacatacatgcatatatgtaaagacacattaatatatactgttggttcattaacattgaattcatagctaatagtcctaaaactcgtgcctgaatgaagcttatctaacacacatatttttctccacaaggcacatcacagccctcctttacttaggaacactagacagcacttcagcactatgattgggaaccattttaaacaggaaaatcactaacaaaaagcacacaaatgtgaaaaacatgacactaaatatactgcaaaaaaagacattttgaaaacagaaagaaaggaatgggcatttgccaagcagcagaaatgtgaacaaaatcatagaaatataaatcagtatgatatgtttggggaattgcatacagttttctgtgattggaatttaggctatgaggtcaggtataaagggaaataaaataagagatgaaaaaatatggaagagttttctacgcattaatccaacagatatttttgagcacctgttatgcacaatacatttgggacatggtagtgaatacttctatgaagaactatacatggaaaaatgagtatattctatgcatagtgctccacagaattctttactactatacgtccactaattgaggacagaattcttgccctcataaaaccatttataatgctagtttgttggtaggtattaggccctatgttaaaaatgaaagattgaacttagagctgccaagcggcttatacaaattgacctagctaagttgcagagcagtggcttcacctaggtcttttgattctacatttctgccttttccccacttctcaacactgttgattattctgattaggaaggattaaagtagtgaaagcctggaaaagggagaccagatatgactattgcactagaaaattaaacaggctgtgggagacagtactaagatggcaacaatttgggatgaagagaagacaacagaatcaggaagaaggaaggatcagtgggatttaataattggctgtgtcaaggttgcgggaggataggaagttttcagaggtgacttagaggtctccagcctgaacaactaaaaagatggtatagtaccataagcaaaaatcaaggaagataaatggagaggcaggttcactttgggatttgttgagtctgagggaccaggagaaagtctaggtggtactttctagcagagaatagagatttaaactgtgaggatggctcaacaccagaaaatgcccctggcagtgactggagcagatttgaagataagccatagagagactttattgggtagtagttaaaagactgagttctgggccaggcatggtggctcatacctgtaatcccagcactttagaaggccaaggtgggaggattacttgagctcaagagtttgagaccagcctgagcaatgtagcaatacatcgtctctactaaaaataaaaaaaaattagccaggtgtggtggcacatgcctgtagtcccacctactcaggaggccgaaacaggaggaacacttgagcctggaaggttgaggctgtagtcagccatgatagtgccattgcactccagcctgggtgacagaacaagactctgtctcaaaaaaaaaaaagaaaaaaaaaagggcagggcaggggagactgagttctggagtcccagactaaatctcatttttaccatttcctaggtgtttgatcttgtgtaaattacttagcctctaggtagctcagtttcctcgctgtaggataaggataatgatagtacgaaattcatagagctgttgtaaaaatgaaatgaagtgttacacataaagcactagcatagtaaatgctcagcatttctaagctattatgatgaaattgatggcaaaaagaggaaacagttgctaaaccacagacatattgagggaaccagtggcattttatgagaaaacccatcattgtatgcgtctgaccagatgaaagaagtgcacaaaggaattttttaaatgtgtttgaggttattacagccatttcagatgagctgcgtagaattcagagccttaaaaattttgcccttaccgctttctaacttatttacagaggacttggaatggtggggagcgatgacaatgaatatagctatttctttttgtgcctattgtatgccaggtattagttccctgaaagatagatattgtctccattttacaaataagaacactgaagctcaaagagtttaaatttctcaatattgtccagtaagtgtcaatatcaatatttgattctcaaaacccaggtcctttccccatactatgctgaacataaaatggagtgactattactgtttatgtatattgatatacttaaaccttttcaaaattattattactattttgagacagagtttcacccttgttgcccaggctggagtgcaatggctcaatctcagctcactgcaacctctgcctcccaggtttaagcaattctcctgccgcagtctcccaagtagctgggattacaggcatgcaccaccatgcctggctaattttgtatttttagtagagatggggtttctccatgttggtcaagctggttttgaactcccgacctcagatgatccacccacctcagcctcccaaagtgctgggattaaaggtgtgagccaccgcgcccggtcgataaccttttcaaaattatttacccttccccaaataaacttttacctttttttttttttttttttggagacagggtcttactctgtcacccaggctggagtacagtggtgtgatcacagcagcctcaacctccccagtagctgggactataagtgcacaccaccatgcctggataatttttgtatttttttttttttttttttttttgcagagatggggtttcaccgaattgcccaggctggtctcaaactcctgacctcaagcagtctgcctgcctcagactcccaaagtgctgggattacaggcatgagccaccacacctgaccaagaaatcaaataagcttttgaaggctgtacatacaatctaatctgattttatccagccataaattaaaaattgttagttctgtgctccgtattctagttgctttcgcagacacgctttgctcacttaaagtctgtataataaccccattgtaaacacaaacaactgcaaatgtgtatgtgcgcagattaaccttttctagacactccttgtaattttcaaagccagtactggagttctagagtgcattagcacatgcatcaaatggtagattccccaggacctcaccgcagtgccaactgcagccccagcctacttcaccaaaaccacaccctgttcttcgtccagaaccaggacctcaagccttcaggtttaatgtctaaatctgaatcttcaggtttggctgaatcccaaacctgaagattcttttgctatttccatttttttttttttttcactttccctcctctaattggctttatgtgagaccttgtgtgaacaagccttcctcatgcatgcattctttactgtgaaaactaggggaaaaaaacctattttctagatgaaaaaactgagatgcagaaatgggaagtaacttgcccaaggcttaggaaaaccaaaagcagaaatggctggttcaagtttacatagtcacaaagtgaaggtaagatatacattttttaaacaaaaaattgtacacacgaagtttgagacaaggaggaaagaaaaatgtggaactaattgacaccctagggctgagccaggcatttgccttccttgtagtttcctggtacccttttccctcttgtggccctttactgttctgaatttcagtgttctaaattcttttcttgtcagcattctgccctagactgtatactcctgagagcagaaatagtgtcttgtttactattataatccaggacctagcatggtttcttacatgtagtaaacactccgaaaatacttgtgtagtaaataaattagaagaaataaaatgttcccagctattcatccactatttttgtttgtttggttggttggttttatattttccatcttaccagtcagaaactcatggtatcttcatagcttgaggacaggcaagtgagaggccacattatagtgacattcctggtttctttctctctcaccctccccttacctcctccttacggtggtcttggaagtaacactcccaagtttgggggaggaggcatggcaggagcatggagtttctagaactcaagcaccagaagtgacccatctgattaaaattttcagatgtgtttttatagccagttgtcagcctctcattttgacatctccagcaagacattcttagaagattgtgggtggcacaagcctgcagtgtagtccctgctactcaggaggctgaggcaggaggataacttgagcccaggatttccaagctgtagtgcactataattgagcctgaataggccactgcactctagcctaggcaacatagtgaaatctcatctctaaaaaaaaaaaatttttttttgtttaaagcagggtctcactctgtcgcccaaactggagtgcagtggtgccatctcagctcactgccatctccgcctcccaggctcaagcgattctcctgcctcagcctcctgagtagctgggattacaggtgcatgccatctactgcccggctaatttatgtgtttttagtagagacagggtttcaccatgttggcctggctggtctcgaactcctgacctcaagtgatgcacctggcccccaaaatttttttaatcaaaaaaacaaaagtgagaagaatgtagtgcagtaggaagggggttaagctgggaaccatgtctcctggggcaaaattttaattcttctagccacttgttatgtgatctcaagcaaggtacatacgtctctgggtctttttttctttatctaaaatatgaagagattaagtgttttcttaattttctttcagctctgatattatgtgattctgtgattaaatgacctggatgttgataatacatgccccattgacaactctcttccgaaaactagaacaaaaccattggcttcctggtcctactggctttatttaagatcatcttctttccttttatatgacagtgtctctgtcccaggcagtttatgaggagttaagcttttatttactgtagctggaggcttctataagccaaggctttgacaatatttcacatttatttatctgagctagagcttaggatcaggtggcagctaagtcacctaaggttattcaaatgcattgaaaatgttgcttaataattcagaaccagttttctctgtttagagtattaagattttttaaatccttctaattagccaattccaacagcagtttagggaaaattctgtcccctctgaaagggcaactgatgcagacttactgtcagcccctgtatctgtgtagcagaactgacagaagctagagccagagagcttccagagccaagggagctgctggaatgacctgctgatggtatcaccaacggagtctgcctgctgtaggaatgaggctgggggaagaggtctgaggatgcagctcctctagactccatttctttgaattcatggaggctctagggaggagtggggagtttccatttagtcattcagtagatcagtctttcagcaaacatgtagtgaacttacactgtttccagcagtatgctaggacctggggataggtagccagtaaaatctcttatgtgccctcagaattcaacctggctggagagacagactcataaacaaataatcaaaaggcacaacagataactcagtgtgaaactgtggctgatcccttgagctagatcctctaggatctcttgcctggtcaaagtataagaatgctgttttagcaaaagacagggttggcattgccagtacctgcattccactttaaacactgaccttatgtcagccagcagaccttggcaactgccttgtctgaggatcctaaggtgaaataaaggtattagtccggtaaacatggattgaccacatgcaggataatgggataggcatatgagggagagaccacaatgaacatatatggtcactgtgttccatgagccgatggcctagtgaatgattccagctatgattaactctgttacaggaataggagaaagattaatttaggctctgtcactcaggcctgattttatggagaaagtagcatctgagctgagccttgaaggacatataggttgggacaggtagaactggagagggaggacagtctaggtggaggaaacaacatagcaaaggttcagggaggaaaagcacaagacatatttgaggaatagcaaactgctctaattgtctggcacatagggtctatgagaggataatatttagagatcagcatagtaagcaatgttggggccaagcccctaccccctgttcgaaaatttagacccagatttcacttatttgatgtattttttgagagaaaatattttgccacttctaaaatgttgttactgtgataagctgtgatgatgctcatagcaggtccataaggtggtacaccagacagatatcaacatccttgtttaacagacaaggaatctcagaggacaaaaagtgacttgtcctagagcacacaggtaatcagagcagtatgctagggtcaggaggcaggtttgcagttccccaaatgatgcttgttctctgactcccctccccagctctgagccctgaccctttgtggatatggcaactaaactgatagggaatacgcatgaagaaaaggctggccaggtaaaatgcatatctccagccaccttcaagtaccactttcctagcatcctctcttcctaaatacttttctttctcatcatggtgcttttgcttaagcccaggagtttgggaattttgggtataggtttggtattgtacaggccgctgctggaccagccttcaaagaaaacacgtgctctgttcatgattcttgccttccagttttataagcttttgggtagatgaaatgtactatcaaaatagctcagagagagccttggtaacatttaagatattgaacgtgctgcatctggtaactagaaaatttaatgatctcctgctgttttggtaattggataagtaaatacatcagaataaatcacaccggcaagtcttttgtatgtcgttagggactaaactcttttaactcctgttcaaagccccagctcttgagtggtgtttgcgtgcagagcaatgcacacaccagctcgcatggccctgcttggatattaaaattcattcaaaatgctcactttctccctagcccactgggcctgaggagcacatgtagcccaccactccagatctctctgaagccaaggagaaaagattttttcagaagtttaaatgataacctaataaggtatttgagctcttaatgatctatgtccaaactgtctttccagccacgtctttcattgaagtcctgctaggagccttctcagaaacactaccgtgtacaaactgggaaagtgaggccaaagcaaaagggaactatcctgttttggcaaggagtcatttaagaactttgagaaggagcaggacaggatcagacattttgttcaactctcactagtggaagtgtgaaggagatagacccagagggatgtggtctattaagagaccatgtggtgttgggtgatgttgtcaccaacttacagatgagaaatttggatcttatctcatggtaagaggttaaatgacttactcaagagcacacatgcagtgctaagatttaaatccaccagtgcttttttttactgcctccctaattagcacttaatccatgcctactagtgaaactctgaggctaacaataatcaggatctctcagaaggcttttaagctaacttaacagttctaaacctaaccagaaaacaggtgtctcccctttcatttgtctcttaatgtcttgttccaaacacagtggttagcattatggaccaaccttttatacaaggtcctggctgcttccgtggtattggccttggaaagtgaggcatgtcccctaactcagtgattcccagcctttttcaagtcaccacacacattgaaaatggtgtttgtgtgtcttactggagaaccatactaggctgctcagagtcagaagcaacccagctctgaggttcctggctgccccaagagttgagaagaatcagtatcttagcatacctgtaagctgggcacactgctggggctcatctgcattaggtttatcttgccacactacagaatcttcacttatgaatttgcctgtgtccagtttatgctttcaggggcaatgagcttgcaaattgttctgtaaagcgggactttcttttatttgcttgaaattatgtcttccagattccaggactttccaggatggggaaacatgcctgttctcgttctttgtatattcattttatgttctttattctcattctgaagacttggatcatctcctgtttttagactaagacggttttttcctccccattccattcttaatagaatcccctctgggccttccccacttatattgtcatttaatagtatagtgaccaaagccaccatcaaggataccactgcaaggagaaggttacagcttttgtttggtgcccagggtgtccccgacagtgtgccaagtttgagaccattttaacattataataccttagagctggtgtcttcactaaacagtccatctaaaggcataggctaggaatgaagaatccagatttgccatgaatgctgaataaacttgggtaagttctttccactcactgggcttttctgtccccatatgctacagagatgacctctaaagacccatccagctctaacaattactagctctgtcataattgaatgactaaatttcacccaaatgcctaaggtaataatacactctgttatgggggaaatatgcatttcagttacacgaagggtacagtcctcccaagcaagggacttagaataaatagtctagtacatgactacaatactaaaataatctactgtggtggttaagaacacagatttgaagtcagacctagttttaaatccttgctctgccacttcctgcctgtgcattcttaggcagattatataatctcgctgagcctcttgtcctcatttttaaagtggaggtaatatacctccctcatagagttgtatgagtgcttatacagcacttagcacagttagcacctagtaagctcccaataaatgttagctcttgttaccattattataatttaataaaacaaagaacaaacagggcagcctacaaggcacaatttctattcctctcttactttaatcttttctccccttgttcttcctttaatttttctttcattctctctttcccaccttaaaaacgtcatcaaaggaagaaaatgtcctcgacacctatgctttgcagccacagacacccacccagcctcactctctagcaccccagttgatctgtcacagttcagtaatgaaaagaggagcatctgtcactgtttcctggaagccctcaccccagtgccacttctttcttgtggtccagtgagacagactggcctagcaattgcataggaagctgagataaaccatagagtagtctcatagtgggacccttccagattggaagtttcattttggggtgtgttaccacctgcagcaaaggtaaagaagaaattgctaagaggtacaactgacattgttgtcatagttgtttataataattattattaataattgtaatcccttatgttgcaaaggactttattattaccaaagatttttttataccctgactcagcatatgcccagcaattcccctaagttccccctctgatactttgtgggtataactgctttctttagggattcctagctcatcaaaaggtgattaaagaaaatagacgattagttgttaggactaagttgacagtaacaaaagacagcttgagttcctgtttggaacaccaaagcccattagggacataagccatgacatagcagcagagtgcagcattttttatgcccaacagaaagccagttagtcatgttaactgtcctccgtttagaagtaggtcagaagttgagaggcagtgaagggtaatgactggatataggctggaagctcacaaaccagggtacaattctggccttctctttcctagctatgtaatcttgagcaagtctcagaaccatttttgacctcagagaattcatctgtaaaattgaaataataggagtacttatctcatagaattgttgggaccatttaattagataatatatagaacaactagcctagtgcctagcacctaacaccaaatgaatggtagctttttttttttttttttgagatggagtcttgctctgtcacccaggctggagtacagtggcatgactgtggttcactgcaatctctgcctcccaggttcaagcaattctcttgtctcagcctcctgagtagctgggattacagtgtgcaccaccacgcccagctaatttttgtatttttagtaaagacagtatttgaccatggtggccaggctggtctcgaactcctgacctcaagtgatctgcctgcctcagcctcccaaagtgctgggattacaggcatgagccaccacacccagccatggtaactttttatagggatgatgttaataattacttattaagcttctgatatttaatagcatgttttcctaatagagtaactaatagaatagattactcatagcataccaaaaagattagttaggccaggcgcggtggctcatgcctgtaattccagcactttgggaggccgaggcgggcagatcaggaggtcaagagatcgagaccatcctggccaacatggcgaaaacttgtctctactaaaaatacaaaaattaattgggcatggtggtgcatgcctgtagtcccaactatttgggaggctgaggtaggagaatcacttgaaccctggaggcagaggtagcagtgagccgagatcatgctactgcactccagcctggcaacagagcgagactctgtctcaaaaaaaaaaaaaaaaaaagaaagaaaaagttgttcccccaagttcaaagtaaatgctaattttgaacaaaatcaaaagcaaatatagtcagcttcactataatctgggaacttacatatgcagcccataaatatgcctcagagtacaaagagcttaggatttgaaaggagaggacctgcgttcaagtttgagccccgacaatttctggttgtacgactgtgcataagaaatgtccccctatttgagctttagtgttctcatctgtaaaaatgaggataaatgaatccaatcttaggatagctttaacgtttagataatatatgtgaaagtgttttgagaactgtaaaataatactattatgtatgcattcttcagaacgaagtttagtagcacattcattttgtgttcaaatagcttggctttaaagaagcatctctttaagaataatctttgttgtggctttatgttacagatgggaaatgtattttaaaatttatttatgccctgactagttgattttcccatcttttaatcaagaccaaacagactttgaaaaaaaaaaaaaaaaaagctgtgaccctcgtatcatgttacatcaaaacctaattgttaagtacttgcttagtgctctgaggtttttgggattttaggagccattaaataataccctttcacttaactagttcaagactaattgaaagacataagaccaattgaaagatagacatagcactcaggtggggataaaaatatcacctcctttgttaccggaaaagttgatcagagattgtgatttgagattaagcagccaaggggcttgctgatgtattctttgcctgtaaattaaacagacttgcccactcagtccatggtatagctggacactgcaggccctcgtaccttgtaacatgagagcaggttggttccagaaaaggaaaaggaaggggctgagctcagatccttctcccaaattcaccaggcaaataagtttgttctcacccctgtgtgggagatagggaacacatccagaagtcactccatgtggatacataaatgtgaaataaatacttcccccaacaagagttataagttttatattattgaccctcacaacaactctgggaggcaaaaaaaaggtctcaattttataaataaacattgaatttgcccagggtcatcagacagctaggaggttatagcagtgggaatccaacccaggtatccctccctgggatcacacttcaacagttccagccactggggaactcaaaccacatagacaccatctacttacacataaagaaggcactgaatcataatagcttccatgtgtcaggcccttgatggctatttcaatccctataataacctttcacccagtggagaagggaactagtgcacaagtaagcatcttactgacttggctaagagatttgaatttaagtgttagtattatatttccaaagcttaactgcaatccagtttactccactgactcgccctcacacttctaaaaatgcaaaaattaaagcctagacaagaaaagtgactcgtccaaagtcatactgctagagtcaggactggaacccatatagtctggtcctttatatcctgataacattagataatgtacagccttggcagtcagcacagaggaattcagagaggagagggttttctgaagtacatagtctataactgaagggatggatttcctaaagcttggagaaacttattttgctctgtctgtgtctaatgtagaggattagacctgcttgtccttgacattggcgtaagaggtaagatgagatggatgaggttttggagtttgatctctgtgtggactcaaagagacttacagattttctgccagcgtggcaaagggttgctcctgagagtcaggctattcagggtcccttcaactcacagtgctatcagcacacagtctagagaatgaaagttattggtcaccagaggcaaggcaagcaaacaaatactagacaaaatttggtaacaagagcttttctgcctttaagatgctggaactttctcaaatgcaaattttattttaaaagcaggaataggccaggcgcggtggctcacgcctgtaatcccagcactttgggaggccgaggcgggcggatcactaggtcaggagatcgagaccatcctggctaacacggtgaaaccccgtctctactaaaaatacaaaaaatgagccaggcgtggtggcgggcacctgtagtcctagctactcgggaggctgaggcaggagaatggcatgaacccgggaggcggagcttgcagtgagccgagatcgtgcccctgcactccagcctggacaacagagggagactccatctcaaaaaaaaaaaaaaaaaaaaaagcaggaatatgttttgagaagcctctgttggtttattgttttccagttccacatattgaacctaaagcctgtaactcatggaatgagagagaacccttttaggctacttgtaagaggtggggagttactatgaaaattattagggaaccagcagaaggcctgggttctggttctgcctctaccacttacctatgtgatcatagacaaatccagtctctgggtcttgtttcctaatctacagagtggggctgatttccaagtactaccgcaatgcatttcccccataaactgttaaatgcattaggaacattaaaaagaaaaagaagaaaaaaatccaacctagcattttttctaaaagtgaaatattagatccagactttcttttattcaatttcaaaataaaagcattacctcagaaatattaaatgtaaaagatctaacttcctcacatgattgtgagttaatgtttgtgtaaatatgttacaaactatgaagggctatgcaagtattgctgctgctattctttttagtattactcagctcctgccctcaggtcgctcccagcctaatagtacaggtggagtatcccttatctgaagtgcatgggaccagaaatgttttggattttggattttttaagagtttggaacatttacctactggttgagcatcccaaatcagaacatccaaaatctgaaatgctccaaagagcatttgttttgagcatcatgtcagcactcaaaaagttttggattttgaaatatttgggatttttacattagtgatactcatcctgtagtttatgctcaggtactaaaaagtgagaggcagaaggatgtgactagaaagagccccaaaacagaagtcagaaactctgtgggtgttgcacatgcagtgctgcgtctgctcctattcaaccgtgtgacctcagctaagtcacttgacctctctaagctttagatcgcccttctatgaaatgaaggggttagataatttggcatttaaggagcttcccccccacaaccccaaacattccaggattcgcagtgtggcctaggatgagaatctgtcccatggattcacatttttctcaacagcagtgataggctttttagaaaaggaactgaagcccagggaagtaatagaaacagtatatgaaatttcagtctgctaagaaaattgatctagaaaggaatagctctgtttggcaaagaacacctgtcccatttttgttacataaacatgtttcacaaagccaatttgctaaatgattaagctaatgagaaaatatatccattcaggttttctaagtatagtgaagaaaatgtcaagatggttgactttccttttctaactatagacaaaatcaagccatacctcttatctgagaatgacccttctcccccaaggagtcccaaaaggtgggcttctttgttgatttagagagtcgataattcagtaaagtcccaagtaaatggcacaacacaagctcagattgggtttttgtattcatattttataaacatttcaggacttttttcctgacccttgacctattgccattcttaaagtgaagatcttatatcccggaagcttggttagaaacaacttcaggatcatctcatccaacttctttctctatatagaaactactctcagcaatatctctgaaaatgtaatgtagcgggttccaaatctagactgccttgattcacagcctggctctgcccttaatagctctgagaccttgggcaagttacttaatctgctccagggctcaatttctccattggctttttggcttaatggggataataattgtccttacctcaatgcaaaggcataaaaatgatataatggactttggggactcagcgggaaggttgcaggggatgagggataaaacactatacattgggtacaatatacagtgcctgggtgacgggtgcaccaaagtcttagaaattaccattaaagaacatacccatgtaacaaaaaccacctgttccccaaaaactattgaaataaaataaaaataattgtccctacctcagataacctaccttttatattaaagtgcttggactatacctggcacaaagtaaatgctcaataaacattagcttctatagtcatcatctgcaagtaagcccctatttgagtgcttctgggaacagcagagagttcacccatcccaccctccctacctccatttccccaaggcagcctgttgacatgttagtcagaatcattcatatcatcagctttagagtcagacctgagtatgaaaccttattctgtctgcagccttgggcaagataacctgtggtatcttcatccataaaatggaaagaatcgtacctatttcactgagctgttgtgaggtctagttaaggtactatataaaaagtatataaagtacttaacatggttcccagctacatagtaggcactcgataagtgatagttgctgctatgatgatgactgaagaacaagaaaataaagaacagagagaggagggagaaagataagagaagcagtagtagccacgtcggcagctgctgtctgtctgtaaaaagttgtttctgactagctgggttctgcttccctgtgattttatttcaccagccctagctgtatcccccagagctgcacagaacacatctgctctgtcttctacttatcagcccttcagatattcaaagagggctgacacagccccctccctacccatatagcaacatcaacaccaccacttctcagtgccccctctccagggagatatctcccattctttagctgtctctcggagaacatagcttttaggctctttcctaagcaggaggtccctcctggcatgctccatgtccttcttgaatggggcccagagcactgcaggacagtttcacagcatggccaccatcttgctggggagaaacatgatgtcctacatccccctaggtttctctcaattggtttgtccaagccaggcaaatgagaatggaaatagagattgtccttgctcactttgaaattcttacctaaaatgaccttcaaagaaaaaaaattgcttgattttatttttagggcaccagagggagcagccagcacagccgtgtttgctttgaagcaatccaatggtgacacagcctcactgaggctgtagacgggggtctccagagatggaggcattacctgatcaggaaagggggggcactcttgctgggccgtggggaagaaacaagaaagatagcctggtatagatcagggttccaggaggttttggtgaaagagctgcagctttgaagttagaaagatcagggcccctacccagtcagtaatggctacaacctactgagtactcattggctcagacactgtaccagaggctgcaccaacattattccatttaactataatcacaacaacctatgaaggagaaactatgattcccattttacaggtgagaaaactggctctcaggttatataatttcttcaaagtcatactggtaggaagtgacagacctaggatttgactctaggtttgcttcactctttttaaccactgtgctttatagacacttattaaccatatggctgtaaacaagtggtaaccactttgagcttcaatttaatcatctccactgtcttgcatggttgttgtatggatatgttgtctggcatatagtaggcgttcaagaaattttagtttcctccttctcaaattccagctctcccactcaaagtgactgaagaaagccacttttcttggatgcagctttctcatatgaaaactgggtgtggtttatgaacctctaatcttgcatatgacaaccccagcatggtgcaactcaggcctgatacttcagcctcccatcctcttttgcttcctagcacacgattacaatgatcgtttctcccaacaaacatcatatttacaagccacaaataacaaagtagaagatgctggaagagctctggcatgttaattaagaacaatatcagaagcaggtgggcagaaaatgccaacgaatgagaagcagaggcagagtagctctgtttgttgacagaagccaatgagtattgtacgttaattggggaagtgggtaaacatttgccagcagcttgcccctcagtgcattggaagatagacaggctaggcccttcccactccttgcctgtccatctgcccacaacccaagagatacaaatacagtgtgctttgctctgagttccttataagcggagaggattccaggggcggatgtgtctttttaaagaccctcctgagcataccaggtttccatctagatacagctgaagatagtttccccttccccttgccagcctgcctttgatacttggccttggcccccagggcctccacttccccatatcccccacccctccatggaagaagacaccagaaccatcttattaggagcagcttgagttaagcagaagataagattgcctgcctcaggtgctgcagtcaggcccagagcagcagagcagcagcctcaggcctgactagagattgcttgccctcccatcacacacttggagttgcccatttatctgtgtgtccaccatctttacagttgctctcacacacagcagtcattatggaacacctgttctgggcaagacactttgctaattatatattttttctcatttaattctcacaatgagtcctgcaagattgatactaactccaaagccacaaagctgatagccaacacagctgtaatttaaagtagagtctttctaattccaaagcctgtgtcgtttccactaaaccagtattactcaacttttaaacattgtgacctcttttgataaacaggaaagttttgtttcttctctcactcgcagattcagaagaccttcatgtcccatccctgcccgttgcctaggagggcataaacctaatttaggatccctgtatgattaacgtatcccactcagccaagattttgtctagcttgactttcaatagttcatattacaaaattatgattttttttaatttttaaaatataaagttgtattatgacattgcctgttttttttccaaactaaatataccatcaacaagggtatgatatgcctcccctcaccaggggagatcttcatcgttgggcatggtggaatggccattctacagtttataatgtagttctaagaggaagatcagccccaaaggcttagctgtagtcccaccaagcagaagagtccctcccctctattaggggctaaccaagcagaggtctctaggaatgccagtcagttgttaaccagcacctttcccaagggccccctgttctgccagccaggctgagctgtgcaagaaaggtacctccaccaaacttgactatgagatttgattttcctgagccctggtttcctcatttataaaatgagaataacaacacctgccttgcaggttattttgaagatcaactaagatactgcgagactcttcgtgccagtgcatagtttcagaatcagtgtgcatagataaaatgaaggccatgtagagaatatagtgcttgtttcagtcttttgaatatgtgttcttcatctttttaggtaactcaactggacccaaataaatcattattggaggtaaagttgttccctcaagaaacccttttccttgaagcaaaagagtaaacacggcccagcggtggaaccagccattccttgacaagccagcagcctgcgtcaggagaagggctcctcgccaacccacccacacgctcgtctcactcaattcaatgtcacacttctgcctcttgcaaaattgctggaaaaagtaataataaatatagctacttaagatttcccatccatgagtatatattcccaacccttattacagagaattacaactctgccaccctcccctaccccctgcacttcaccctccttcaatgacgaatgcattgttcaagtgtgagtgatcactaaatagaatttttacctctccagtgcccatcttttccccacagtgtctaggacagttctgtctgttctgtgacaccaggatgctgtatatttgatatatgtctttttattttcatgactgaatttctacttcatcacctaattttaaggggcagagggaaaaaaagtcaaatgagacattgtcggcatggagattaaacattgtaggaaaaaagtataccatttttgttagaactttctgatggctttactaagatgtcaggttttgtttgaggactgaatttgacatatatgcaagatatttatttactgctgctgccttgggtctccaggttctacctaggaggtatttgctgttccattgcagcatagggaaactgttcaagcacacaatgtgaatgttgagatcatgtgcagagaggccagtaccaaaacttcagtatctggcccaatggcaagaggctactgttaggtttgcatttgggcagttagaacctcacagataccagctcccaagttgctagtccatcagtgtaaactgaacacaattctctcttgctttctctctctctactccctcacacatttggaccttgtcacttggtgtttaagcaccttgcctatcaacaaaatctgatgagcagccccatggactctcctgtaataaggaacttgctctactattttattcttttaatgttttagtatttgatattggactcaaatgaaagggatctcattctgtggctgaaaaatcagacttcatatgttgaagagagcaaacttggggactcaactcagaagacatgtgttgcctgaaacctgcatataataatttttgatttgatttagtaagtgtggatttttcttaatctacagatttggggtttggggtttagatcatgagaacaccgtttataccttcacagccaatgatttatttttagtcttgaaatatttctccatatctgtttttgtgtcacctgtgggttttatcctaggggttgggatcctgattttaacattttgtacttgtccaaaaaagagttcaaatgctgggtttgttcccccagcctcggccaaggggttctcagaagattctaaccaaagctggagataggtctgctcattttccttctgcccagaagtggatgttggccaggaaaattacaccttgtgtcttctctgatgctccaaccagggacctctccagattactatctagcacagactagtgctacatctgcctaggtatgggctttctctggcagcaggggtctctctagggaggctgagagacccatgggtctcccttcaggggaagtgttcaggggagttcaaactgaacacttctctccagctctattcctatcttcctaatctaatggctctacaagatagtcatttccagtgctacagatgcaccagggcaccacctctttttttttctaggtagaccttgttctgtagctgctgtgaagaagctgcagccctgaactcaggtcatactcaggaacagcagcaggggtgtgggtggggtttgagggaaggtactctgaattcaccttcatgtttaacctgttccatctgacttgggtttcttcattatattgttccctcccactcaccttcacttctgtattacaacaatatagactttactctaaagccaatttcatggaagttattaaatgctacttgaatgtgtgtgaagttgatacaacctttttcaacctgccttagaaagttcttttggcctactcagccccatgatttcctatgctctaggcctcataactgggaaaggcctcagctaattgtcactgttcactcaggacatgatggtctactaagcttcagacaaaaggccaaagc

SEQ ID NO: 16298 - DNA, 16236 bp, Human
ttaggatctaagtataaaagtgaagtgatttatccttcataggtcactcttaggaggtgtcctgccacttggtacatgcagaaaccaggtgttagctggccagggatcaaatgacacagctgttgtggactgagacagaatgtttcaggttccctgtcagttccctgtgagaaatccaggccaagtaatgggcttccttaaacctccaagctggctcactttggtggggttgtgtttatatagaattttaagtttttttcatgctgttgtgccctattagatgcaagaaacctatgaagaagtttagtacccttaatttatagatgagccagtggcaggttacgggagtggatctgtgagtctttacaaactagtgtcgtgcatatcactgagcctttgctagttatctagctcagctgccctcacctcaaccctgagaacatgtctgtatggctgtacctacgcgactggaactctgaggtgtttgttttcaggaggaaacagtgggagtattaacagaagtttcttaccctagagacttctatccgaagtgagcctatctgtgtaggatttgacctaaggagcagagggtatatacaatgttgggcaaattgccttcctactgccatatcccctgctcttccagttctgaatggcattagtccagttgggtcaatgaggagcagtttggtgaagtggttaaaggtcggggaaagtgtgcttatattttgaaatttaaggtttgtacaagctgcttgtgaaattctgtctttgtattatggtcatacctcttaaactgagaatactgcaacttgattgagtgagtgttgagaactttagaatatcaggttcttaaaaaatgcctgaaagtgggttttctattcatcttagaagtcaccacagattaaatgagagaatagtatattaattacaagtatttctcacatgaactctcaagttcttaatttttgaaactagatatcccattcacctgagaaataaaatgggaaagccttactgttttaaagactgtttatacatatgaacttttttgaggcctagtttaaaatccactatttattgcatgtttattaaaattgtatctgtatatatttaaagttagaaaacagaaaagaccagccgggcgtggtggctcatgcctgtaatcctagcactttgggaggctgagatggatggatcacctgagatcaggagtttgagatcagcctggccaacatggcgaaaccccatctctactaaaaatacacaaaattagctgggcgtggtggcgggttcctgtaatctcagctactcgggaggctgaggcaagagaatcacttgaacctgggaggtggaggttgcagtgagccgagcccagtgttgcactccagcctgggcaacaagagcgagactctgtctcaaaaaataaaataaaataaaaaagacctatttggaggttttggtacgcaatttcatgtcataccttaaactttactgtgcccgagggctctgtatgactgaagcatgtatttagtaatttttgtaagaacttttatcttgctcttgtattttcattcaagtatttgaaggtatccagcaaacataaaaattgcttaagaagatattgaaatgtaattatcttccatctccaaaccctcaaaagtgcttagaatgtgtaggagggatagttaggggcattgaggctcagaggaggttactggtcaagagcacattgtaaaaatgtaaaatgtaaaaatgagagggtgtaaaatgtaaaaccccttgtaaaaatgaaagggtggtgagtgttttagaaaaaaaatagggattttaggtttcagctgtacaggaatagcttcacttgattcactctattagtgctagaatctactgctatcttactagagctacaagtatgtgaggtcatcatgtggaaatgtgcatgaagtaacttatctttaaaataaatatttgcctccattatgttccatctgtttccagatccttcatgatgagagatttggggacacttctctctcctgtgtgtagttgatagtttggtggtgaagagatggctgacagtgtcaaaacctttctccaggaccttgccagagtgagtacatcttgtttataggaattcatctctcggccttttttttttttgctgaaggaaccatctaggaaatcctttagggtttttggaacttttatcatatttcttgggttctttacataaaggttgttattctagaccacactactcaagaaataggtattgttctacatcttgcagacagtcttgcaggtgcttggaagacctcttcggtggatgtctccagtattgggaccctaatcatcttggcttcagagctttttttttttttttttttaactttttattttggaatgtgtttagatttacagaaaagttataaggtagtacagagagttcctgtatgtccttcatcagcttcccttaatgttaacatataaccgtggtatatttgtcaactaagaaatgaacattggttcagtactatcacctaaactaattaattcagatttaaattagagaacctatcttttttttttcccaatttttcatttatttaaaaatttttctgttaaaagtagagacgaagttttggcatgttgcccaggctggtctcaaactcctgggctcaagtgatccacccgccttgtcctcccaaagtgccgggattataggagtgagccactgcacctgccagaaccttttttctccccattctacaagctgtgcacgtgaggaggatactctaggaaaatgccctataaagatctggttaggacccagtcatccaaattaccaatagcacaaaagtctgctacttttaatgtatgtctgaagcctaataatgtctcacttgtaaccccctcttatatttccactagcatgaaagaggccaattcttggagtggggaggttctttctttagtggaagagtttaaaaggttacctttatggccaggggaggtggctcacagctgtaatctcagcactttgggagaccaaggaggcaggattgcttgagtctgggagtatgaagcagtagtgaactatgatggtaccagtgcactatagcagggcaagaaagtaaaaaggttattacttttgagtaaaagagggaggattgaaagagtatcttagaaggtctaaaaagactttatgcatatgatctccttttttttttttttttttttttgacagagtctcactgtgtcgcccaggctggagggcagtggtgcaatctcggctcactgcaacctccacttcttgggttccagtgattctcctgcctcaacctcccaggtagctgggattacaagcacacaccaccacgcctggctaatttttatatttttagtagagacggagtttcaccatgttggccaggctggtcttgaactcctgacctcaggtgatctgcccaccttagcctcccaaagtgctaggattacaggcatgagccaccgtgcccagcagcatatgatctacttttaacatctttaccttgttgtcttgccattcatgtgctgtaaaatttcaaccctcccagcctggctaacacagcaaaaccccctctctactaaaaatacaaaaaagatttagccaggcgtggtgcacatgcctataatcccagctactcaggaggctgaggcaggagaatcgtttgaacctgggaggtagaggttgcaatgagccaagatcatgccactgcactccagcctgggcgacagagtaagactctgtttaaaaaaaaaaaaaaattcaaccctgtgttggttctacagtgtgctatttacatgtttgtctgccccactggactgtagatgtcttagaggtggggatcctatcatcctagcatgtactaggccctcagccatttgaacttaactatcttagatagttggagtttcctgagttaaaagcaaaattaagagtaaaaattactcagacaaaaaaagatcaaaggcacactgtgccaatttatgttcctgttaacagataatacatcaacttgcccatttctctgtattccagctattatttctaaaattcgttttgtctgataacagtagacgagaatgctatccattcttaaatccagcttggccattgcttccagaataattttttctgccttctcatgaagttgaatgccccagtgctaacactctacttgggccatacatctgttgtggcacttactaaactatgtgtgcttgcttctgcagcacatgtactaaaattggaacaatacagagattaccatggctcctgtgcatgacacacaaattcatgaaatgtttcatatttaaaaacttttttaaaaaaaaacctttaatgtaattttttggtttacttgtgtgcttttcctactaagttataagcttcttgagcatttctatatgacaatatatagcttattgaagatactcagtacgtgggtgggagatggatgcatgagtgaattcttagcctttgggaggcttaggcaggaggattgcttgaggacaggagtatgaaaccagcctgatcaacatggtgagatccccatcgctacagaagaaaaatttaaaagccaggtgtggtggtgcacatctgtactcatagctctttgggaggctgaggcaggaggatcatttgaacccaggagttggaggctgcagtgagctatgattgagtcactgcactgtagcttgggtgacaaagcaagaccctgtctcaaataataataataataatgatagccttttctatagggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagaggtaaggagtgcatgcctgatatcaaaatgtccaagggagggaagaccttacatagtgacttgatgtttcagtgccattttatttcttttgtgctttttcccagaaaaatgttgcaagtgatttccccccaacaacattgacttaaactagggtctaacaataatccttgctaaaaatgtcatggtgttaaatcagaaagctgaatagagaatcgcaaaatattatttggtttgatagatacttctagggaagcctgtgtggatttatgtattaatagaagaaccctggccccacactttctcttaatcttttccatcatcagactttagaaaataaattatttttcttttaaaagctggttccatatatatacacattttttttttttttttgagacggattcttgccctgtcaccaagctgtcacctgagattgccgtggtgcaatctcagcttactgcagcctctgcctcccaggtccaagcaattcttctgcctcagcgaaccggctggctggaagtacaggtgcgcaccaccacgcctggctaattttttatattctttagtggagacagggttttgccatgttggccaggctggtctcgaactcctgacctcagttgatcgcctaccacggcctcccaaagtgttaggattacagccgtgagccactgcgcttgaccatttttttagtcttttctcattgactgacattagaacattgggagaacatgaggcactgaaaaataatacagtacccacaaaagataagatataaaatgaactactgaatgacaattaggaaataacttatgctttataaactaaatacatgtgatcttttccagtgagccacgtattgttagtagaattttccagtgttgtgcttggaatggtggagtgttctgggtaagttctttaaattccaggtgccttataagcatcttcagattgttgctgggttgatagctatgaactgttttcttgaaacactgagacaaatagttttcatctgctgatgtacacttagaaatataactcaggagtctgtgcatctgcagagattttattcccactcaggaaagcacacttatatgtaagcaaacgtcacagccctgaatatacacttgaattttgtttctaaaatgactcattcacaagtattagaggtagcagtttctcttgacactgtctagacattttaaaatgctaacagcaactatggggactcgggaagggcagatacggctagacaagaacaaggttctccctgcttctgcttatagtgatcaacaagagttaatttgcattgaaacctatagcagaaaagattgcctaccgtttactgagaatcccagtgcaggcttaactgaaatttgggtactttgaagaatggataaatatttcctttgacttagaatttagagtaattcatcacttcttaatctaaacaattcacagatgttttcagatgttagttttaaatttaattaatatgtattcctgtgtacttagtacatgcctgtattttggcctgaatactacttgaaatgttcctgtatgcccccaaaagtttcattgttttataggcaatatcaagtttgtatctctcaattggagtgttgggaaatagaaatggatccagttttggtgctttttcaggcctcctgatttattttatttatttatttatgtatttatttgagatggaggctcgctctgttgctcaggctggagtgcagtggcatgatcttggctcactgcaacctctgcctcccgggttcaagcgattctcctgcctcagccttcccagtagctgggattacaggcatgcaccaccacacccgaccaattgttgtatttttagtagagacggggtttcaccatcttggccaggctggtctcgaactcctgacctcaagtgatctgcctgccttggcctctcaaagtgaaccaccgcgcatgagccaccgcgcccggcctaggcctcctgatttataaaagtcactcccatctataaaatcattacactaaaaattgaagctcctgttttaaagactggattttgatgtttgccttgttgcttcttttctttagttcagtctcctcttgttttatcgagtatttattcctgtgcttcagtcggtaacagcccgaattatcggtaagtgtataccctgctccttgtctgttggggacagagtgggagatgatgtttcagtctccctcagtttactgaacatttcctgtgtaccaggagctttcactgtttattttcttttttgttgttttattctttttaaaaatttatatttcgttattctcctagaggccctttaagaatgggtactgttgttctatccattttatgaatgaggaaatgcaagttaccaaggttaaaccattagtaagaggcaaagctgagatttaaacccagatggtatcctgcagatagcgtactggtaatcactgtggcatctcgttaccatcatgtaagcaggtttgtgtcaagcagcacatatctatggtttctttgaattggaattgtggccagaatgtggtgcgtctattatgagttagactctttgagataggtatagtgatgtgctggcaagaactagaaagatccaggaggagacagagaatagtcacgagatgggggttccgcatttggtcttctggatttccatttctccatttctagtaactcgtttcctctttcttaggtgacccatcactacatggagatgtttggtcgtggctggaattcttcctcacgtcaattttcagtgctctttgggtgctccccttgtttgtgcttagcaaagtggtgaatgccatttggtttcaggtaggtccagggcagaatggagtctgggtcccgcagcatgattggctgacaggtgacaagtttcagcctgtgaagttagtgggcatgtagggggacctgtttttcagccttaatgtttcttggccaggtagccagtagctgatctttgtgttcttacagaatggaattattgtctcagcatctcattggcaggtgtctggtgccttttctttttcgttttggcttttttttttttttttttttttttgagacagtctcactctgtcgcccaggctggagtgcactgcaacctttgcctcccgggttcaagcaattctcctgcttcagccttccaagtagctgggactacaggcacgtgccaccatgcctggctaattttttttgtatttttattagtgacagggtttcaccatgttggccaggctggtctcaaactcctgacctgctgatctgcctgcctcggcctcccaaagtgctgggattataggcgtgagccacggcataaggcagcaatcctcctaccttagcctcctgagtagctgggactataggcacatgccatcgtgcccagcttatttttaaataagccttttcttaactggcagctctagtggcggactagtggccttagctttggggatgtatatcaaggccatttaattcatgttttggtacactttctctgttacaggatatagctgacctggcatttgaggtatcagggaggaagcctcacccattccctagtgtcagcaaaataattgctgacatgctcttcaaccttttgctgcaggctcttttcctcattcaggtgagactgaccttctgggcatatgggcagctttattaaaaagaaaaactgtttcactagagagaacttcacaaagacagagtattatatttatacagagtattatatatatgctggtgggaggtaatgatttttaaatctttttttccccacggaaatgagaattttaaaattacattataaaattataagaaacatgaatttacctgcttttttctgctactctggttattctccagtcctgccaggtggaaactttttttctttttatagttatgcctaatttttttttttttttaaagagacagacgggtcggctgggcgcagtagttcatgcctgtgatcccagcactttgggaggccgaggtgggcggatcacctaaggtcaggcatttgagaccagcctggccaacatggtgaaaccccatctctactaaaaatacaaaaattagctgcgcgtggtggcaacatgcttgtaatcccagctactcgggaagctgaggcaggagaatcgcttgaacccaggaggcagagattgtagtgagccgagatcgcgccattgcactccagcctgggcgacaagagcaaaactgtctcaaaaataaataaataaataaaagacagggtcttattttgccacctaggctggagtacagtggcacaatcatacctcactgcagcctcaaactctgggctcaagcaatcctcctgccttagcctcctgagtagctgggactacaggcacatgccatcatgctcattttaaaaatcttgttgtagagacagggtctcagtatgttgcccagtctggtctttaactcttggcctcaagagatcctcccgcctcatcctcccaaactgttgggattacaggaatgagtcactgtgcccaccctgcactcggccttttagaaacttgagaagcagctaggaagctatctcagacagtgattggagagtgacaggtgaatggtgctaggtttccgaggctttgggattaagattttccatatttgttcttcagggaatgtttgtgagtctctttcccatccatcttgtcggtcagctggttagtctcctgcatatgtcccttctctactcactgtactgctttgaatatcgttggttcaataaaggtaagtccatctaaagaaatccagaaaatggaggcccagtttggaaatgctactgctaagcagacttcttaaactactcatagtcaggcttttggcaaacaatcctttgagggaagcagcctcattggcaagagggagcttaccttcggcttagtgggtttaactctcaactttgaggctgggggatgtggtagtatggcattatctttttggtgcttaacatggtatatctctgactgggttgtaagatggcataaatgagcatgagttgctctaaattagagaagtcaaattgatgtcagcatctggatccttttgggggtgttttagaaagaccttcagatatttaccagggtgtgcgtggttgaaagaggttaactgatacttacaggatggcatccttttgatttgctatcttgcttagttccagactaatcctgacaaaggatgctggtgctgaaattcttaattcacttagcctgtcagctttgaaattacgattatagaattctaagaaactttgcatgctttatatcagatttgtacacttctaatttatatgctgtagctctgttctaaatctgtacctaggctgggtgtggtggctcacacctgtaatcccaacactttgggaggccaaggtgggtggatcgcctgaggtcaggagttcaagaccagcttggccaatatggtgaaaccctgtctctactaaaaatacaaaaattagctgggcgaggtggcaggcgcctgtaatcccagctacttgggaggctgaggtgggagaatcgcttgaaaccaggaggtggaggttgcagtgagctgagattgcaccaccgcactcccgcctgggcatcaaagcaagactccatctcaaataataataataataataataataataataataaaatctgtacctaaaactcatggtttgtctaccatagttacttagtcacttgactaaaaggaaatataatatctaattgtattggctttcttgttttaggaattgaaatgcaccagcggttgtctaacatagaaaggaattggccttactactttgggtttggtttgcccttggcttttctcacagcaatgcagtcctcatatattatcaggtaatttggctacagggatttgaaggagactagtaaaaataaaaattcatgaagtcagtgccttttgtttgcttcgttctgtttcgcattctacatcatcatttgtccatcaggagacctgcagggtatttctacatttgttagcatgaagatctagtctgaatgtccctatatcccatattctttttctatgttgcctcctgaagcaattattctttttttttttttttttttttttttttttgagacagagtctcactctgtcgcccaggctagagtgcagtggtgtaatctcagctcactgcaacctccgcctcctgggtttaactgattctcctgcctcagcctcccaagtagctgggattacaggcgcccaccatcacgcctagctaatttttgtgtttttagtagagatggggtttcactatgttggccaggctggtcttgaactcctgacatcgagtgatccacccaccttggcctcccaaagtgctcagattatagacatgagctaccatgcccagccctgcagcaatgttaaacatgcccagtgcttagaaaaatcttctgttctttttgaaagatgtgtttgatgggctgggtgccacggctcacgcctgtaattccagcactttgggaggctgaggtgggcagattacctgaggtcaggagttcgagaccagcctggccaacatggtgaaatcccatctctactgaaaatacaaaaattagccaggcgtggtggcacacacctgtaatcccagctacttgggaggctgaggcaggagaatcgcttgaacacaggaggcggaggttgcggtgagttgagatcttgccactgtactccagcctgggcgacaagaacgcgactccatctcaaaaaaaaaaatgtttgaaatattgaggtttcatcaagccataatgtttacactggaagcaaaagaacttggagcttctaatatcttcttcaaagtcatgtctgttatgaaggtgactaattatttcttttttttttttttaaacagtggctgccttttctctatcctctttcctttattcattatcagcgccaatgaagcaaagacccctggcaaagcatagtaagtattagccagtgatgaaatttttgctgtgtaaagggttggggctgtaacaccagttatgtcagtgaggctttttaaaaaaaaaaattcttactgtaggaaaatcttaatataaggtttaatgagagagaaacacttctgggatataacccaaacttttctccatgcatatatgcacatgagtatatatatatttccaaaaccgatcccattatacatattcaagtagagggctgtatgacctggccacatgagtttattgataacagtagtaaaatatactttaaaatgagtttttagcaataataatagcattctaaaagttttattacttcaaagaaaagctcaattcatctttgatcaattttggttaagtcagtgtggatacttgtattagagacttaggtctgctttgggtttttgtatgctcttgctatacagcacagctcactgtttatcttaagaggaatatttgactttcttttgaaactcttcttcctgcaaccacagatagcatatgataccttcagacatagcttgaagtctgtaccccgaagtcagccatagaaaagtacttctcaaatcaaagttaatctaaaatataactatttcctgtaagagccacaatacttcaacgctggtgactgcattacattcatggcagcagcagggcccaatgcattctttttttttttgagacggagtctcgctctgtcacccaagctggagtgcagtggcgtgatctcggctcactgcaacctccgcctaccaggttcaagcgattctcctgcctcagcctcctgggtagctgggattgcaggcgcatgctaccatgccctgctaatttttttctcaagtgatccacctgcttcagcctcccaaagtgctgggattacaggtatgaggcaccacgcccggctccaatgtattctttagttgcctgttccatccatgtatctaatatctgtatttccttgatcaagtttcatttgtcttgtctttccctgtgtagttttaaatttaatgtcaagttgtcaaacaacggaaataattttgagtaactggggagctaacaagttgggtttcttgccttttagtctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaaagtgtctaatggttgaatttgcaaatcttgatttcgagaaatgtattcatggaatataagactttgtcttggataatttagttacagttttgagaaattagccctgaaaaatgttccctgagaaagcctggattatatgattataatcacatttatatttggtagaagagtcagattattactttttctaaagtctatatgtatatcgctactgtatattcatgaagggagaaagaccctcctagatattggtgtattgagtattaatcgagggaagccgttaaacatctggttaacagagacctttactatgtgcaagataaaatatggaattaaaaattgttgctggggccaggcatggtaactgatggctgggattccagcactttggcaggggccaaggcaggaggatcacttgagtccaggagtgcgagaccagtctgggcaacatagtaaaaccccgtctctattaactataaaataggttaggccgggcatggtggctcatgcctgtaatcccagcactttgggaggctggggcaggtggatcacctgaggttgggagttcaagaccagcctggccagcatggtgaaatctcgtctctactaaaaatacaaaaaattagccgggcgtggtggcacacacctgtaatcccagctgctcagaaggctgaggcaggagaattgcttgaacccaggaggcagaggttgcagtgagccgagatcgtgccattgcactcaagcctgggcaagaagagcaaaactccatctcaaaaaaaaaaaaaggttaaaaaaaaattgttgctgagagttgtaaaccaagtttgaaggtttatgcggttgatggaaggagggtttttaaatggtaggcatcttggaagtgaacactttccagcttgggcagaaaaaattgtaaaagacatggtttaaagtaaggtttacttccaacattctcctatgacatctctggtcatttaacaatagtattgcagactacttccagattgctatgggtgtggtttgcagaagacttcagtatttcatcagcttgtaagtgataagtgattgccttatttaagcttagtttcttaaaactaagttttaaaagtaggcttagttatttaagcagtcacatctttgcttcctgaaatttatatttgtaccatttagaagcatctcataaactattgaaaaaaaaaatagaaacatctcagtttggtttaaaagggtgaaggagactgggcgtggtggctcaggcctgtaatcccagcactttgggaggctcgaggcaggtggatgatgaggtcaggaatccaagaccagcctggccaacatggtgaaaccctgtctctactaaaaatacaaaaattagctgggcatggtggtgtacacctctattcccagctactcgggaggctgaggcaggagaatcgcttgaacctgggaggtggaggttgcagtaagccacgatcgcaccactgcacaccagcctgggtgacagagtgagactctgttttgcgggggaaaaaaagggtgagggaagttgagtggatgaaggtatatgatttttatccccagcactgtgcctggctatagaaaatgtgtaaaggtttaaatgactggaagtgaggaatctccagagttttattagcacagttgagcagccaagccttttgtataaaggctagattaggcatatctgtgataagagaaatgtgaccatctcaaatgagttatatacacaaagcagtgtaaatttttcctgcctttcacgagggtattgtcactgagagcagtgattaggaaatgggtcaaaaagagactatatttttgccaagtgcagaatacctgtttgaggcagactaataattagtaaccaaaaacaagggagctcacaaaactaaaaatgaaaatttgtttgttttaatcacaaaaccagtaggatctgaggaattgttcccagaagcacttttcaagggatagacatcacagcttggacaggtatatgta

SEQ ID NO: 16299 - DNA, 12759 bp, Human
ggtcttgaactcctgacctcaggtgatctgctcgcctcagccttccaaagtgctaggatcacaggcacaagccactgtgtccagtcttattttatcttctttccccgttcattgctacaatccctcatttaggttattttgaagcaaatttacatagggaatttttaaaaacaattgttttcagctgaaagcatcagctctccagagcccactgtctgtctttctatgttctaagttagggtggaatagatagcacctcttcccttctactaatttccactgcttctatcaacaaaagtcagacccaaggctcatagctgttcttccaaactcatcctggaggaaaagaattattgatagcatgctctttcatacctttctctactgtaaaggaacctgcctgaggctcagaaatcctagctttatcctctaactcaagtcaagtaacttttgatccctggtgatcttgctgtcttcaactaacccagaaccttaatccagattctcttctatagattctcttacatgattctctataaattctcctctatgaggcagagagaggccccaaaaggtaactcattccttccttccttcaggaaaagcttaggcatgctgctaggtactgggactacaacaatagtcaagacagggtctctgcattcaagcttagagtccaacggggagtacaaacatgaaacaaataattataacagtgataaagtgttagtccaaactgcaccatttcgtaacccccaccgacccccgccattttgcagaccttggctaaagtgaagcattccacgggggtttgggcccttagaaacagcctgtccaactgcctccctgactttatcacactctgctgggaaaaagtccaaggaacatcagcatcacattctgcgggaacaagggccaaaatgcctcattatgggaacatcttcccaggcagcaagccatactgcccagacccgtcctgctcatacctacaagtaccccaacctgtacgaagcagtgggcactggcattaagctagtcccccacctctgtaggtcttatgctagacagaaagcctggatttgatgtagagccgccactctctctttctttaaccctcaccttcctttcaaaatgtaacaataagtacatctattctagatttagcattcagtggtatataaaacaaagttgttcaagagagctgagcagagaagcagcgagaaatggaagctaccagatctttgccactcaatcctccataagttctagttttatatcaggtggatgcctcactgcatccatcttctcagcttggccacccccttgctaccaagttgcagctcaaaacgcagctttctactgtctcttgatctctttactctgcccatatctgtgtaaactctcctcagttacccatttgagtttgccacctgtttcctgctaaaaccatgttgataaaggtctgtatgaaaagactatttacagaagtgggcaaggttaaggaaacaaacaaacaaaaaaagagataagtttgggcatccagattttagtaacagcaggaaaccattatcatccctaggcctaagagggcagggggagaaaaacatattaccatagcatggatgagagctggagccatggaagagaggacacccaacagaagctctgtcatgtagactcagccagtgtcaactgtggcaggaagggaataggaagaacaaatattccagtctcgctctctttctccccattcctcccttccctcttcctctctctctttctctcttctcccctccaatcctgtataaacccaatctgaagccaaatccagccagcattcaggtgataaagtcaacagaggtcaaccttccagggtacagatcagagccaagaaaggctgatttagaaagccaaacagaaaacaatcaacaattacatctcattgtcaaaaacacttttaaaagacagtagatatcttttaaactttattacaaaaaatatgtgctttttggtaatacttttttttttttttttaaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggtgagtgtttgatctaggcttcaggtaaatacaaaaggggtctcccttaagacatttcaggccttgaagaaggaagaccagtctctcagtcacccaaaccaatctgagtcagaatcaagagcagctaaacaagtccaactcggagagctcctgaaccagttgatttctctagtcatagctttacagtcagagggtcccactggcttggcacagtctggtttctacttattttagccactcaacatttatacctgatgctgcatgagatgaaaaagtaggcttaggggttctgtagaagcccaatgaaggtttgtcccaccaattaaatgtgagggatccttgtgtggttaatgtgccaaggaaagatgggagatgggaagatgtaatgtgttcagaaaacaacctcagaacacgacagagctataggccagagacttcataagcctcttcttcatggctgtgttatatcaatcaggttttctgtatcatctcttcttttgggatcccccattcatggtgtgctgtgttccctcctgcctcctacagcagaaagaggccatgagctctgagcttttagtgaaaaaacaatgtattttctataatgtcgactgtcagaggttttgctttttgctttgttagaccttcaaaagttgactcaaaaatgtagatacacagccaccaggtgatagtatgtgccagtcacatggtgacacgagtcataaactataagatcaagaaattagcatgctttttatgtctcctttctatatcagaaacatctctttatcaaaacttgtgttaattattgaaaaaccagtcaagtagatagtatttatgtaataagtttaaaaaataaaaacctcctaaaagctttactaaatcttacctttcctttatcaacatattctcaccctagtcatttagaaagtcactgattgtaagtactgcactgtgccaagaaaatatatctatcgcaagattcttagagttttgagtactctggggttttagactacctcagcctcaaagatccaataattcctctcagcttttggctagaattaaataacttggttgttgtagtctacttgtcttcctctaggtggctcagtttaatcaaagagtaataatcaaattatctgttttgtgcttctgttcacttaaaatatacttaaggaatatttgtctgacagtcaatgatgagatggattggccagacacagtggctcatgcctgtaatcccagcattttgggaggctgaggcgggcggatcacttgaggtcaggagttcaagaccagcctggccaacatggcgagaccctgtctctactaaaaatacaaaaattagccaggtatggtggcatgcacctgtaatcccagctactcgggaggcagaggcaggaggatcacttgaacccgggaggcggaggttgcagtgagccaagattgtgccactgtactccagcctgggcaacagagcgagactctatctttgaaacaaaaaaaaaaaaagaaagagacggattaaaggtagaagagactggccagaaaaaaataaccatgtaagagttttgtaattcccagtgtaaggtgggaagaaaagaaaaataaaattgagtactaggcaatggtgcacttcacaatttatcttattaagtactcaggacaactccatgaagtgaatgtaaatggtatgtcacaaggatacaattcatatatgtgtgtgtgtctatatatatatatatatatatataatatgcctagacttttttttttttcccttaatagcttatagcaactttgctctctgaatccccaacccacatggattggggattgagtgtgagaaaatacttgacattaccaaatacaggcggcttaatcccttctgataatttttgtgggctcatacttgtcatccctgtccaaaggttaactcttccgcccttaatttaggttacaaatactcaggtattgaaaactacttgctttctctctccctcttctatctctactcttcttgtctttcacccatagaggaatgggagggttggtggcgaacttctgattctatcagggatggtatcctgacttcctgatgctgactttgtcagggaggcacattcattttccttcaggggttttttgtacatggatgagtggattctcctaagtagttcttaatattggggaacttaagattcttcccttcaatcccagaggtggcctctgtttgtttcactaaacacttctgtcctccatggccttttgggatacttagttgatttttcccaacatctgcagtcttcaggtgcccaatctaggcccataggaaacctaggagtctcataacattagcctaactccataggaagatagtctttatcccattctgtcagcttcaccaactctcttctgttccttctccatcccaggaacatcaagtcagcctaatgagctttctggctccatagatcatcaaacttcagttcagcaacttccaggtgagttcttttcacttgaaaacccttctgatgctgaggctttatatgagacttcttcaggcctgaacactttaagtgagcatggttccagtgagcatggttcaagcaagcacactgtggccgagcacacttctggagaacatgctgagagtgagcatgcttcaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggtgagccatgtttggatgggtgccagtcattgacttcaggtgggaaatggggaacacatcaagaaaacccaattttagggaaggagtgcagaagaaagaattgttaacacttcacaaacagctctctcaaagtctctctagttctcgtcacaatcataccaagaggcatgtgggagcctgaaagctaaacaatatggagggccctctataagaaaaataaaacaaatacaaaatgccagtacccctccaacttcactctccataagaaattatgaatacacagcccttccgacttccctagaaggggatcatgaaagtgcagagttctgaagactaaccttcattagctttatgctaaccctgcctcttaaaccatgttagaatgctataactttacaaattctgtaaagagatgtgtgcagctggtggttctttttgtttgaacatggaatgtaaagctattttcttttagatccagaaatgagttcctaggacaactgctagtctgtggctcttaattaaaagggtttgttctgggaaagaaaacaagacccaaagtttgatgcctcaagttattaccagacatagttcacatttcactctattgtttaaatatcattattctaaattttcagatgaaagaagtgaggcaaatgtaatatgtccaatgtcacatggctagaaagtggcaaactttggattcaaacttaggactgtgcaaagcccataatctttccacttctttaggcttcccaaactgggggattagcagtagagacagtaaaagaggcaacatggaagtatttcaaagatagtgctgttagtgaccttcaataaggtcaatttgaaaatggagaaggacacactcttcacagggtttgcaatgttagagcattctaacatagcttattaatcggtcaaatatgactccaagtgtttgtgccttgtgggtgagagtatgatggggagtacaaaagggagatgaaaatcacacatacattttgctcctatgctgtcacatgacagaagggtatctaatgataaatgcccaggaagtcaatgcagatatggactggagtaaaaatattagagagagaaatttgggattcatcagcaatgagggtcagagatgaagaagaatgaaggaatttcctctggcacaggtctatcagacacagggcccagatccccaaaaagaactaagaaataaatgtgtagtatccatgctacctattgcccattacccctcccagatgtgaatcaaggctacacatctggtccacaaggaaatgtcatcaggcttatcttaaattttcaggcacaatattaaattgctacacatgtgcttatatgaatgatcaaggaaaatgtcttcgtggagagggaacctgcatcactcagaattcccagcagtgcatgttaaagaagatctttgaaggtatatggggacttcatgaggcaatttctgcctgagaacacatcaacttacttctggtagggggcagttggaatgacaggggcccaggaaagaatcaaggaacttgaagattcagaactttattttttcaaggactaagaacagaatcccttgccaggcgaggtggctcacacctaaaatcccagcactttgggaggccaaggcaggtggatcacttgaggtcaggagttccagatcagcctggccaacatgaaaaaaccccatctctactaaaaatacaaaacctagccaggtgtggtggtgggcacctgtaatcccagctacttggaaggctgaggcaggagaatcgcttgaacccaggagacggaggttgcagtaagctgagatcatgccattgtactccagcctgggagacaagagtgaaactccatctaaaaaaaataaagaaagaaagaaaataaagaatagaattctttattctaccaccaggtactgatgaagagatagatgcccttcccattaggcctaagagaaggcagagagactagctgtctcttcccattaaagcaatgtgttgattgccccatgagccattgggacattgactgtaagctatagctatatattcctgggacctagcacaatgtcaagcatatggtaggcatttagtaaatattgaatggataaactaataaacaactgtctacaagtctgtgttcacaggttaccagaccagtctgagtatattcccacacctctttacccttactctcagttcctcatccctaaaataagggatactggttatttccatcccaggaaccacactgcctgactcctcttgtagtttttcttcttcctcactagaaatgtcattttcctatttctacatgcagacattcatccaccatcactcggaaaacattaatgacacataccatgaactacagaaagatgactcaaatataaactgtgtacaaagagattatgttataatgtaagaaataagaaacaatatcacaagggagaaaattgtgtcttaagaaaggcacatataaagtgcagagagttcagggaaaggaaagattagaggtgcagagaagtatggggagaaggtggtattcagaaaatgctttgagggaacatttacgatttgggccaggagttctcaatcttgtttgtacattacaatcacctgagcaactttaaaaaatcctaatgttcaggttgcaccaaagcaattaaaccaggatctctgggaatagaatccaggcatcagtatttttttaaaggctcctagacaattccgatgtgcagtcaagattaaagagatactgatttagtcatacagcaatggttgatgggtattccagagacagggaatgaaagcaaaagtcagaaaagtgcaggatgtaaataggaaaaagagcaaagagttttttgaggatggtgagcagagacatagaagataaacttggaaaggttgactggagccagctgatacaagagcttcagtgtcagttaaaaagagtttgaatttaatagttctcctttatttattgcttccagacagtatgatatgcattttaaaataccctttatcatttaatcctcacaaagtaggagcttgcctaaagacctgttactaggaaaaggcagagccagtagcccatccaggttggtcaaagcgcttcttcaggaagattaccttagaagcaagttacagtggacacaagagaacctgttaaagggctattgtaatatttcagtaaaaggtaataggagtgactgatggaaagacttattaacatctctcccatgtcttttcactcattctgcatccctgtttacactctacacttactccagctacgcaagtcaccacttcctgaacagtttcatgttttcatgttttctccagttatgcttcagcctgaaattatcctctttcctttctaatcgaaatgctaacaattcttcatagcttagttcagtctcacttccttcctaagaatttccttgatactatgccccccttaatcaaaataccaaaattaatcatttatttgccagcatagcatataacatggtttttccattgcatgtaataattggctatttttatctctctcagctcttgacatcaaatgatgttattaatctttgcattctccagagtctagcatagttccttactaggtccgttaattttttttttgagatggagtcttgctgtcacccaggctgagtgcagtggcgcgatctcagctcactgcaacctctgccccccagcgattctcctgcctcaccctcctgagtagctgggatcacaagcgcctgcctggctaatttctgtatttttagcagggacagtgtttcaccattttggccaggctggtcttgaactcctggcctcaagtgatccacctgcctcggcctcccaaagtgctaggattacaggcatgagccactgtgcccggccaaatgtttgataaatggaaaccgagtgacagaaacaaactagattgcaagtagaactgacagaccttcacaacaaattggatggaaaaagcaaagggaagaatcagagatgacagaggttttgaaggtgtggtacaggaagtatataaaggaaactcacaaaaacaagcaggtttggggaggaaagtaatgagtttcattttgggcatagtaagttttagatgcccttagcatattggcatggaggtgatcatcggttagttggtaatgtgacagttcaacttgggagagcagaaataattggatccagaggagtagatgagcagtggggaagaccttgtcagaagcagagagtatcaagaaagggtgtagtttcaggccaggtgcagtggctcacgcctgtaatcccagcgctttgggaggctgaggtgggcggatcacaaggtcaggagatcgagaccagcctgaccaacatggtgaaaccccgtctctaataaaattacaaaaattagccaggtgtggtggtgcgcctgtaatcccagctactcaggaggctgagggaggacaatcgcttgaacctgggaggtggaggctgcggtgagctgaggttgcaccactgcactccagcctgggcaacagagcgagattgtctcaaaaaaaaaaaagaaaagaaaagaaagggtgtagtccacagtatgatgtgcaagcaaagaggttaaaaaagtcctgagaaaaggatgcagaatttgatgagtagatctctatgacttttgagagaggtttcggcatagtagggtcatgattcaaactgtgaggggccaaggtgaggaggataggcagactctgggaaggctgtaaggaaaggaaggatagtgctaggggagtagcacgattaagagaaagtattttaaatttggggtaacctgagcatccttgtaaaccaaaaaaggagtccatagaaacggactgacaatataagaaaggagtgggcaactgatggggggcaagttcccagaggaagcaaatagaagagaaagagaagggataatggacaagtggaggtcttgaccatcctgcatggagacactgagcatcacagataaaggctaaggttggaggacgaagctttctgctcactagtctgtctctgctcctttcaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcacacaggctcaagacagacctttttttcccccattaatctagttgcagggtcaacatgagcttccttccacaccgacactaaactgggtgcattgtttaagcattccatatttatgaaagtaaaggagtctccaagggcagagacaacaaagaggaatgcaaagtaggtattaatcttttacagggtgtaaacgtgcaggtacttctgacacccccccttttccatccctacacactcttccatttattatggcatacaaaaactcaactcttctttggctcttgagagtttctagtcttcagtagtccactactaacataatgataatagtataatgattccttatttgctatatattgcagcagttcataatgcttaaatcatttttttcacacacaatgttactgaatcatctatacaggataggagggcaaatggaaatactaaacggtccctcatataagtgttatgttcttcaagatgttttcacatacacggtctcatctgatcctcaggaaagatcccagagtggtagacaggaaagatggcatcatccttttttgcaaataaggaaatgtgacacagagatgttttctttattcatactccatgttgttccaaatttaccaaggttacagagctacagagagctataggcagattccacaaccaaatctgcaagatctaaatctgagctgtttccaccacaatgaaagtagccagaatggttctaagaactcttagaacagtacaacaagaagtcaattttactgtatataaaatttaaaatttcaacatatatacacatcatgaccccttccccaaaatatattgctaacaagctcttcactggcaataatggtaagctggaagaaaatggaacatcttcaaacttctgaaggaaaattattttgaacttatactcatacccctagataaaatagtatacaaaaataaaatccccaaagcaggaactaaaatcctaaatgaattttcaacttggccagaagggaaatgaaagcctgccaacattgtcaacactaataacttttttttttgaagggagaagataaataatagtctactaggtataggtgttgagggaaaaatgtaagttcaaatatgttgttaaaatttaaggagccaggcatgatggctcacacttgtaatcccagtgctttgggaagctgaggcaggaaaataatttgagaccagcttgggcaacacagcaagaccccgtctctacaaaaagttaaaaaattaactgggtatgatggctcatgtcaataggcctacctacttgggaggctgaggtgggataatcacttgagcccaggagttcaaagacagcctgggcaacatagtgagactcatcttaaaaaaaaaatttaagggtaggaaaattctggcttccatttatagtggaataatttgaagtaaccctctcacaggtaacaattatatgttctggacaaaacataaaaaaaagatttgaaagctcctccaaaggaactgaagagaagtcaccactaaaaagagagatttgtgagcttatgctggagggtacttctcaatccatgcatcacaggctggcaaaaagccacaggctcactggtttgaagtttcagagaacataggttgggactagcagagcagctgcaaaattagggggtactcctgaaaataagacagccacagagaagcccctaaatttgaggataacctctgaccaaattattgtctggtcactgactccaggaggctcaaaaacaataacatctgaaagctgaaaaaatagggcagtgattttagcttctgtccacattgaaggagacagacctaatagaacaaaagtcaatactcttcagaggaacagaagagtacagaatctctacaattcctcatttactatgtctactatgtaataaaaaattattacacatagaaaaagcagggaattgtgacccatagccaagaaaaaaaagcagtct

SEQ ID NO: 16300 - DNA, 12759 bp, Human; identical to SEQ ID NO: 16299

SEQ ID NO: 16301 - DNA, 12759 bp, Human; identical to SEQ ID NO: 16299

SEQ ID NO: 16302 - DNA, 12759 bp, Human; identical to SEQ ID NO: 16299

SEQ ID NO: 16303 - DNA, 12759 bp, Human; identical to SEQ ID NO: 16299

SEQ ID NO: 16304 - DNA, 12759 bp, Human; identical to SEQ ID NO: 16299

SEQ ID NO: 16305 - DNA, 12759 bp, Human; identical to SEQ ID NO: 16299

SEQ ID NO: 16306 - DNA, 33870 bp, Human
gcttttatttttataccaggccctgtggctcgcttctgtaatcccagtgacttgggatgctgaggtaggaggatcacttgagctcaggagttccaggctgcagtgagctaagactgcccaattgcactccagcctgggtgacagagcaacacaccctgtctccaaaaacaacaaactgtaaaaagattacatgaagcctaatctgtgatgtcatgattcaaaactatacacataagcattttaagagttttttccttgatttttgttcctgactttgcttctttaaaagaaatgtgtgtttttgttgttggttgtttgtttttgagacggagtcttgctctgttgcccaggctggagtgcagtggcacaatctctgctcactgcagcctctgcctcctgggtagctgggattacaggcactcgccatcgtgcccggctaatttttgtatttttagtagagacgggggtttcaccatgttggccaggctggtcttgaactgctgacctcaggtgatccatacgcctcagcttcccaaagtgttgggattacacgtgtgagccaccaggccccggccttgagtaacattttatacttgtttcactttactattatcataatagccagttatgcttagtgtttgtatgtggcccagtcttaaggactaagaaaatatatatgtatatatataaaatatatacatataaaaaaatatgtttttttcctacggaatcatgctgttgcccaggctggagtgcagtagtgctcactaacctctaactcctggactcaaacgattgttctgcttaggcctcccaagtagctagggctacagggacacaccaccaagcccgactaattcctaaatttttttatttgtagagatggggtctccctatgttccccaggctggtcctgaactcctggcctcaagccattctcctgcctcgccttcccaaagtgctggaattacaggcaggagccactgcgcccggccagtgctggagaatgtaatggagatgatcctgcctatccctgagttccagtctagtttactgtcagagaatacttatttccatttttcctattttgttcttgagtctctttcctcagaatttacttttccacttaaatgacgtacgcagcttttaaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacatacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccggtgaggaagggcggccggtagagtagggaaggtttctaaagaaggagttcggggtctagattagtgagggagggcatggtgggagaaagttagcattgactagcgcaggggattggagagactcctgcggaggggcggtttcggagggtggaggaatggtaccaggaggttcccgttgtgggggcgggggcaggagggactaacccgctgctagctaagaaccccaaggaagagtcccagcccttcctttcgcctctgggggcagtttggccccgccccggcctttgggacgggtggggctgtggatggggatgggaattggaattgagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagagtgagttcttttaagcttgccttcgttttctgagtgcatattcattgttttggagtctcacactctggtgatttagaaagtagatgtttgagatccaagggttttggcaactgaagttacacagccttttgctaggattaaaaattttttccttccctttaaaaaaaaaagttttctttgtagagagctggaagggacacgaagttattgtttccatgcccacaaattgcttctcagggtttaagcattgcggttaatgagcaaatgagcagactctggagattgcctgcctggtttcagatccttgctctatcacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagtttttaaatttgttttttaaatcttgggcatgctatttggtcgttgtcctttcaaaattgctcatgcaactgtgaaattggaatacattatctttaaaaaatttttccacctggtgttaataacataaaagcatatatagagtcaatgaaagaaaacttctttcccaagttatataagtgattttgatttaagattggtgtcttacagaatttaagagtgacaaacaagttttatggtacatcataaatgcagtgtatcctaaatgcaatgtattgcctacacaattttttctttgtagacattctagttacatgaaatcattgtatacattttatacatttacagatctaaaatagcatgctgtttcctcttggtttacatgaaataattgagaattttctaggattgctttttgtatattaagtaaattctatgtttgctattaatacttaaatattcgatgtagaatcaaaggattgatatttcagaacactgagaagtacataaaatctggatctaaatttataatttaaatttataatttaaagctattgtattaaataagtttatcagttaaaaactgataaagaggtattaggatctccagtgtgactcaggagagagttgagggtaaaagaaatggagttaatgagagagatcaaaatataaaaagataactgataaaagaactttcataataaaactgtttcacgaaggacctcacaggcatttgtggttttgtactgtgagactatatgaagtttaaatctgagccaggtgtggtggtacatgcctgcaatcctagctacttaggaggcaggaggattgcttgagctcaagagttccaggttacagtaagttatgatctcacgccagggcactccagcctgggtgaaagaacaagaccgtatctctaaaaaaagttaaattataaaagaagtataatctgtaaaatatttagtgaaattggcttagatttgcccagacttcccctttggcattatatttcaggaatgagaaaaataattagcatagcatttagaagaaatggggggaatttcaaggttactaaataaatcagggttagtataagaggaagcagaggctttgaagtcatggcttgcattcttgatttggatattggttttctctttataatttttctgtgatgacgccttttgccacctaacacaggtaaatgtgagttaagccccatatgtgttagtggactcctgaatcttttgttggcatttgcttctgtttgcctaagcacatttgtaaatgtctaagcttcaaattaagaagctatgtggttgctacctgattatatttagtcaataaacttactttcatatttgttttagagccagacataggcatgcctgaaccagatgctcagagattcttccatcaactcatggcaggggtggtaggtatagttgtctatttcccttttacttaaaattagagtgaatacattacattaccaaattctagtgtgtttctctctgcatccctcttaggtttatctgcatggtattggaataactcacagggatattaaaccagaaaatcttctgttggatgaaaggggtaagtttagcattttatcactacctaaaataaaataaaataattacctaaattattttaattacctaattattttaatatagccatacaaggcaaaatcaagtctttttgcattactggaatttcaagacaagatctgaaaaatcaaggaaattttggagacttcgtatatttggaaatcacaagtctcattttgcaatacaagtgcggatcaggtagagaaatctgacctaggtgcaagcctagctcactatatgtataagaataatttttttttttttgatacaggctcactgtgttgtccagtctggggtgcactgtattatcacagttcactgcagccttgacctcctaggctcaagcaatcctaccatctcagcttcccgagtagctaggaccaaccacaggcaggtgccaccatgcctggctaatttttgattttttgaagaggtggagtcttcctgtgttgctcaggctagtcttgaactcctggactcaagcagtttaccagccttagcctcccagagtgttgggattatagacgtgagccaccatgcctggccaagaatagtttaaaataatcctttaatggattaataaagggaagttcctgtggaataccctggaccttagtcttgtcctgttcactctttttttatgtatgacgtggataaaaatgtaagaaatttagttatattttctgaatgtcatcaaattgagaaggatggatagcgaaagctttaagcttacagggtcagaatcaaaaaagaaatgtcagctgtatgaggcagtagtttttgtctggtttaatgctttattcttagtattagaatagtgcttaacaaatggtcagcttttttttttttttgaaacagagtcttgctgtgttgcccaggctggagtgtagtgacatgatctcggctcactgtaacctctacctctctggttcaggtgattcttgtgccttaggcccctgagtagctgggattacaagcctgagtcaccacacctggctcatttttatatttttagtagagatggggttttgtcatattggccaggctggtctcgagctcctggcctcaagtgatctgcctcccttggcctcccagagtgctgggattataggtgtgagccgctgtacccagcctatacatgcttttttcttatgtgcatatggattttactttttacccctttaaactgagtttatatgacataaaaatctttatttttatttaaaactttaaaaattcaggtacacaaaaattcttatgtattataatgaaatgtaaatatatgtatatcaacccacctggtttaaaaatacaacattattcgtatataagaatgctcacagtggtgatgtttttaatatagcaggaaactaacccaaatgtctgtcaacaataaattatgaaatgcatggcttttcaagccatgtcacaagcagtgacacaagcatgtcacaagcagtgacatggatgaatttcaggtatataatgatgtagagcaaaaagagacagttgcaaaagaattcatatggtctgattctgtttatacaaagttcaaaaatatgtaaaacctagtatattgttcaagtatgtaaacatggagaaaaaaacatgcagaaaagcaagggtataataaaaccaaattcagaatggtctaagaaagtaggggagggaatgtatttaaggaagtatttaaagatttcaaaggaaatagagcattgtttttctaaagtgagtgggtgtttattacattgttattctttatatcttgtattaatatacaagatataattctttgtttctatttaatatttaggagtcttttaaaaaaagaaataaaatgttaccagtatttaatgtcctcctgtttatttcatcacaaatatattcttcctttgtttttctaagagctaaacacattcctacatttaaattttattatgtgcagttctctaacatagctgagtattatgttgcagacataacaaagtccaaggaatactatagttatccattagtattttaagtgattactactcataagtaatttgaaactcaatctcagtggtttgtccaatagtgtcatatttaactactgaaaagataatcaactgggtgcagtagctcatgcctgtaatcccagaggctgaggtgggacgattgagtgattctaggagtttgagaccagcctagacaacatagaccctgtctttatgaaaaattaaaaaaaaaaattagctagacatggtggtgcacacctggagtcccagctacttggaaggctgaagcaggaggattgatcacttcagcctaggaggtcaaggctgcagtaagctgtgatcacatcactacactctagtctgggcagcagagtgagacactttctcaaaaaaaaaaaaaaaaaaaaaaaaaagggtaatcacagtagctacctcctaagtcagatagaggtaaacatttcattggtttacatattgtgtgaatgtacttgatttttaaagaaatcagtcccctattttgagacatttaagttgtttctaacttataaaataggacagtgatggcttctatcaatttgtgtaaaaggccaatataaaaattgcgtcatgctataatattttttatgctataatattttttatgccattagcctttttgtcccacttacacactatttcatgttagtatgtatagatataccttgttgattgttttcaaaacctacctccacattttccattgtacaaatttggacatttatttacaaataatattgctatgaatattcttatgtttatgaatttgtgggattatttctatggatatagaagtgggaattgctagttcaaagagtgaatgtttcacagtttagtatgttttgccaaattgccctctgataatagagggccttttctaactcttaagactgggttacattcctttgctctaagatcctatagtgctctatatttttataaccttcataacagttttctattgtcagtcttcactaatttatctattacctgcattggctggcatagtgtctgtcactaagttacagtagatattcactaaacataagttaagtcctgcctgcagtttttgtgtgttgaagatgggaagttagggtggaagttgggtcttctgatattttttttttgtacagagtttgtcctctttttctcagactctctactttgaagaaaaaaattactgtggtttgttgaattttggtgtgtcttcacatattttcttctgccaactgggtttgtttgctgctgagaaagttgtgcctaacatactactgatgtttccttcctgccctccaccctacctgatgaggggccttgctttactttcatctcaggtttagagtgctcttttccagaagggcagccccttctgactccagcctctttctttaatctggtccagactgttctgtgtgttgataatacttcttttaagttaatagaagaggtgaggcctttttctacttttagcatagatgatgatttattttatttttttaaatttctttttgtctattttgcttattttaagagaagttctacaaaccttaagtaacaccagtgattttttttcagtaaaacttaattcctgtaagtatatctatttgcaaaacatttttattcagtgtcatctttttttcttttggtttagataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggaggtaagagctatttaatcatggtaaaactcctataaaaagtcagattagttatactgaaataaatgaaataaaccaaggaattcatgtttatataatagtttttgttttcttttttaagagacagggtctcactcttggccagactggagtacagtgagctgttatagctcactgcagcctcaaacttctaggctcaagcaatcctctggcctcactcttccaagtagctaggaccagtggtgcctgccacaagacatctggctaagttttaaaaattcattgtagagatgggatcttgctgtgttgtccaggctggtcttaaacacctggtctcaagcaagccttctgtcttggtctccaaactgttaggattaaagtaaagacatgagccatggtacccagcttttatagtagtattttaatagtgtcttgatcggtttggtaactgctgtaacaaagtatcatagactgcatagcttataaacagcaaatttatttctcacagttctggaggctgaaaatatgagattaggggtgccaacctggtcatgttttagtgagggccctcttcctgatttgcagatggctgtcttgctgtgctctctcatggtggacagccaagagagcagaagcaagctctattgtggtttttttttttttttttttagaccagagtcttgctctgtcacccacgctggagtacagtgatgtgatctcagctcactgcaacctctgcctcccaggttctagcaattctgtcccaggctcccaagtagctgggattacaggcatgcatcatcacacccggctaatttttgtattttgagtagagacagggtttcaccatgttggccagactggtctcaaactcctgacctcaagtgatcccccaacctcagcctcccaaagtgctgttttttgggttttttgttaaatgaccagatgttgtgagatattgtgtctgttttttgtttttttgtggttttttttgagacagggtctcactctattgcccaggctggagtgcagtggcacaattcaaggctcactgcagccttgagctcccaggctcaagcgatcctcctgcctcagtctcctcagtatctgggtctacaggcgtgcaccaccacacctggctaatttgttgtgggttttttttcacagacggtctctccatgttacgtaggctggtcttaaactcctgggctcaagtaatctgcctacctaagcctcccaaagtgctgggattatataattagtgccctataaagatacaatattgtccgggcacacaagcccttattagacattaataagctcttaataagagcactaataccattttttgagtggtcccatcaccaggacctaattacgtctcaaaggccccacctccgaatgccattgcattatgagttaggatatcaacatgacttttgagggggatacaaatatttagcacattgcaaatagtaacttatttataatcccaaagattttttaagctaaggcatgcatagttattaaatatcacaacacttatctctcctgtgtatcatgtaaacatttgtgaaaacaagactagggcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtattataatctaatgggactgtctgttatacgtgtggtccattcctgactgaaacatcattaatgtggcccataagtatgtaaaatgaatatatgtatattatttatatgtgtttttatacaaaatgagatcacactaataatattttgtaactgtttttggttttagtgcgcagcgaacattcttccatgactataattgtaggtctacatcgttggtttaaaggctgtgataatattctgccatgtggatatgccttactttactcttttaatcactttgttggagatttttctaaattttcacagatacaaaagagatataagtatctgtgtaacttaatcatgacacatacccttaaattgttcattgaaatccccagaagcaaaattgcaggatcaaggatgtagtttttattattatggcttattttgtcaaattgcttcccgaaagttcgaaccatttcatcacagtctcatcaatttacattaaggaaaaaaactttaaataatagtttttcatttttattttaaatttaatactaatgaagttgtataccctttatgtatgtattagttttttgtctattttgctcatttttgtcaaggatattgtttttcttaccactttgaagcttttttttttccttgataacacattgacctttgcacttgttacaaatacttttcacaatttatcatttattttcattttgttttgctatattgacattcaaatctattatcttgtcctttgtggtccctgactataatttctttggaaaggtcttctacctctactatttaaaagttccctatgttttcatttagtgtttttatggcttcatttttccatttaaatctttggtccattaggaaataatcttcacataggaagatacgtgaattttttctcaagaaaattaagataccttaggatggttagttagattactgtctcttaaaaagttattggtaagtaaatgttcattataaaactgtgtgaataaggaggtcacgtgagaacatgacattgaagtaatgaaattcggtattgaaaatggataagaggggtttctgtatctttttgttaatctcgtcacatgaggagaaacatttccatctggctcttgttctcagttgcaaacaattgagaatcagatcagggaagactactccaagatacagcagcagagaaaaactgcatgaaattaaagcagtaatttagtagctttaattctttctcttccccaggaataatatttagacataagtaggctaacagaaaatgtgtttcttacctcaagccataggcttctctaacatgattctttcgtgaatgttgtcgtaatgtttgtttttagctctgctgcataaaatcttagttgagaatccatcagcaagaattaccattccagacatcaaaaaagatagatggtacaacaaacccctcaagaaaggtaatatccttaaactacaagtttgtttgtttttctgtggaagaaaaggtaattgcaaagttattatcacaagtcaacaacacatgatagctatgatctctgtcctcatggagattataatgtccagtagaaaaaaatacagaaataattttgtttattaataattataaaggggaaagtcagggtactatagctaagtgtttgaccaagtctaagggacagggaagacttttcttcctgaagaaattacattaaatctaagatttgaagattaaagggaagctaggcaggcaaagtaagtggcagatttgattctgaacaggggaagcagtatttgaaaaatcttagattttagaaagtctgatgcttttgagaaacttgaaagatcagtatggcacaagccgtgtctgttgtgttcatcattgtatcatcagtgctttagcacagtatatggtgcaccataggcactcattaaatatttgttgagtgagtgaacagggaagtgggagaggaagacaggtttgagatgaggccagagaggtcgctagtggccaatttgtggaagaagaccttgtaagccatgttaaggattttgggctttaacttaagaccactggggagacctctgagagattttaagcaagactatgacatagtcatatcttcggtttaaaaatatttctctgacttccttattttttttccattgttttttatgaatagggaaagattcagggtgctgtaggtttttctgctagttgtctagaagtgggaggctggtggcttggaataggttagggcaatggtattggagaaatgagatgattccaaagaaatttaagaactagtattgataggactgttaggctgtgaatggaaggagagaggacaatgactagagatgatgaatgaaaaacattcagagagttattaatgtttaactctgtcctcatggatagaaaagagttaatgtttaaacattcactcttctttaatacctctctgcatgtttcttcctccttgtcctaacttaaagtccaattctcccctgaggacactgcttcctctgaagcggtaggtgttttctttcccataccctcatgtcctttgatctggacatggtacaggtgtcctccttattcttcattgtcactttctcccatcttcctttatgtctctcccctctaacttttgaaccccaaattaaaatttctgccgtactatcacagtctgcaaaatgactcttgatgttattttcgtcatgattcttggtgatttaaatatttatttggatcatcctcctgatatcctgacttcactgtttcttgaccctctctcctatagtgatgttgtctttgaacacgctgcactgatcaccagtataattttttctgacttcctcccttaatattctaacttaaacagtcctttgtatctggacttgcaattaattaattctatctcttcagtctcttacctgctccctctctaggtccttgatttcatctttacctatcttaaatctttaggttagtcattataaatgactgctttgcgttcatcatcttcaatttccttgtccccttctctcttcatcatacttagtgggtaaaacccagtaagtagtttctgggtttaatctagtagttttctacgtactgcacacttgtacctgcacaacagattgcagcaggagaaaaatacccaaaaatgttcactttaaattcaggattactaatctcaagtgggcccttaatgcttcctggcatttggccttcgtttccccacatctttctctgtcctgttctcctaaatcacgtttttataatacttttctctttttttttttttttttttttgagacagggtctaggctggagtgcagtggcgccatctccactcacttcaacctctgcctctcaggttcaagcgattcgattctcgtgccttagccacccgagtagctgggattacaggtgtgaaccaccacacctggctaatttttatatttttagtagaggttttgccatgctggccaggctggtctcaaactcctagcctcaagtgatccccctgcctcagcctcccaaagtgctgggtttataggtgtgagctactgtgtctggtcccttaacttttattatcttctctccatcctcactctcagttgttcactttgcttcctgtgtcactgggaaatgaaagccacaagagaacttaggcaagctcccaccaccatctcctccatactaactgcctctatgctcatgtactctctttcatcctgtattgctgtagataaattgctctggatgtaagccaggtctttctcttacccactcaatgactttgtctagcaatttttctccctctcctacattattaatttttccttctctaccggatctttctcatcagcatatctacatgctttttctcccattttaaaatcaaatcataatggtaataaaatttctcttaactccacttttccctaccattccatcttcttcacaattgaatattcctaaaattgcttctcatctctaacacctcaaaactagttttcaatttcatctattttgttgccaagagtcacagtgatttttggaacgtgttgccaagttcaatgtaatagtccactgtggtcaaccgaggtctgaaaagattaaatggaaagtaccagaagtaaacaattcatcaattcatgggttttggccgggcgcggtggctcacgcctgtaatcccagcactttgggaggccaaggcgggcggatcacgaggtcaggagatcgagaccatcctggctaacacggtgtcaccccgtctctactaaaaatacaaaaaattagccgggcgaggtggcggtcgcctgtagtcccagctactcgggaggctgaggcaagagaatggcgtgaaccccggggggcggagcttgcagtgagccgagatcgcaccactgcactccagcctgggcaacagcgagactccgtctcaaaaaaaaaaaaaaagaaattcatgggttttatttatttatttaattcgagacgggatctcgctctgtcgcccagactggagtgcagtggcgtggtctccacttactgaaacctctacctcctgagcttaaatgatcctcccatctcagcttcccgagtagctgggactacaggtgtgagccactatgcccggctaatttttgtatttttggtagagatgaggtttcgccatgttgcctatgcttttctaccaaaaatacaaaaattagccaggtgtggtggttcacgcctgtaatcccagctgttctcaaactgctgggcttaagcaatccacccaccccggcctcccaaagtactgggattataggcatgagccacaatgccctgccataggttttaaattgtgtgctgttctgagtagcataataaaatcttgtgctgtcctacttcatctcacttgggatgtgaatcactcctttttccagtgtattcacgttccatgtgctacctgcttgtaactcccttagtagctgttttggttattagatcgaaagaacatatatagggtttggtaccatttgtactttcaggcatccacttgaacatatccctctgtggataaggggggtactactgtagtcagttctcagacctcttgttttatctcatcaatattttatacagttgatcatgccctcctcctttaaacactttcttcatttggcttccaggcgttacactcttctgattttcgtccttctcactggtcgctcttttcagtctcttgatggttttttttcatctgctcagcctcctactattggagttctccagggctgaatctatggatctcctttgttttcttctccacactcactccattagtgatattacttggtttcatggctctaaataaaactatatgttgatagtcacatttatatcaacctagacctttcctctgaattccaaacttacatgtcttaactgccttctgaaatttcacttgaatgttaagaggcatctcacacttgatgaattccaaactgagttactgatcttttcctttcaaacccattccttttcaaagtctttcccatgttggttaatggcaactgcattattcttattatgcagatcagaaactttggaatcatccttcatttttctcattctcttttacttcacatccagtacaccagctaattctgttaacctctatctttaaaaaaatcttagaatctgattaccttttttttttttacctctactgttaccctatcattccaaattaccatgatatctttccaaaatgttctgatttaaaagtgaattagaatatatcactattctacccaaatcctccaatgctttagttctcacgtgtagtgtaagctaaaatcagttcatgacctgtgagttcttacacaattttgttccttacattacctctccaacctcagttctgctttgctcccccttggtcatattgttgttcttcttattgttctccaagtgctctaggcacacttctacctcactgtttttgtagtgactgttcctatgtctgaaaatgctttttcccatgggacttatttgcatgtcttattctcttactttctttggatattgacttcagtgtcatctttccaataagcctttcctggccatgctatttaaaatggtatcctcttccctctaacacatttcttaaatttttaaaatttttactctcttgtggacatacgcaatccaacacgtttcttcattttattttccttcagtgtacttaccaccatttagcttactgatttttaactgtatttgtatttattttatgttattttgtctctcctcagtagaatgtaggatttaaaaggtcaagagttttttttctattttgctcactgctgaatacctgatacctagaataatgcctggcacagagtagacctaataaaatatctgaatgaatggattaataaataaaaagcaggtttaaaaaaaaacttgagcatgtttaaaaagaaacaaacttaagcatgtttaagtggtttgggtacggatcctgtagagaggaagaggctgacagtctaagagaaaggaaataaataacagaggatcaagatccctaaggaggtagaagggtatgggctccagagcacaagtagagagatgaacattcgatgggagaatggaagggatgaaaagatgtataataatacaaataacttagctttggtagggataagttgatgtagtttctgtctaatggctttattttttctctgaaatgggaggtggtagtataggtactggatggtagtcttgggaattacagaaaagtgtagttttgaaatgatccttgtggagaaaaggaaaggaaactagagaaacaaatattatctggcaatattgaggtttagctagggattgtaaccataaatttacagtggcgtcattttccatataatattcttctttataaagcttttccaaggaatcaaagaatgttggctatagcagattcataatgtttattgctattatcataaattattttttattttaaaaagttctagtcctttagccaggtctgttgtcttcatagaacattgttctgttacccataaaagatgccattaagactgtggcctgggccgggcgcagtggctcacgcctgtaatcccagcactttgggaggccgaggcgggtggatcacgaggtcaggagatcaacaccatcctggctaacatggtgaaaccccatctctcctaaaaatacaaaaaaaaaaaaaaaaaaaattagctgggcgtggtggcgggtgcctgtagtcccagctactcaggaggctgaggcaggagaatggcgtgaaccctggagacagagcttgtagtgagccaagatcgcgccactgcactccagcctgggtgacagagcgagactccgtctcaaaaaaagaaaaaaaaaaagattgtggtctgagcatactccacactttgaacatgtctacagatcatacttaggtattgtaaaatacctaatttgacaaatgagttttagtaattttataacttggccatattttttataaaatcatataggaagactttgttttatatcttacaaaaattttgtgttaaataaatagatttagacatagttttacttcttcaagttgccagttgggttaatttaaaaacatacttgcatagaagacttgaaagcatttgtatttgttttcttttttaggggcaaaaaggccccgagtcacttcaggtggtgtgtcagagtctcccagtggattttctaagcacattcaatccaatttggacttctctccagtaaacagtgcttctaggtaagactgataaagattgagtagtttttgattgtagtattccccatgaagaataatacatgtatgtgttttttcataataatcgacattaacataatactgtaagcatgagaacttgtgtgtgatataagaaaggcctgatagattttattttattaaatgtatgtttctttctgtcttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtattcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctgaagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcctgcgtggccaacagagtgagactgtctcaaagaaaaccaaacaaacataaaaatacaaagtaattagttaatttgaaaaagaaactatttaagtaaaatgttctttactttaagaaataatacttttttttattttgttttattttttaatttttaatttttagccactgtgcctggcctaagaaataatatttcttaaaagacctttttattgttattaaaaatagtagggagctggaatcattatctttgtaaaaactatgtatacttaaactgtagacaataacagttgactgcctactatgaaagacgaatacattagcaatcccacactttctcccatctcccttgattgcacccgtcaatttttattgtttatattattagagcatagttataacattggtattctaaactgtctttaaggcttttcaaaaaaaatgttaatgtcaatgaaagacaaatagggtagctgttttttactcaaggagactaaagaggcctgataactaagtgcaagtgcaatgcatgatctttcactagatcatgtatttgaaaaaaactataacggacattattggaacaattggggaaatttgaatatggactgtatattaattaggtaatgtttttgtatcagcgtcagatttcttgggtgtgataatactgtggtttgtaggagaatgcccttgttcaaaggagaacaagtgtcaaagcaaagttgaagtgaagtgatattttcattcagcttaaaatttaaaaaaataaagggcaaacaactacataaaggccaataaacacacacatatctggtagataaggccaatgaagagtatatggttatttattatactcttttttcagtttttctgtagattcgagttttcaaaattaaaaattgggggaactgttactgtgtagaaatctgaggtcagcctgatagtcttctcactcacataggtgattcactttctttcaggtagactcagagataaaatttgcataacataagaatcatcactttaaccattttaaaatgtaaaatgcagtgctttttagtatattcacaaggttgtgcaaccatcgcccctaattccagaacattgcatcaccacggggaaaaaaaaacaaaacacctctgtaccacctagaatcactctttattcctttcttgctccattcccagacaacctcgaatctactttctgtctttagggattgcctttttggacattttatataaatggaatcatataacatgtagtcctttgggtctgtctgctttcatttagcacgttttcaaggttcatagcatctatcagtactttattcctttttatggctgaataatattctgttgtgtgtatgtattacatttcgtttatccattcatccactcatggacatttgggttgtttctactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacgttcccatcagtaatgtaagagggttccaatttctctacaaccttgccaacacttactgcctcccctttttgctatggccatcctagtgtgtatgaagtcttatctcattttgcttttgattttcatctctctaaagactaatgatcttgagcatattcttatatgcttattggccatttctttataacagtatccggatattttgtccatgctttaactggcttgtttttattgttgagttgttagagttcttttacattctggacactagaaccttgtcaggtacctgatttgcaaatattttatcccattctgtgggagaaaattcccccattcttttgttttcttgttagtgtcgtttgatgtactcaagttttagattttgatgaattccagtggatctataatttctcttttgttgcctatgcttttagtgtcaaatttaagaaactgttgcctgatgtaagattgtaaagatttatactttatgctttcttttaggagtcccagcctcctaagtagcggggactacagtcttaaagtttagctcttatatttaggtctttgtccattttgagttaatatttgtatatagtatgatgtagggtgcaaattcaaatgtttgtatgtgaatattcagattccagcaccatttgttgaagatatgttttactattagatggtcttggcacctttgttgaaaataaataggtcatagatgtatgggtttatttctggaatctcaattctttttttttccttttttttttcttcccctgtggactcaattcttttatttcatggatctatatgtctgtgctatgccgttaccacactatgttgattactgtagctttatagtgaattttgacattagaaaatatgagttgtccaagtttgttctttttttcaaggtattttggttatttgtggccccttgtttttctgtcttttaggattatcttatttctgcaagaaaaaaatttggaattttaaaagagattacattggggagtatttccattttagtatatattgagtattctttattcaaggtgcttgggaccaaaagttttgtggattttacatttgtttggattttggaatatttgcatatgcatattgagataacttacagatgggactcaagttgaaacatgaataattttatttatgcttcatatatacctgatacagatagcctgaaggtaattttatacaatgttttaaataattttgtgcatgaaacaaagtttgtacattgaactatcagaaagcaaacctgtcaggtatgaaattttcagtttgtcacatgatgtcagcacctgaaaagttttggagtttggaacattttggatttcagatttgagattaaggatgctaaacctctaatagtaactcttctaatccaataacatggggccttttttttcccatttttttagggtctttaatttctttcaagaatattttgtagttttcagtgttcaagtcttgcacttcctaggttaaatgtaatcctgtttattcttttttttttttatcctgatgctgatgtaaatggaattttttaaaattttattttcaaattgttcattgctatatgcaaatgaattttgtatattgatcttgtatcctgaaaatttgctgaattcattaactccagtagtttttttgacaaattctttaggttttttaatatattaagattacattatttggcagggcgtggtggctcacgcctgtaatcccagcactttgggaggccgatgcgggtggatcatgaggtcaagcgtttgagacctgcctggcccacatagtgaaaccccgtctctactaaaaatacaaaaaattagctgggcgtggttgtgggcaccggtaatcccagctactcgggaggctgaggccggagaatcacttgaacctgggaggcggaggttgcagtgagccgagatgacgccactgcactccagcctgggcgacagatcaagactccgtctcaaaaaaaaaaaaattacattgtttatcaatagagatacaggaaattgttttacttttttttttttttttaacccagatgccttttaattctttttgtttagttgtcctggctaggacttccaacattatgttgaacagaaatagagtctttgtcttgttcttgatcttagggttaagtttcgagtctttcagcattaagtatgatgttagctgtggggtttttgtttttatggtgaaagagtattggattttgtcaaatgttttctccgtctattgagataatcatgtggattttttttccctttattaatatagcttgacctcctgtgcccaagtgatcctctcatctcagcctcctaagtagctgggactacaggtgtacactatcatacccagctaactttttaaaaatgtttttgtagagatgcagtctctgtgtttaccaggctggccttgaccttctgggctcaagtgatcctcctgagtagtgggtactacaggtgtgcaccaccatgcccagctaaattgacagttttcatcagtctgtttattttgtctaatgttagtatatccacatcagctcaccagctatcttgtgtattttcctttttttagatggagtctcactatgttgcctaggctagactgtagtggctacttaaaggcacgatcatagtgcaatgcagcctcaaattcctgggctcaagtgaccctcctgccttggcctcccaagtaggtgggactgcaggcatgtaccaccatacccagctaccagctctcttttggttattgtttccatggtctattttttttttccttttccttttaacctatttgtgtctttgaatctaaagtgccttagccaggtgtcatggctgacacctgtaattccagcactttaggaggctgaggtgggtagatcacttgaggccaggagtttgagaccagcctggccaacatggtgaaaccccatctctactaaaaatattttaaaaattagttgggcgttgtggtgtgcacctgtaatgccagctattggggaggctttaggtgggaggatagtctgagccattggagatcaaggctgcagtgagtcgtgatctgattgcatgactgctctccagcctgggtgacagagcaagactgtctcaaaaaaaaaaaaaaatcgcttcttagccttttggctaagatcaagtgtagtatctattcctatcagtttaagtgccttaatttctcttccactttttggacaggtagttttgctggatatagaattcttattagcttttgtctttcagcactttgattatgccactactgccttctagcctttgtggtttctgatgagaaatcagctgttaatcttactgaggatctcttttatgtgagacgttgctgctctcttgctgcttttatgtttctctgttgaccacagtttgactatggtgtatcttggtgtggatttcttttttcattctgttcggagttcgttgagcttcttggatatgtaaattaatgtttttaatcacacttgggaagtttttggccacaatttcttcagatttttttttttatatctaactctcctctccctcttggactcattatgtttattgttggtatacttgatgtgccacagttcttagactctgttcatttttctttattcttctttctttatgtttctcagggacagttttggttgctgtttttcctttataagggccatactttgtttccttacatgctttgtaattttttgttgaaaactggacatattgtggcaatatgtggcaactctagaaagtcagattttcccctcttgccagtgtttgttaccgcttgatgtagttgtttgttttttttagtggtgtttgtttttttttttttttgagacggagctttgctcttgttgcccaggctggagtgcagtggcgtgatcttggctcactgcagcctccacctcctggcttcaagtgagtctcctgcctcagccttccaagtatctgggactacaggcacctgccactgtgcctggctttttgtatttttattagagatggggtttcatcatgttggccaggctggtctcgaactcctgacctcaggtggctgggattacaggtgtgaggcaccatgcccggccctagtgatttttcttatataattttttaaagttggtattgtttgtcatgcatggctgtacaatttctgtcccattagttttagtggtcagctaatgattggacagagatttccttaaattctgtataccaaaaacaaaaaatctgcagagtgttctgtatttgtgttggggcacacctgcaatactcaaccaagaagtttacaacgttgcttcagccttcgctatctgcttgtgcaaaatgcaaagttagggcacatgtagagcttaggggccttctcagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttgggattacaggcatgagccactgtgcctggccaggacaagccttttgatcaggtcattttagagggtcagatcggcttaagatagtttgtaaatgaggtttattctgctcccacctggacctatgccttaaatatgaactgttattttcaaggctgctactgagtgaggagcaggggataaacagggtaagttaaaatgccagaaagctcactgttcttactgcgtttcacttgttttgaataagttgctgcaagcttttagctagtttacaatgttctgaaaaagttgattctgacaggctttggcaggtttttaaaattgcttttgtggagtaatggacttctggagttcttttctctgccattttcactgacatcactccttgattcactctctctcagttcttgaagtattttctttgtctttgaagtttaagagcttaattcagatgtgttgagttgaatatcttgtattaattttcccagaacatagtgggttatttcagtgctgcacagtcgtggtatggttgtgtgttttcatagtttcttgaagtaagaattattacaaaaacttttgtaatttgggctgtgttttttgggcaaatctgctgatctcgctcgggcttaactcatccagctgtagtcatttgatgtctttactgtggctggtggtctaaaacatccttactcccatatttggagtcttggcactgtctgttagctgagtcttttctttctgcatcattcagctaggctgagcgtctttccatgccataggaacgttctaaaagactgaaagtggaagttgaaggcctctcaagacctttgccatcttctaattgccgctctagcttttcagccacaagtcaggcctttttctttctcacattttaataatcttgtttttcctcccattatgttttcatctttgattgtttcttctttcagtggtattttggtaaaagacagtaagttttgttgctatgagttcatatacactcaatccctaggagctgcacccctgttgatagattgggttggggacacacatacccactgggagaagagagactctggaatgagtgagattatcagcatacttaatattactcctgttatggaggtagccagcaaattttttttaattgatacaataattgtaatgtattcatggggtatgtagtgatgttttgattcatataatgtataatgatcagatcaggataattagcatattcataatttcaaacattgtgggaatgggaatgttcagtgatgggaatgttcagtatccttctagcaatttgaaactctattattgttaagtatagtcatcctacagtggtctagaacttactcctatctagctgtaattttgtattctttcatgaatctctatctttcccttccctctccccttcctggactctagtatcctctgttctgccttctacttctatgaaattaacagtttttttgtttccacatatgagtgagaacatgtgatgtttaattttctgttcctggcttatttcactttacataatgtcctccagttccacccatgttgctgcaaatgacaggatttcattcctttatatggctgagtagtatttcattgtgtatatatatcatattatcctcatctgtttgcttggctttttgttttgtttttttgagacagggtctcgctctgtcgcccatgctagagtgcagtggcgcaatcatagctcactgcagcttcaacctcctgggctcaagtgacccttctgcctcagccccctgagtagctgggcctgtaggcatgcaccaccatgcccgctaattttttgggaattttagtagagatgaggtatcgatatgttgcccagcctggtctgaagcgatccttctgctttggcctcccaaagtgctggattacaggcgtgagccacagtgcctggcctacactcatctgttgttggatacctaggttgattccatatcttggctattgtgaataatgctgtagggttgcaaatttctcttccatataatttcctttcctttggatcagtagtgggattgctggaacatataggtagttttatttgtagttttttgagaaacttctattctgttcttcatagtgggtttactagtttattatctactcacccatgtggcttaaccttatttttgttgccttaggttactatatcaacaactgataggagaaacaataaactcattttcaaagtgaatttgttagaaatggatgataaaatattggttgacttccggctttctaaggtatttttatgttttattgtattctttctatggaaatatttctatatgaatttttttaatggcattatgtttgtatatatgtggcatttgtaaataggttacttgcttttttcgtttaatattatgagcatgtgttttcgttatctatttttcccgaacattgtttttttcaaatgacattttccttattataaaagtttttgccaggcgtggtggctcatgcctgtaatcccagcactttgggagtccgagacgggtggatctcgaggtcaggagtttgagaccagcctggccaacatagtgaaaccccatctttactaaaaatacaaaaaattagccaggcgtggtggcgggtgcctgtaatcccagctacttgggaggctgaagcaggagaatcatttgaacctgggaggcggaggttgcagtgagccgagatgacgccactgcactccagtctgggtgacaatacaagagactctgtctcaaaaaaaagaaatttctgcttttgtgaaaaatgtagataagcaaaaaatgagaaaataaaaataattctaaattttcagtgatcacattaatatttcgaagcattttaatatttttcttaatttatgtcttttaataaaaattatgatttgttacaaatatttcattataatttaatgaacctttaccagttataataattctgtgattgctattttatgcatagatttttttgttcatatttctgatgatttctttagaaatcattgattctaagatgatagtattacagcccttgatatataaaaccaaaataacatttttctctattttctgagagattgtatgtggctctaaagagggttggaggggtagctgctgtgttagagcatttgccgcagtactctttgtattagagatttgctgcaatactgtttttcagatgcttgctacagaattaaattaagatcgtagtataatgaaattcttctcataactaaatctattgattttggtcagtagtgttatgacaacaagacttcagtttagttgtatagtttattgttagtttccaaaccctcactgcctatggaatgtaatgacttaggtccagatataccaacacctgaaacagataggatgccatgtttatctgctctctgagctcagtgcagtaggaacagtgatgggcatgaaaccacatcagaattatttgtgtaacaattttctcttccaggatatttggtcttcataaacagaccgaaaagaaaatggtagctagacatacctaaagatgtttgtctcttgttaccactacaaagagattgattttaggacagaattttgtttttgtttttgttttgacataattttttaatactatttctaatatagggtgatggattggagttcaagagacacttcctgaagattaaagggaagctgattgatattgtgagcagccagaaggtttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaagataacagttcaaattttgatggaaaaatcaacctatgcttgtgtgtgtgtgtgtgtgtgtgtgtgtgtgtgtaatgtgtacagtgtgtgtggttgttgagataagcataattatataaaaatatgtgtgtgtgtgtgtaatgtgtacagtgtgtgtggttgttgagataagcataattatataaaaatacataaaatatgtacacttcaatgtgcagttgtaaagttaacattcacttaaccacaactcaattgtagaaagatcatttacagacccttaagaacttcctatatgcagtctcccaatcacaacccacttctttcccccagaaataatcacaaaatagactttggtgataatcttttccttcgtgtgttttagagtgttctcagctatttatgcaaataatatcatttagtttatgtatttttaattaatatggtttttattaacgaactttatatacattttgctgtatttttcatgtgttgattttttatagccatgcttttgtgcatattgaattcattaattttaatttttatataggatgtatttatgaacatcccactaactattctgctgctaattgatatttggattgtgtacagttcgatgctattataaaattcttctaaggacattcttgtacatgttcatttgttttgctaggtcctagagtctaaggtatatatccagaagaggaatagc

SEQ ID NO: 16307 - DNA, 32211 bp, Human
gtttcgctcttgctgcccagactgaagtgcaatggcgcgatcttggctcactgcaacctccaactcctgggtttaagcgattctcctgcctcagcctcccaagtagctgggattacaggatcctgacaccaagcccagctaatttttgtatttttagtagagatggggtttcaccatgttggtgaggctgttctcaaactcctgacctcaggtgattcacccgcctcggcctcccaaagtgctgggattacaggcgtgagccaccgcgaccggccttaatattcttaggttagtacttaaaaaaaaacaaaagaaacttgaacacaatctttctaattttaatgcccccctccccgcttttttatttttaaagagaaaaaacttctttttgagacggagtccagctctgtcgccaggctggagtgcagtggcacgatctcggctcactgcaacctccgactccctggttcaagtgattctgtgtcagcctcccgagtagctgggattacaggcacgcgccaccacgcccagctaatttttctatttttagtagagacgggtttcaccatgttggccaggatggtctctacctcctgacctcgtgatccgcccgccttggcctcccaaagtgctgggattacaggggtgagccaccgcgcccgaccaaaactcgtattttgaagaagcatttactccaagttctgtaattccttcaggctcagcttcagtttccttttgttaaagtaaaattacatggaacacttactactaaaaacaaaaccaaaaaaaagcagatctattgaatcataacgtcctggggcgagcctggtcatgtggattttgaaaaaaatgcatgtgattctgaagcagtgatttaaataatgacctttcaataagtggtgggttccgttcatgggagaataggaaactgcgtgagtggtagaggcaacaagttcgaagagctgcgggacgttcccactctctctggtgtagccttggctcaccgaggcgcgcagggagtggaagtgcctgaggataaaggtgtgtacgtgcgagtctgagatgatggaattgctgctcaaacttcgtccccttctctgccctcagcaaacttattgggggtcggggagcgcgtggggtgcgagagaagagaggcaagttaggatagggagagcggctctctggccggtattttaacaaagggctgaactgactaagcatggccgggctgcctcccggtctcccgaggaagcccgcttgctgctggggagggctgtgcctccgcggcggtggctgtctcagctggcagtagaaatgcttccagcttagccccgacaacccctttaggcctaggcacgctctttcacaaaaccaggggctgtgaactctgtcaaggttcccaggtccatcgcagttaccagggcacagtaaaagctcgagtcaactatcaggcacatcctgcaaaagacgaactgtctggaccagtccgcgtttgagttttaattgagaataaataggtagaaaatgcttccctcctctcctttcaccttgtattaggtaacaatttctaccttaaaaaagacgggagacgagcggctccgcattccgagttactgggacttggagcaagggcctatttcagcgtagtttccgcttcttgtcacatgacgggagtcagtgggccgcgccttcccactgcgactccccgtgggtccgcaaaccgacacgtcactcctcggccctcaaccaaactgcttggggcacgttctttccgcgctcttgactcctacgcgccggcctatgacagctcggcgggagcatacagacctgcctctagactgctaagtgatagctgtaatgaccaattaaaaacttgaatcgcggcccggtttacgcctccggatttgacagacagttccgagaccctatcgctctccagaagcgtcctattggcctggagccagccaacgggggagcggtccgggaggcggacccggctcctgccagggttgggtgcgccgctgaacggatggctgagggagccccgcggatcgtttaggaaagccggccaggtgagaaggccgtagaacgtaacttgaaaatcagcggcaggtgcagtccatggcgttgatggggctgaacgaagtgcaggaggcaaaactctaaatgggggtggagagcagagcttagggccttgcagaggagggggcgtggggcgtggtgtgggggcttcctggatggaaggatgcgaaggtctagggagggagggtaaggtgggtcttgagaacagagcgtgggaaagactgggtcctgggactagttatggaggggaaggcgcgtaggatgctggggtgatgagtgtcccgcgctgaggggtatcagaggtggtcagttctttgagggtgggaagaagagggaggtgggacccgctggaacgaccggaagggagaagagagtaaaagatcgtgagagggtgtggaaacgtgtgtaggaaaacggggctggggaaattgcagtctgggaaactagaggcagggtggcaggagatgccacagcttgcagggcacagttgaggagagcaggttggtaagtgttttaagaaaggtgtctttgctcttatttgcttggcggtgtgcgaaagtgaccaaagagcacgagatgaaatctcccttacggccctgccctcaatgactagctcgtttactcaagttttcaagtagagatcctagcagtctcattttggtgtgtggctcgtatcaacgcagtggtgttaagtttgttcctatttcaggcattccagaaaacagctgcaaaccctgagagatatggctggattgttgacctcctggagtagttaggcctttatttttagttgcaaagtaagctttccctttgggactatacttaaacacatttctaaactgctcttctgggacagttaattatggagaacatgcttgacttctcagtgttggggctagcattctatatgccttccacctagtccagtgttgttgttttgtttttctcctttattccaataatagtgggaaaaaagattcatggaggaggatagacaaacgtttgttaagggatacacaagtacaactagataggaataaattctagtgttctataggataactattattaggagtataattaacaacaaaaatacacaatttgttgtatattttcagatagctagaagagtggattttgaatattcctaagacaaaaaaaataaggtgatgaatctactaattatttcccgacttgatcattacacattatatacatgtaccaaaatgtcacactgtactccataaatatgtacaattatgtgtcagtcaaaaagaataaaagcaaaacatcttgaatggtgttgcatatcctttgttatagtcgttataacttagctcttgatcaccttgtaatttaaaaaagtaggtctgggcgtggtagctcacgcctgtaatcccagcactttgggaggctgaggtgggcagatcatgaggtcaagagatccagaccaccctggccaacatggtgaaaccccgtctctactaaaaatacaaaaattagctgggcgtggtggcgcacacctgtagtcccagcttctcatgaggctgaggcagaagaatcgcttgaacccaggaggtggatggaggttgcagtgagccgagatggcaccactgcactctagcctggcgacagagcaagactccgtctcaaaaaaaaaaaaaaaaaaaagatagtagtactgtcttatacaagaataactaacctatggtagattagtgctatattgctatataaataattcatatctgtcatgtgatttccattttgaactgcctacagatagtgtccctcaacattttaatctactttttttaatcccccgactcttctgcttcagtaggaaaaattcgttttctttccctctagattatcatctgatgccatcaaactgtctgtgtaatttaatcagtctcttaaatcagcattgtcagttacagagaagccttgagacagatgattggaagcgggtatagatctgagcagtcgttacagtctgatatatgggatgagagcacagtggatctgtgtttgggtacctccacctctttttgagtgcatgattgtacctgcattagttatcaggtatgctgttagttgacccgacagccccattgggatttggaaaagaaaaaagtttatagccattcagttgaagtttaaatttagggctcgaaattgtgttgattcagtggtgacttctatttttcctcttaatgcctttcacttcttctttttttttttttttcctttttaaagagaggaggtctggctctattgtccaggctggagtgcagtggtgtgatcctagctcactgcagcctccaactcctgcctcatcctcctgagtagctgggactgcaggtgcagaccaccaagcctgcataattttaaacagttttttgtggagatggggttttgctgtattgctcagattggtcttgaactcctggcttcaagtgatcctccctccttagcctctgaaattgctggggcttgcacttctggtctcaatgtttatttcctgcttccccccctccgcccctgccaccccatatagtcctgccttttcttgagtgctctctttctccattttattatttttcagtatttccaatctttcctgtttattttttcatctcttccttgtgctatactattgctaattgtgcttatgtacttgttagctgtgaaggagtgggaaatagaattatggatggtttattctgaccactccattttagtcttgacacatagacctgacttgtgcctacttccttgcaagttgatcatactttaggccaggcttggatactagtattagccttgaccctgtctggtgtttttgctagctcctacgtcctttatgattccctctcatcataaaatatgaaaattaagtaaattgaaggtgttcaatatcttgtggtcttgactttttcattttagctgatcgtcgtgtgttgccacccattcatgtcaagatgactaagtttggatttttgcgattgtcctatgagaagcaggacacacttttgaagcttctcattctgtcaatggctgctgtattatgtgagtgtgcatgtgaacctctctttctttggggatagaaagaagaaagtctagaaaaaaattgaaaatcgctatcttaaaatgccttgttctttttagcagattgttacatttttccattcctcattagtataattttatgaaggcaaaataaaaggaatataaaagtcagggctatgggccacatgcagtggttcacgcctgtaatcccagcactttgggaggctggggtgggtggatcacttgaggctgggagtttgagaccagcctggccaacatgatgaaaccctgtctctactaaaaatacaaaaactagttgagtgtggtggtggatgcctgtattcccagctacttgggaggctgaggcacgagaatcgctcgaacctgggaggcagaggttgcagtaagccgagattgcaccactgcactctagcctgggcaacagagcaagactctgtctcaaaaaaaagagggctgtgatcatctttgaaagaatgggaagcatgctgtgccaattctgttttctcatagggttgaaagtgatattggggacccttggataactgatttttgtaaaagacaattatcttcaatttagatgtctcctatagtatttttgaaagtctcttgagagtttactctgtattttagattttctggctcttcatgagtcctaggtgtaattttgcttgccatacctattactttgctccaaggttaaggttagttatgtgtgtatggtgggggagtcagcgtatataaaagatgaccatgtaagttgagtttggtattagtaggtgaatgtaatgttataggcttttataattagttaactgtgacctatgaaagtggaaaatgtagatgccattgtcaggggaaagtaaacttctcttgtttcctttatgtggggaaagatggataaagactttattcagggattattttatattttctgtgacctctctactggataatactgtcttcattataatactatatctgctgttctttcatggcacattaccaataaaatattaactctctggtttttgcagccttctccactcgtctgtttgctgtcctgagatttgaaagtgttatccatgagtttgatccgtgagtacctttgcttgatctggtattatttcctttgggaggcattcaggttcatgggtttcagattcaaatttcagtcagctctcagtgatagagatgtgctttcagtacatttaagggaaaaaaaaaaccttaaattcttccaaaggagataattatctccttttaagacgtatgtgttggagtccagcacagtggctcacacctgtaatcccagcactttgggaggctgaggtggagggatcacttgagctcaggagttcaagaccagcctgggcaacatggtgaaaccccatctctacaaaaaaaaaaaaaaaaagtatgtgttggaattgaccaagtaagtctctgaaactcaaaaaatgtgagaggcattgctagtatgtctgcctatcacttaagatctggctaggctaagagaattctggctgcccagtttggtaaaagtttgtgatgcagattgaaggaaagggtcctggtgtgtattccaggctcagaagagaatcacaaacaatggacttgagattcatgacattttgctgtttgtttgtttgtttagcaatttatgtgatagaaattgggcttcttagttaaattctagggcaatgaaaaaactcaaagttatcagtttgataaggaattttgttcattagatgaaaaagatatagtggaattccttagtggtattaataactagtatttactaagcattcattttgttccaagcactaatttacagattatctctaaatcctttcagcaaccctttgagatgtaggtactattattcccttcttagaaatgaggagactccactgggcacggtggctcacgcctgtaatcccagcactgggggaggccaaggcgggcagatcacaaggtcaggagttcgagaccagcctggccaacatagtaaaaccccatctctactaaaaatacaaaaattagctgggcatggtggcatgtgcccgtaatcccagctactctagagactgaggcaggagaatcgcttgaacgcaggaggtggaggttgcagtgagccaagatcatgccactgcactcctgcctgggctacagagcaaggctccatctcaaaaaaaaaagaaaaagaaaaaagaaatgaggagactcaggctgggagtggttatctaaggttgattattcagtacgtggaggaaccgtgatttgaatgttggtttgtctgactccagagactgtagtcactgtgttatattgcctaaagttaaggcttataacaaatttggagggccaaaatcataggttcttgaaatattattggtatcttaaaaatagtatattcaatcttgtggagtattgattgaaaatgcctgcatctatttgcaaatttataattttgttttgtgtagatatttgaaagcattttggaggcattacaaataattctgtttggggcctcccaaattcagtttatattttttctcatgaatgaggagacatgtccttttgttttttctttttttgtttgagattgggtctgactgtcacccaagctgaagtgcagtggagtgatcacggcttactgcagccttgacttgtggggcctaagtgatccccccacctcagtttcccaagtagctgggaccacaggcatgtgccaccatacctagctaattttttaaaaattttttgtagagatggagtctcactatgttgcccaggctggtctcaaactcctgggctcaagcaatcctccctcctcagcctcccaaagtactggcattacaggtatgggcttccatgcccagcctacttttgtttcttgatcccaatctgttaggcttctttctcagaccctctgaatgagcaaatattgatgttagataatcaaggaatgcaagagcatctgctttgtcgtcaagagctgttagggaccataagggacttgacacttccttttgcagaggaggaaactgattcccagagtggtgaatgcagtccagacctattcctactaacttatacttcctctctcactctgcctctcctactggtagctaaaggacacaattctgacacatactgatgtctgcaaccctcatctcttctgtttctgacagtcaccaaaataacatcagtgacaaacagaaggatagagatttctgccatctgttgcttctgtttacttcagctttcaaaacttgactgaccaaggaggaaatagggttagagaggtgggcagagaggacggttagtcatgattatccatagtaattaaactgtctctagtttgagactctttgtttatttttgtctgtcttccttttttttggaaacagggtcttgctgtgtcacccaggctgaagttcagtggctcagttatggctcatgcagcctcaacttcctgggctcaagtgatcctcccacctcagcctcccgagtagctgggattacaggcacgcgccaccatgcctggctaatttttgtgttttttgtagattgggtcttgttatgttacacaggctggtctcaaacttctgtgctcaagcgatccatccacctctgcctcccaaagtgctgggataacaggcatgaactactacaccggcctcttctttatttttatttattattattattattattttttgagatggagtttcgctcttgttgcccaggctggagtgcaatggcacaatctcagctcaccacaacctctgcctcccgggttcaagcgattctcctgcctcagcctcctaagtagctgggattacaggcacgcgccaccacgcctggctaatttttgtattttttgtagattgggtcttgtcatgttacacaggctggtctcaaacttctgtgctcaagcgatccatccacctctgcttcccaaagtgctgggataacaggcattaactactacgccggcctcttatttatttttatttgttattattattaattttttttgagatggagttttgctcttgttgcccaggctggagtgcaatggcacaatctcagctcaccacaacctctgcctcccgggttcaagcgattctcctgcctcagcctcctaagtagctaggattacaggcatgcgccaccacgcctggctaattttgtatttttagtagagacagggtttctccatgttggtcaggctggtctcgaactcccgacctcaggtgatccacctgcgtcggcctcccaaagtgctgagattacaggagtgagccactgcgcctggccttattattattattatttattttattttttgagacagggtcttgctctgtcaccaggctggagtgcaatggcatgatcagggctcactgaagcttcaacctccctgggctcaggtgatcctcttatttcagcctcctgagtagctgggactacaggcgtgtgccactaagtcctgctgattgttgtatttttttttagaaacagggtctctctatgttgcccaggctgatcttgaactcctgagctcaagtgatccacctgccttggcctactaaagtactgggattacaggtgttatctacctcacccagccttatttctttttaaataagaaacttaaggacttacatattttgggcctaaagaactatctttccatttaaagctcttaagcattttatgtcaaatatttttcatgttgtctatgtatctgtgtatctttctatattttttttgagaaagggtcttgctctgttgcccagtctggagcacagtgttgtgatcatggctcactgtagccttgacctcctggactcaagcagtcatcccacttcaacctcctgagtggctgagactataggtgtgtgccaccatgcctggctaatttttaaaaaatgttttgtagagacagagtctcactgtgttgcccaggctggtcttgaactgggcttaagcgatcctcttgcctcagtcttccaaagtgccgggcttacaggcatgagctgccatgcctggctgtaatctatatttttatgcttctatataggtgacataagaagcattttagataaccacatgagtagaccttgttaaaagtttaaacactgattaagaaagttgtgttatgaagtaggttaaaattttttcatcctgcatatgatggtataccaacatctttaaagattctcatcactggaaattattcatgtgtctttgtgtgcagtatagatttttaaaaatatgttcctgtcacttaaaagccagaatctggccaggcatggtggctcacacctgtaatccaagcactttgtgaggctggggcaggtggatcacctgaggtcaggagtttgagaccagcctggccaatatggtgaaaccctgcctctactaaaaatacaaaaattagctgggcattgtggcgagcgcctgtaatcccagttactttcagaaggctgaggcaggagaatggcttgaactccgtaggcagaggttgcagtgagccgagatcgtgccattgtgctccagcctgggcaacaagagcgaaactctgtctcaaaaaaaaaaataaataagaaagccaaaatctattggtgcccacatctcagtggctttgtcttcatggtgcttgaattctctgactggtcctaatgcctaccacatgtcagcttgttgaagtatcccatttgattgctttgttacaatgttaggctccagtttcatttcctttttatttatttatttttttttctgagatggagtcttgctctgttgcccaggctggagtgcagtggcaatctcggctcactgtaacctctgcctccaaggttctagcgattctcctgcctcagcctcctgagtagctgggattacaggcacatgccaccgtgcccagctaatttttgtatttttagtagagatggggtttcaacatgttcgtcaggccagtctcgaactcctgaccttgtgatccacctgcctcggactcctaaagtgctgagattataggcatgagccactgcacccggctcatttccttatgagaaaagcagtgctttagttgagacaagcatggagatagaagtaaacagacttatggtagtgtaaaatgattttcatggcataatatctgatgttaaactgatttttcattgagtaatgctgaatttctcaatggtgtatcctgaggagcaaaattcaccacaaatttacaacaaagtttatttcttgctataggtactttaattatcggactaccaggttcctggctgaggaggggttttataaattccataactggtttgatgaccgagcctggtaccctttgggacgaatcattggaggaacaatttacccaggtgaggagaccagatgtgtttttttttttaaaaaaaaaacagaaatatttgtatgctagagaaccagtttcttttatttctaatagctttgtcttgtgacacttgtaatttcatcctgattacaggttcctaaaagtgcatcttacataaacaggagtacatttgtagtagagtggagatgggtggtttttatacattctagacttctgattgaatccttaggggagaaatttataggcttactgcagttgctatgttagtatttctggtgatttgtcaagacttacatagtcactttattgtatctgggattttccctttctttttcccttaagttctggtaagacaacctaatggagtttcttcttcctgttacaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggtgaaggatttggggtgacaggaggcttgggaatgaatgttattgagcctctctaatcgatgctggagggtgggggacagagccttagaaaggcagggagccagaaggtgaagacagcttttactgggccaaattaattggcttcactccaacccctttctgcaatatgtgttttttatcattagcaactgtttgtccttatgagagtacagttgaaagtgaaatgtaaattgcaacataaagaaaaaaacatttaaaatgcaaaatgtgaggtttggattttgaagtcctcacaatgtaagggagaggaaaaaaaaactacatgaaacattccaaaacggttagtttttcctaccaggaatgtactcagcaattatttgttgatttaaaaaaaatttttttttattttaaaattcttaagccatttggcttccgtagtagactccataatgctgactctgtttttccaggtttcagcattgctgaccttggctccctgggtgctattcttagtttgtgctgcggtgttagagagatacctgagaggtgataaactagtagggggtttgggaagcctgaatttagtttggaaaactttttgatccttctccttgctgccctttcccaaatttgactctttcaacagacaagtctttacttttttggaatgtggcttatatctgttgctcctttctcctgagctcaaagggtgcctggtgatatttaagctttattgcctaagctcctggcatcttcagtttaggtagattatcacttagctttcttggctttttaactgaaataataattttcttcctttgattgtccttgcatggcttttagaggtgtgactggtgttccaatgatgtacagatattgttaggggtagagacttacgagcttggggagattggtagccaaacagcccattctgggacagtattgatgtttgacatctcacttgatttgtctgtcctcagcatatgtgttctcagtgtcaggtttggtgtcatcatggggaattggtcatgaagtttttagcttgcttgtgctgtgagcatttctagcatttctaacatctcacatctaccttcgaaattgttggactgttttctgggctcattataaacagaatggactagtggatcctctgttctttctcagcattgtattggtgttaatgtcttattaccctttttttcttacaggatgcaggggctgggcttcttgctgctgccatgattgctgtagttcctggatatatctcccgatctgtggctggctcctatgataatgaaggtaagacttttaaaatgctgaagaagatcatctcacctcattatccaacagagcttcacaaagtgcagtctatggtttagcaataataaaaatggtaactgggtgagaatattagaaatgggcaggaacggatcttggacaagctcatgttctcttcccatcatcctttccagaaaggtagttggtaacttttcttacaagtctttggttcatctctgcactcataaaatagttaactattgttttaacattataatcatttgctttattttcctacataaagggagtggatgtccttaaaattttaatgactgattgacttattctcaattcaacatacatttgttgaatgttattgggaaaacatagtattaagtgttaggtaatgactaagattactttgtgcataattataagaaattaaagagataggtaatgaataaggttatattggcccatcatctattaaggaagattaaaatggacatgtaaatataactccagtgacaggagatagtactatgtgccatgataaaaatttgaacagagtacttcaggaatgtagtggaaggagagatttggggctgagcttggtggctcacgccctgttatccagtactttcggaggctgaggtgtgtggatcatttgagctcaggagtttgagaccagcctgggcaaccctgtcactataagaaatacaaaaattagctgggcatggtagtgtgcgcctatagtcccagctactctggagactgaagtgggaggatcgcttgagcctgggaggttgaggctgcggtgagctgtgattgccactgcacttcagcctagtaatagagcaagaccctgtttttgttgttgttgttgttgtttttatttttatttttttaagaaaaaaaaaaagcagactggagaatcaaggaaggctttttagaagtggttgagggtcaactgggtcctgaagttgggacttcattaggcagatatcaaggaaaggggcaattggggcatgagtattatatgttaagacatagaggcaggatgatgaatgatagtataagatgtctttagaactatactagcaggatgtttagtgcttggaaagaatgataataatggccaatatttacttaatgtttattatatgctaggtactcttctaagtgctttacaggcattaattatatttgttttcagaacacttttatgaagtagatactattacttcttcttacatgaaactgaaacaaaaggaagtaaataatttgcctaaaattacactattacttggtagtagatccaggcagtctgttccagaacagtattcttaatgactatactagcctggcctcttgttgaatttttggtgtgtcctttctgcagggattgccatcttttgcatgctactcacctactacatgtggatcaaggcagtaaagactggttccatctgttgggcagctaagtgtgcccttgcttatttctacatggtaactttttctacatgttttcaatttttaaagttctctaaatactgtatttcctatgggtacttattgtttgaccaactttcttttctggtaggttcccctaaatttttttcttttccagtatattttttctgttcatacttacgtatacatgtagacttccttaattgcttccacttgctcacatatccctaaatcctctgtgtgaccttacagtagattgcatttagattaattctgaggcttgagtccctctcgttatgtgatcatgacatcagcaaccacaagggagcaggggattgagttacagtgatgggtttgaacttgattttatattttcttttttaaaatttattttattttgtgtgacctgtacatgtaaggacttgattttcctgtttaaaaaaaaaaatcagttatttgaactctttaagccatttggcataaataaagttatagttactataagtgttctttaaagagtcacaggtgatatcctacaatatagtggtggtggtctgaggaggcatactcagaggaactgtttttttctattccatcataggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccaggtgagcccttgactgagtagggttttcagcttctactttttctatgcagccccaactagactgatttatcttagattctgttaagaagagtacgacttattcacagcctttatattgaactacttgtgttagttgaagcaacagaattactggtcattaaagtttgcatccaggagtctgctaatatttgctccgtggagtttgaattccatggctcttactttggctttaagtttgtgggaaggggagggatatttagttgagttgagtttagatgagtgatcagagttaaaatttccagtcttcttaatgcagatgaccccatgtagtagcagagattcctgatcttaatggcatctaattgtaagtgcttcaggaagtaaagcacaaacctttaaccacattgctccacagggttaacagacaactgttaaatcaaagaataatgtggtatgtttgatttctcttgtgaaattatcatgaaaatgcaaaccttatctagaggtcaacaagtatttctttactgattacctactgcagattgtccccaacttatgaagcgtgacttaggattttttggctttagaatggtgtgaaagtgatctgcattgagtagaaaccgtacttccagtacccatacaagcattctgtttttcacttacagtacggtagtcaataaattacatgagattctcaacactttattgtaaaataggctttgtgctagatgattttgcccaactgtaggctaatgttaaatgttctgagcatgtttaaggtagtctacgctaagctgtgatgttccataggctaggcgtattaaatgcattttctacttaagatattttcaacttaaaatgggtttatggggatataacccaatcataagttgaaaagcatttgtatatgcagtttgctaatcacttgaaaatgtaaaaagaataaaaatgcggtcatagtccttaaggaagttttggtcttcttacagggaaagaaatacaggcagctgtctatatccgataggctacagttctggaagtgtggttcttgaatcatcatcactagcagcagcagctagaaacttgttagaaataaatgcaaattctagagccccaacacagacctactgaatcagaaactctggaggtggggctcagcgatctgtgcttcgacactcctacctccttggtgactacgatgcccactagcatttgagaaccaccgatctaaggcaaagaatgattaagtgctagaagagaactaatgtgatatggaacatagagaggagtgattgatttcagtttggcagattgggaagagatgatatttgagttggaccttgaatgatgagaattttagtggatgggaatttggggaaaattacagtctaggctaaggaaataacctgagcaaaagccagagatgtgataatgatagtgtatcttatgctttagggggctgcaaatattctgtagaaaatatggctggtgaattaaacccttccctagattggccctgattccttcggggcctcagaactcatttgaccatttggtttgaactagataagaataatgcaggcctgcactggacttactcattttttttccttagtattaacatacatatccttttacctacagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggtagggaaggctcacagcttttttccttttttctttttttttaagatggagtttcgctcttgttgcccaggccggagtgcagtggtgcgatctcggctcactgcaacctccacctcccaggttcaagcgattctcctgcctcagcctcctgagtagctgggattacaggcgcctgccaccgcgcccgccaccacgcccagccaattttgtatttttagtagagacggggtttctccatgtttgtcaggctggtctcaaactcccgacctcaggtgatccgcccgcctcggcctcccaaattgctgggattacaggcgtgagccactgcacccggtcaggcttagagcttttactattaaatgcagatgggtacagacatagaataaactccaaaagacagggtattttctgaacacaaaagattatttttttcttatttcttttttcatcggaagcatgtacaatcccacaattttacattcaatccacttttcagcccagtgtttggattcagcatagcagaaaatatcttgttggagctgctcttaatcacacctggtgaaaggactatatcttaccttgcgaatctttctcctttttctttctttttttttctttcctattgattgggtgggagaagtcattatattgcttaccataccctccaaagtggcactcatctaatcccatggaaactaaatcatagctgtttagttggttggaaagccaaattttccttctttttctctactttgctttctcagagatgaatttgattttgctcaagtctatctattgactaattcagagcaggacttgaggatatagttgatttaatctctacagttggccttggtttgaccaaatttggcctaaaaccctttcaggtagcatttctgcctctgttcttctctccaagtttatatacagcctggctttattctgctggcagtgctgacaaaagtactctcaggtttgaaagaaaggaaggagtgaaactctctaagtattggtggcaattaagcaaaaacctaatccttctctgtcactgagaatcttattaaaatgggaagttgtgattcatttggatcagatgtttgtttgaagagtgtgtgtggaatatttattgcctctttgctgctaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccaggtatgtggcctcgtgttctgaaatggccttgttcataagaatcacaatttgattccaaatttgcaagctaccctcattcgtgttttgtttttctttgcctgtttatgttgtgtaatacagaggacggctaagcaaattttctcatgtatgaagctgagcagaagtcagaagttcaacagttgtagatattggcaagttcagcctcacagttttctgttcatttgtcatttgtgttataagttaaaatttaacggtaatttttactccggttttgttttgttttgtttgagtacttctgtcgtactccttcccctttacccttgtttttcctcttggaagtattgaagtcccataatgagtactgctgattgtaaagcctcatcaatctcttatcttctggccaatccagatgtgttttagaatttaccggtgttagtggtctttttctcttaaaaaataacttttaccttttttttttttttttttttttgagatagagtcttgctctgttgcctaggcttcagggcagtggtacaatctcagcttactgcggcctctgcctcctgggctcaagccatccttccacctcaccctcctgagtagctgggactacaggtgcacaccaccatgcccagctaatttttgtattttttttgtagagatggggttttgccatgttgcccaggctggtcttgaactcatgggctcaagcagtctgctcaccttggcctcccatagtgctgggattacaggcgtgagccactgtgcctggccaacttttacttttttcttactgtgaaagtaatttgtgtattgtaaaaatatatgtaaataaatagaaaaagatgctgggcacaatggctcatgcctataatcctagccagttaggaggctgaggtgagaagatcacttaaggtcaggaatttgagatcaacctgggcaacacagtgggacccacgtcttaaaaaaaacaacaacaggcctggaattgtagttcacatcagtaatgccagcactttggaaggatgaggtgggaggattgcttgaggcgaggagttcaagaccaggctgggcaatatagtgagacccctgtctctacttaaaaaaaaataataataataatgcgcgcacacacccatacccacacacacccatacccacacacacacacatacacacatataaaataaataaaattagctgggcatggtagtgtgcacctttagtcccagctacttggaaggctgaggtggaaggattacttgagcccgggagtttgagaccagcctcggttatacagcaagacccccatctcaaaaaaggtacatattcaggagttctcactacccatctctagccactgttaacattttgatgtatatttatcaaataagaatgagatcatagttttttccctgatttttttcacttcataaagaatcaaatttctctgttacttagtattattttatagaaatacttaaaatgtatcatttattagttttttaaagtacagagatgtgtcaagatgtgtaagaaggcaagtagtacataatctcatgcagcaatattttaatatattccattttataaatatagtataattagctccttgtttttggacatttgggttgtttctgatttttttgctactttaaagtgtgctgtagtaaacatctttgcatgtttctatgattgtttttttaggataaattcctggaagtggaattgctgggttaaatgtgtggaatcatccagtcatataatgaagatactttaccttgtaggtttcaacctacaggactcagctgcttatttctccttccctcttttgtagttggcctctattactgctttagcaacctgtctgatgcccggatttttatcatcatgtatggtgtgaccagcatgtacttttcagctgtaatggtgaggatgccctcagtctggtagactttttcactctaactctgaggtgcttttttatctgtctggcagaattcagaaagtactgatgattgtgcacatgcttccctctgagcatttgagggaatgagttgtaagttgttgatcctttccaggaacgtatgggacactcatacattctggttgtggggtccaactttcttggattcgtaactttgtattatagaagcatttttgcactttgttggataatatgaccctgggtgtcttaaaacgggagatgatatttttttcttgaaggcttgggagtattacccagtgctagattgttagaggagggatttgaattttttttttttttttttttttttttttttttgagacagagtttcactcttgttgcccaggctggagagcagtggcgtggtcccggctcaccacaactgccgcctgctgggttcaagcgattctcctgcctcagcctcccaaatagctgggattactggcatgcaccaccatacccagctaattttgtatttttagtagagatggggttttccatgttcgtcaggctgatcttgaactcccgacctcaggtgatccacccgccttggcctcccaaagtgttgggattacaggcgtgagccactgagaatacacacattctcttatatactttaaatcatctctagattgtaatactaataactaatactaggtaaatggttgttaatactgtattgtttagggaacaatgacaagaaaaaagagaggagagattttatatattgtagtaaaatagtgtttctcatatttttttggtctcaaaccacagttatgaaatatactttatatcattattcaagacacacatgcatatgtacatgcatataattgaaacaaagtttaagaaatacatactaatactgcaactatttcaagtattttctctttcactttttgtggaggtcatgtttgatgaaaacccctaaattgatgtcttgatctactaataggctgaaatctgtaaattgtggaacactgattagactgatcatgcttcctgtctctgttaggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtgagaagcaatgttaagagtagacttgggaaactctgtgtgtgtgtgtgtatgtgtgtatgtgggcagcggggggtgggaggagtaaagtagagcactgtcctaggtggtcagaattaactcatatagcctctgacttattttgatcaatctcatctatatgaatgtgtctaagaagttgtcctgtgttgtgtgaatttagtttggttaactacacaattaattctttttccttgtttaggtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggtgaagatttgggaggggtgggaattgtgggttaggggcaaaggggaagacatttgatgttacagtgaatcatacagcttttagatgggtggaaagctgggtgaaactggaactttgcaactctagtcttgaatgagccttaaaggtgaacctccattcaattctgggatcttttgtagttactcttactagtaattatctagactttgcatgcacacttttattgatatgatgattttaacatgaggtagaacatcccagttataaaagaagaaaaaagttatagataaataatacatgttcactttagaaaaatcagaaaattgaatcaagaagaaagatataaatcttgtgtaaagtgatcaccttatgataactgcttttaacattttaatttatatcttttgagaatctgaagtgatttcctttacaataactattaggaatatcatttctgagacaatttgttaggaataaaaacttttaagagtctcttaattcttgtccatcgtatcatgtgatttgagtttccaccccatctttatagtaagtgatttttgcaattctgttaaaaggttatttaagaaaattgtctaatgacactaggctattgatgtggctacattgcacagtctcccacacctcccaccccattatgttagtataaagtgacctgggatgaagtgttgggaatgttggtttgttatttgtgctgagattttataattgtatataaatggaagaccaggtgccaggatttattttctggtttgacatgcattactttgtgaagaaattgattagttagccaggtgtcacttctgtcagaccaaagatgccttctctgttgcatttgatttttagagacagtgagaagcttgttatttccatttcccattctactttcaggatgcgaaggtcatgtcctggtgggattatggctatcagattacagctatggcaaaccgaacaattttagtggacaataacacatggaataatacccatatttctcgagtagggcaggtaagataaagggatgatctttgagtgtttggtgtacaaggtctaatgggaaatgtgtctgcatgaggggatcatatgacttgggattttgctctgagaattgtacatttgtttttccaggcaatggcgtccacagaggaaaaagcctatgagatcatgagggagctcgatgtcagctatgtgctggtcatttttggaggcctcactgggtattcctctgatggtaatatacttgattctgtttctagctgcaggacatagattctaagaaaactagatgaatatcctagttttctgtacttttactaatattttactaagatatttttctttcatgggaagttcctaagtatttgcaacttgaggtttgggtattttgatttttttctttttgtaacaagaggacataaatgtaaacaattcttgtgtaggtacagcatgctatatgattgtctaaggcatagaagtagttccacaaccagtaataaaaccaagctgaatataaggctcatgacaatgaacttaagaattagcatttttttagtggttttaagccatataatcattgaccagcttagaaatgttttatatggcctgacagcgtgtaaaaaaagagaacattttatatatatataaaatatatataaataaaagtgtgtgtaaaatggaggttaccatgtgccctatgattattggcacaaagatttttagaagaaacatccaaatatagttatctgccttaaaagttaatgtaatgcctgtttacactttaaaaagttaagcagttcacagccgggtgtggtggctcacacctgtaatcccagcactttgggaggccaaggcgggcggatcacttgaggtcaggagttcatgaccagcctgggcaacatagtgaaaccttgtctctacaaaaattagccaggcgtagtggcacatgcctgtagtcttagctactcaggaggctgaggcaggagaatcgcttgaactcgggagggagaggttgcagtgggctgacattgcgccattggactccagtctgggcagcagagtgaaactgtttcaaaaaaaaaagttaaacagttctgaaggtttataataaaaagtgatagttcactgcccaaaaatctaagcccccttaacatcagtccccagaagcaatgattcctgcagctatttcttctagtacttacatgcatatttctaaatactgtgtatacagtttcccctccatatccgtgggttctgcatctgtgggttcaaccaaccacaaatggaaaatatttgtgaaaaaaaatcataatacaacaataaaaatcatacaaataaaaaatacagtataacaactatttacatagcatctacactgtattaagtattataggtaatctagacatgatttaaagtatatagacagatgtgcataggttatatacaaatactataccattttatataagggacttgagcatttgtgaattttgatattctggtgggaggggatatataagttagactttttattttttaaagaagataatacgataaccattaaaaaacaatgcagaggccgggtgcgatggctcatgcctgtaatctgagcactttgggaagactcttgaggtcaggagtttgagaccagcctgcccaacatgatgaaaccccgtctctactaaaaaaatacaaaaattagccacatgtggtggcacatacttgtaatctcagctacttgggaggctgaggccagataatcacttgaacccaggcagcagaggttgcagtgagttgagattgcgccactgcaccccagcctgggtgacagagcgagactccatctcaaaaaaaaagaaaaaagaaaaatgcaaaacactgttactgtctagatccatgaaaacatgtatgtgaagatcataaaagaagatagtgtagttgtccctctgtatccatggaggattgtttccaggacacccccacccctatcctcacccctcaccaggataccagaatttgtggatgctcaggtcccttatataaaatggtttagtatttgtatataatatacacacattctcttatatactttaaatcatctctagatgataatactaatccctaatactaggtaaatggttgttaatactgtattgtttaggtaacaatgacaagaaaaaagtctatccatcttcattacagatgcagtcatctgtttttttgttttgtgaatatttttgattagaggtttgttgaatttatggatgtcaaacccacagatatggaaggccaactgttttggttaatttgttacactgaatttatttttcaaggtcaaattattcattgggctttactaataggagttctgtaacatttgagaggcataataaaaataaaaaaagttgggcctggcccagcttctttttttgtagacaaccatatcttttgaacaatgggctctccttgatgcagttcctatcatcatcatcattattgtttttgagacagagtttcactttgtcacccaggctggagttcagtggcacgatgtctgctcactgcagcctctgcttcccatgctcaagtgatcttcccacctcagcctcctgagtagctgggactacaggcacacaccaccatgcccggccaatttttatactttttgtagagattgggtttcgccacattgcccaggctgttcttgaactcctgtgctcaagtgatccgcccatctcagcctcccaaaatgctaggattacaggtgtgagccatcacacccagccattcctattattttcactcttccattcatagagcttatgaggtttttgcttcagacatacctgccaggcagctacaatactattgttctatcatagccgagctgatgttctgggggtttatttttgttcctgtttctggcgctatgatctaggcaagtctctgtgcctcagtttctccatttgtaatatgaagataagaatgcagacactgaacgaagatagtaatattattcattggatgtttaccatgtgacaaacaacttactaaatgctttacatgttgttactcataataacagccctattgttgtagatactcttatttttctaatttgacagatgagaaaactgaagcacagagaggttaaataacttgcccaaggtcacccagctagaattggcagtgctggaattcaaacttaggcagtttggatccagagtctgttcttaaccaccgtgatatcccctcgaactctttgcagtagtgcaataggaatcttatctttttttatgcattagaaatatttttaatactaaccatccagtgaaacatgtagcaactgatttccctaaagcctgtgcaagcaatacagtaaatgatgaaccctaaaagagatatcatgagttgatgatagtgtcaatatttattaagcatgggagtgtgtttgacacagaaatgttgacttctcatatacctgctttggaggtctataattttgcagctgttggtcaagaatgagaagactcatgtcttgtctacctttttggtaaagctactactctttagatcagtcgtgcccactgtctaatagaaataatgggaaccacattatcattttaagctttatattagtcacatcaaactaagtataaagaaacaggtgaaagtaattttaataattttaactgaatagtcatatcaaaacattattatttaatttaacatgtaaccagtatacccccttttggggtttgttttttttactaacttttcaaaatctaatgtgtatttcatacttacctagtgtgtattttatacttacagtacatcttaatttggactagccacatttcagctgctcagcagctatatgtagctaattgctgctatatttgatagcctagccctagctaatctataggaccaatctcagttgtggcttaagtctggactagtagcgtaggatttcaggagtataataatttctcagaaaagttgtatattttgacgaaaaatgctttgcccgtatgttgtcctcactatttttacaaattagagttaaatgataccaatccccattaaaaaaatgttgaggaattttcttagaaatactaacctgctttaactccagcaacttttgtgatgcagcagttctttttttttttttctcctagatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccagtgagtgactcataataatattaataacagtagtaataatagtgattactaatacacagtattttccatatgccaagcactagtaagtgctttgtgtctgttaactcatttaatcctcacagcaaccccaaaggcatatactgatattattgtcatattacctttatttttgttgtttgcatatttttttgagacagggtttttgctctgacacccaggctggagtgcagtggtacaatcatggctcactgcagccttgatttcctgggctgaaggagtcctcctgcttcagcctcttgagtagctgggactaaggtgcacaccacaatgcctggctgtttttaaaactttttgtagagatgaggtctcactatgttgtctgggctggtctggaactcctgagctcaagcaatcttcttgtcatggcctcctgaagtactgggattacagacctgagctactgcacctagctattgttatttttgttttgttttgttttgttttttgagatgaagtcttgttctgttacccaggctggagtgcagtggcacgatcttggctcactgcaacctccacctccccggttcaagcgattctcctgcctcagcctcccgagtagctagaattacaggtgtgctctaccatccccagctaatttttttttttttttgtatttttagtagagacattgtttcactatgttggccaggctggtctcgaactcctgacctcaagtaatccacccacctcggcctcccaaagtgctgggattacaggcatgagccaccgcacccagcctgttattttatatatgaggaaattgaggtacaaataggttatttaactgcctagtgtcacataactaatggcagagtcaggattcaaactgacaaagagtggctccaaattctgtgcttttgaccgttactttttattgtccttaagggtattacagtgaagacaggaacaaaagggaaagaaagtgacttttcgtatcttctgatgactacattgagagttatttgattaggttaagtctctccttctgacttcaatttcttgattctgtactagggagaatttctgacatgaatgcaggtctttgacttctggtaggcttttttctctgatccatgcaagggttgctagtgtattagaggctctgaatgacaatcctcaggaatagagggccttggaagtcggctccctatgtctgtcttatcagagataagacattgactggcaagcatcatcttgcatagaacttaagctagggtaacacttgatttgcccttactacctcatgcccttttttgcaggctctactctcaacaaattgcaggctgaggaataatcatcaattagtagatggtttcctgaatccatatactgtctctctaggaaattagcactgtagaaagaagtgtgttctttttcatccctctctagagcgtcctccaggctttgaccgtgtccgaaatgctgagattgggaataaagactttgagcttgatgtcctggaggaagcatataccacagaacattggctggtcaggatatacaaggtaagcagatgctatacgtctcagaaagcaacttttatttttggagattggtttcaatgcttataaaatgggacatatatttctcaaatagggaaatttctcatgacacctgtgcttgaaaagtagcttgcaaactcactgaaaattttacttattttagattgttcttagagagtagatgatcccagtctgccatcattttggcggttgttgcagtgatacttttccagctggggcttgactaaaccagtttctgtgattatcaggctcacgggtggggagagtgcaggaaatagagaaaaagttcacatgtttatatttagctacattttcttctctctctgaagaacttaaggtatatagagtcatatagaaccacataggagtatatctctcatataagaaaagattgagaacccttgatctatgtggagggtagatcagtaatattggtcctcacagaggtattccaaaaggctaagcagagagaatctagtctctagtcagtgcttgtgtattcacagccctaaaccaggctgcagaacccaacataatcctgcccactctgggtgaatccattttagtagaaaatttctccaaagttgatctgattgtaaatattaaactgacatctttatgttgcaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcctttctgggctactatgtctctgttctcaatgtcttttatccttagacgctctttgactttataaatcagcagttttgaagactcaagacaaacagtgaaattattggtttatcaatggagaggaagaaactcttccagcattacatatagagcttgatggtcagtaggtgtttttgaatcagcttaaatataatcatacatatcaatttgaaatggagcttttcagtactctcacttattcatgacacaggaatgaccctttactcaaaactcttgtggttgttcaaaggtgagcttctttttcccttagtcttagcctatgtgttgctgttgtatattgttaccaagttcaactacctaattttgaagctctttccaaataagatacaaattaaaaggggaagcattgccagtaacaggtccctagagagcagtgccagcctgcctgcaagaaaagaggagaaacttcttaaaaagttttaagcctgggcaacataaggagattgtttctatgaaaaataaaaattagccaggtatggtggtgtacacctgtagtcccagctactcgggaagatgagattggaggatcacttgggcctgggaggttgaggctacagtgaactgtgattgtgccactgtactccagtctgggcgacagtgaaatcttgtctaaacaaaaacaatttaactgggaagcacagtggtccttgaggacatttaatatcaggacaaagagcctatgaatatatcactgatgtatataaaccctaaggcgttaataaaagctaactgtttagtgttatccatttaagggaacaggaggaattgcataacttttagattagtcatagtggtgctcctaagggatatgctgttgtatatttgtatagccagggcacttagccttccaaaccaatttatataccatgttcttcaactgtgggtgagatttagcctcaagatttgatttactatatgtaagtacattacttgatttctataaagaatctttagtggaagaggttattctgaattatttatcaatatgattaataccagttagaaattattaatgatcttcctttatactatacataggataacttttaacttgtcgctacagttgttgctctgaggatcttaattttgttactttctaggctacatgaagctatctttttaaaaagtgtactcttcattttcactgttattgtgtacttagcataaaaaactcaaatctaggccaggtgcagtggctcatgcctgtaatcccagcactttgggaggctgaagcatgcggatcacttgagcccaggagttcaagaccagcctgggcaacatggctaatgaacactaagcatagttttgatgtctttcatattaaagactttctcaaattcttgctagtctgctcctctttaagagtgggaccctaggcagggcgcagtggatcatgcctgtaatcccagcactttgggaggccgaggcaggcagatcacttgaggccaggagtttgagaccggcctggcaacgtgggaaaactctgtctctactaaaaatacaaaaattagctgggtgtggggtacacaccctgtaatctcagctactggggaggctgaggcatgagaattgcccaggaggtggaggttgcagtgagcagacatcatgccactgcactccaacctgggagacagagcaa

SEQ ID NO: 16308 - DNA, 48691 bp, Human
  misc_feature (1)...(48691): n = A,T,C or G
atgttgcctttgcaaactgtaaatgctccaaatatgttttaaagcaacggtaatcaacttaatcccagcaaaatcccggtacaaactggcagtgttcttgcctggcatgtcctttgccttgcttatttagagttttagttttgtaggtagagatggagaatgggcactcctagggcaaaatccatgaattttgctgtctggttcccctcaggaagcgcctccaatttgagcacctaactatatcaataaccctatagaccgaagagaaaagcttggtagcctttctgttgagcgtgtagagaagggtatgatagtcagcaatgcttgtgctgcctgaaactgaaaatggaaaactgtatgtgggagatagatcattttttcaacgagcacatattgattgactgcctagccacagggtaggcagtgtatatttggagccagggaagatatccagaggatttctgtgtcctcgaggaatttaagttaaaattgaatggggcccagatgtacacacagatggataaatcacagttggaagcagtgcatgaagatggcccgatgaggggtagaggtcccacagttggtgggaactgaagggagttctgtgtgtgcagcgttccagggtgcagtgcccaagatggttatggagtatggctttggagcacatgggtagttgggtctgtttcttacaggatacaggataatagatcatttagtctattcctctgctcctaggcatatgctctatgtgtgggaaaaccttgggtgcttgtctgggcacggtggctcatgcctgtaatcccagaactttgggaggctgaggcaggtagatcacctgaggtcaggagttcgagaccagcctggccaacatggtgaaaccccatctctactaataatacaaaaattagctgggtgtggtggcacacgcagctacttgggaggccaaggcatgaggattggtggaacccagaggtgtaggttgcagtgagctgagatcacaccactgcactccagcctgggccacagagtgaagctatgtctcaaaagcgaaacgaaacaaaaacaactcaggcatttattggaaagtctctattgatgttttattagtttttttaaaaaaataaaaatagagatgggaccttactatgttgcccaggctggtcttgaactcctgagtgagctcaaatgatcctcccacctcaacctcccaaagtgctgggattacaagcatgagccaccacatccagccaatgttttattagtttctactatttattgataagggtagtaatatctaggtatacaaacccttatccaaaacccctggggccaggcatttggaattcagattatttcagattttggaaagtagtaatagagtgtacattccgcatttcatccagtgggatctgggatagcaatctttgtaattaaaaagttaatatttctgcagcaaaacacacaaaatgggataaattaaagccatgaacagctttatattcatgttggtcatgtttagttgccagatgagtttagatcatgtcacattttgctgccaaacaagtcatggagaattttcagctttcagatcacatagttaaggatatggatctgtggtaatagtaatagtaataaaaataataatactaaaacaccaacagaaagtattcaataatattggcacttattatcttccaggtactgttttaagcactcacctgtgtttactcctttagtcttctaacagccctttgaggtgggttcagtattatatctgtcttgagaagaataagaagcacagagcaattaatcacttgcccaaggtcacagctggtaggacagaacagaatgcaaacctagacgatcttgtccaggagcttcgtacttaaccagtgccttgttttttggagtagggaattggaagcaggtgtgtctctaaagttaactctattatttagattagcctggtctaaactcacattacgctgttcatttcttttagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggagtaagaagtcttaattgccctctcctgcttcagtcgagagccctgtagtccttgtctccttgacatagtgctggtttctgtctataggtttatgggctattactttcattttcgtgttgccagcggagcagtgccctggtacttgctgtcatagctctatatatgtccctttacagtcccctgaggagaactttcttaaattgaaaccttagaggaatgaaggttttcctagatacaaaatggaatttcaggagcacagtaaatttcagggtctgtctatcttaagctttctttatatcagtggaaatccagcgagatattagaaataaaggccagaaaaaattaattaaccatgatggatgaatctatgttattggactaatttgcttcaagaaacaccagaattttgaaaatcccgaatttttgacagcccctcaggcctggagagttatctacagatgttaggatatgtccacataagaaagcatctaaactgaactgagagcacagcgggctaccctggacaaagtaaaggtggaaactaggtgatgtggcctttgagtatgcagattccttgtatcacttgctcgctactttctagggtcttaatagtagtcaagaaaagggatctgagaaaagtactctttcaggagggactagaaagagaagggggtgatatgttacacaaattaaagaaggatgtcttaggcatttagtaaaaattcagtggttccccgctatcctcgggggatgtgtttttttgttttgttttgttttgtttttttttgagatgaagtttcattctatcgcccaggctggagtgcaatggcacaattttggctcactgcaacctccacctcccaggttcaagctattctcctgcctcagcctcctgagtagctgggactacaggtgtgcgccaccatgcccgactaatttttgtattttgagtagagatgggagtttcaccatgttggccaggctggtctcgaactcctgacctggtgatttgcccgccttggcctcccaaagtgctgggattacaggcgtgagtcaccacacctggcccatggtgggggatatgttttaagacccccagttaatgcctgaaaccgctgctagtaccaaaccctaatgttttttcctgtatgtacgtacatatgataaagttcagtttataagttaggcacagtaagagactaacaacagctcacagcaaaatagagcaattataacaatatattgtaataaaaattatgtgaatgtggtctctctttctctctctctttcaaaatatttcattgtactgtacagcagataaccgagccctgggaaagcaaaaccacagataaggggggactactgtctacatgagttccctgcagagatacaatatgcatccattgttcttagctatcacacaagaaatgtcaaacgtcagggaagtctgaagcacctgtgcttttgtttccctttttgtggatttgagtgggaagaatggcccacaaataatggggtaagaggcacgtcctagaggattggaacctgactgtatttgggagagggttgcttatttgatgactactgtaagactctacttttacacatagaggggccaaatatctgtctgattcactcttacagccccactgtctaatacagtgcaatgtgcaaataatatttttgaatgaaatattgaatatcaaataaactagatgagtgataatagctagtagccttgtatgtacatgtaatatatttctaagcccacaccatttccttcttttctttttaattaatgctggccggaaggtatgatcacagagaacatttcattctgctgactagtactatagctgtgggctatgtgtttaaattttaagtttcaaacagattctttttagattctgagcctgttatctgctcaacatttataagtcaaaaaagaatggctctgggggtttattatgccgaatattttttcgttctagtgcaccagccaatgaactagaaatacaaagactatgaattctaattttggtactctctctaactcgctgtgtgaccttgggcaagtcatttaaccctggttgactgtgtaggtcctcatctatgaaacctccagagctcaatcttgatgaagtgaggctaaggacttgtaaagaacctaatttcttacctcacccaggatgcccaggtgctctgaaaatgacatttcaagatgcgtcccattccttttgcttccaacaaatcatttcccccctatcaaaacccctcctctgcctcattaaggatgaaggcccaatgagcagattcttactgtcttctagcacattagaagaggccactcaatgttaattaccatcacatgggattattggcctcctcagcctgatttttctgacttgactgcctcattgactgcctcagttaagagaccaaagattgaataattccttcgagataaggtataatttggggacagtgtagcgggaggaagctgggaagagaaaaattaacacaacactttctaggcattcagttctaacccctctttataatttaaaataaaaatcagaattctgttacacactttgtttcatagacactatccagatatttcaactgtgaaattatggctaagtaaaggaaaagggtgacttaatatctcacctgactacacttctcctgaacatagctctaatgttattgttataaacttgttccggtttagtatttagagggctgtttcatccacaaatgagtgaaaagtgctgtggatgggttagaggtaaataatagaagcttaaaacaaaagcagggaaatacttggttaaactgcctccttaaagacagcacaaatcatagagcaaatgtagtgattcccttagaagctttctttagtcttcatttggaactatttagccaagaggggagttggctaagatttgtcaacttatctctgatctgtcagggcatggaagttctaggcattaaaggagagtcagatttgaatacacattttttggttttgcattcaagaaatatcccagaatctcttctttgtgtatatgtgaccaccctcttcctttgccataagagattgggcctggaggtcacagcctcttaggggtcactacaaaatggaaattgacggccctcagcttacctcctacgtcactggggatccctatcagccctcttacgagtaccctgaagacagaggggctaaccatgcaatggctgtttcttcagatagaattgttataggtgatgttaaaaataaagtgcacacaataaactgcctgtcatcagatatactacatgttgaagacaagtaaataccaaatagtcagctagggaaaactacacataattgtgatttttagaaaatttaattctctttttagaggttatagaaagcggatatagtattgattctatttaaacatttgaggacatctagaaagttgagcaaacgcattaatgtgctgctaataatttctactttctttctttttgagacagagtctcactctgttgcccaggctggagtgcagtggcatgatctcggctcgctgcaagctccgcttccttgtttcaagcaattctcctgcctcagcctcccgagtagctgggattacaggcaaacgctgccacgccggactaattttttttttttttttgtcttttagtagacatgggttttcaccatgttgtccaagctggtctcgaactcctgagctcaggcaatccacccgcctcagcctcccaaagtgctaggattacaggcgtgagccaccacgcccagccactaatttctactttctaaacataaagtgcaaaggtgtactcaaattaatacacatttgggtgtggatattggcatgactgcacaccagcaaaacactagacaagggaagtagccaggcttgagggaaatgtcagcaagttagaattctaataagccctttaagctgcctgccatattgtcagaaataggtatataagggtttacgtgtgcatcaggactgagagaaccctgatggctatgttgccagttccaggccctggagttctttgtacacgtgtcctggcaccccccagtctccaccctcctccactgggtttgctcatactctgccagcagcctttcccaaagcccctgctctctgtggcgaaagatacttaagtcaattctacaggcacctaagcccaagctataaaatatgcacctgaaaaagccttttctgttatacagggatggagagagcaaattgaatctcaggtgtcatggcagcataatgataggaactgaggcaacctgtttaatcttagttctctgatgaatgatagaggagatagctttcaaagtcttctttccccaaggtaagagtaaatagcaggatgcttctcagggaagtaaaactttacagtccacctccgggtactcacaaaaggggtgatgcacactcccaagaaccctgcttatgatgggatatatgatgggatagacagcccttccctttctcttcctcacagaaagctgtttccccctgccctggctgcattggctcctctgttgctgaggctgctggctgccagcatctgcctgtgccttccttgtgcccttccctgggctggagatctacatagaaagtggccatgcacccctgctacctttgccattcctccttctgtagatccatgaaaacacaatgttcaggatcatcgtacgtatgggtttctcacgcagagccagtttctttttttttttcttttcttcttttttttttttgagacagagtttcactcttgttgcccaggatggagtgcaatggcgccatctcggctcactgcaacctccgcctcccaggttcaagtgattctcctgcctcagcctcccaagtagctgagattacaggtgtgggccaccacgcccagctaattttcacgcagagccagtttctaaactgctctcctaggttatgattaggaacttggtatgttattctgatgcccataccgatgccaattacagaattcataaagacttggaattgttaagtggttaggaatatgggctctgtagccgtgctgcccaagttcaaatcccacttttaccattactggcagtgtgagctgagacaagtgaattaaattcactatgtttcaatttttttctcattagcatctgccttgtataattgttgtgaagaatgaatgaattaatccatgtttcgaatctggtttagagtactacctggctcatagtaagtgctcagcaagtgttgactgctattgttattgttaaatgggcactgggtaagtatggaaagggtatacaactgattataaagagaagaaagctgctttatcttaaagcttgtttataaacttcaaaggataaaaagtatgtcagcaaggaaaaaggaaacctggacaaaatgtgaaagagaatgaggatggcttgaaatcctgagaagataaaagtttagggaattgtcgctaaaaatgtagaatcagaagataaaattcaaagcttatcagcaaaggctcagatgagaaaagcgggcactctaaatgatcccgagagagcccctgcttatcactttaaggatgtaaatagtctcaaggtcattggaaagtgtgtagttcgttaaagttctcagcttccctccagcctgggagagatacaaaaggctcctgcctattttgggctttgctgaatttcatttctgtgggcacttcctgcagggacaaatctgaaggtcagtgcctgtatgcatgttcattcttgcagcagagaatgtaatgcagtgatgtaaagagtagtcctgcagtgacctttccagcgggtgtggtgccttggaattttgtcttggagaaagcaaatcctatttgcttcttggctctagaatgctaatggcacttggatttagaattagcctggattaatgcagctctaatagtgcctgatggagattagggtatcacccatggtttaagaagtctgctctgaaatcctgctgagtagatggctaacgagtacttgatgagttctcttcaaagtgttttcttgtaatggtaggaaaataatgaataagcagatgccccaagcactgccattacattgtgttttcttgggttccttttatttgttccatcaccaattatatgcattgtgcactaagaaagtctttttgcttttaaaacccatatatcacgtcgcattcctgatacaaacaaaatcaggaatgtgatgtgatatatgggcattttgtttagttaatagtgccctcattactttctgatttcaagtgtctgtgccctggtgtatatatacatacttgcttatttttgaaatcttgctctcacgggtatcatttgtgtttgacatgcataggcacctgaaggagagtgcagcgtagagccctaatttatcattatctaatattttagttttttttttttttttttttttttttttacagtgtcttgttctgtcacccaggctggagagcagtgacacaatcatggctcactgcagcctcgacttcctaaggttcttcccatggatcaggctatcctcccacttcaagcctctcaagtagctgggactataggcccatgctaccatgcctggttaatttttgtattttttgtagagacagggtttcaccatgttggccagtctcatcttgaactcctggagtcaagcgatctgcccatcttggccttccaaagtgctggatttcaggcgtgagccatcgcgcccggcctcattaatattaattcaggtgccattggcttccatggcggtcattatcttaagggctttgtttactgatttacattaatctcttggtgttgaataatttatgtatcttcctgatgtgtgtttgtgactttgaaattttccccaacctccctcctctttttttgtaagaaatctttctgaaataagttaaggaataagaattgtagaaatcctttcttataatgtacatatcagaattttaaaaagaaatgtaataaatgtagctccatctttccccactaaaaacaaattgtgtagacagaggtgtatttattggtttcttttatatacagtatttacctgagagtgtccgtgatgttggaatgacacaatgcaggatttagattctacattgttagagggcaggatcttgcaacccgtgggttcgatagaacattttgggtagtaagtaagcactcactgtattggcattattcccttacctacattagatgtcaaggagggaattcctgatcatttagattgtaggcctctgaaactgaaacggttataaactagataatgattctgatcttaatgagattcagccagaaaaactgcccagatctctctttctctgtgttcctctctctctctctccctttctctctctctctctttctctctctctctctctgcccataggaaaagaaacatgggcatctcttagattcagaaacatgagctatttggatgaggggcagatttattttcagagccagaggcagtttgattatagatgctgccatttgtatctcaatggtaggaaattcctcttccctcaagcaaacacctttcacactgaagcccctggccaagctccatgcactttctcccctggatgtgcctctgattcagtttttaagctgctttgcccctgcatgctggaaggcagatgatctcagcctggcacacacagaagcctctctcctctcccggcccagctcttccttcctccaggcggggccaggccacagatgtgtgttaatgagagcttctctttgtttacagggtttgggatgctctgacagacaattacatcccttcactctcagaagactggagggatccaaacatcgaggctctgaatggcaactgctctgacactgaggtacctctccggggcccctggtttagcagggcttgagatgtggaatccagttagaaaaacattcagtaactcaacagtcttcctcaaaattgttgatggaggctcatgcctgtaatctcagctttgggagaccgaggtgggtgattgcttgagttcagtaatttaagaccagcctgggccacgtggtgaaacccccatttctaccaaaaatacaaaaaattagccaggcatggtggcgcatgcttgtggtcccagctactcaggagactgaggtgggaggattgcttgagcctaggaggttcaattaaaaaaaaaattattgttgggaaggaggagttgtagaggagggtgaaaaataaggaagacatccagtatatctgaaatgataggaatggtcatctatagaaaagcagaaacacagatcacttctattaggttggtgcaaaagtaattttttttctgccattactttccttttttttttttctttttttgagatggaatctcgctctgttgcccaggctggagtgcagtggcacgatctcggctcactgcaaccttcgcctcccgggttcaagggagtctcctgcctcagcatcccgagtagctgggactacaggtgcatgccactatgcctggctaattttttgtatttttagtagagatgtggtttcactgtgttagccaggatggtcttgatctcctgaccccgtgatccgcccgccttggccttccaaagtgctgggattacaggcgtgagccaccacacccagcctgccattactatcaatatttctaacctgtgtactacaacatgaaaaataaagtggcctgaaataagaggaggaaactgtcatggcttctcttgggttcaaataatggtggtttaaaaaaatcaggttttctcatcttaaatgaacagttcaggccggaaataagaggaggaaactgtcatgggcttctcttgggttcaaataatgatggtttaaaaaaattagattttcccatcttaaatgaatagttcaggcccacaaaaacagtgctgagaacaagtgctgacggatcttgcacttgacaatggccagaggtggggcccagatattagcaatgtagccacacagtggggaagaagtctctctttttttctcagacagggtctcactgtgtcgcctaggctggagtgcagtggcacagtctcggctcactacagccttgacctcctgggctcaagtgatcctccagccttacccaccaccccctccccgagtagctgggactacaggcatacgccaccatgcccggctaatttttgtattttttgtagagatgggattttgccatgttaccaaggctggtttcaaactcctgagctcaagcaatccacccaactcggactctcaaagtgttgggattacaggtgtgagccaccatgctggcctagaattgtttatgaaactcaaccaaggggacgtttatgtgtctggaccagagtcacactccatgagttactgactccaagggagaaagtagcttaggggcttctgaaaaataaagatgatatttattttgagttgatttgcaaaggccataaagggggtgacctttcagaagatccaaattgcccctcctatctgaatctacatatggaatggtttcttagtcagtttgggctgctgtaacaggatacgttagactaagtaatttattaacaacagaagttgattttcacagctctggtggcagggaagtccaagatcaaggcactggcagattcaatatctggtgagaacctgctttctggttcacagacggcaccttctcactgtgtccccacatggtagaagggtctaaagtgctcccttgggcctcttttagaaagatacttgtgggcatcccacctccatgatatcatcacctccacaaggtctcactgtctaataccatcactttgggcattaggattttagcatataaatttggggggtgggacataaacattcagagcacagcaaaagataaaatcatttaatggctctatgttaaaagcaaatttctgcctcacttggttttctagtttcagttgtgaaggaaatttgacaatttatcgtcaggaagggctgtcacagccctgcaggctcagcaagtgatagagttggatgggtctaatctttctaagtgtttcagaattgagtccaagtaaaagagcaagaaacagattccccttactcggcaatatatttgtagattattgctcaaaatagcacagcaaagagatcagcagttgactgatttgttgaaaatgtagccatatatatccttctccatttttctagtaattagcaatctaaggtactcaaaacctcaaggcttcattgacgggagcaagtgagatgatgactttgagactaagatttcctgcaagcctcctcagcacagacataggaggctgtgtctcaggtcctgttttgaactctcggctgtgcatgttctcttgtaatgcttacaggcatgatgcttagtacttacccaaaccgcaaagaagatggaggcaataatggaataaatctagttactgaaattaaatcaggtccatcatggtacaaaaggcagattttgctttgttatctcttttgacacctttccaactcattttgtgaattaagccaaaggatatataagatagcctgcccttcaaaagggctttaatttatcctcatttccagatttccctcaagagggttaatatttcagggcaaactgaatgaccctgagaaggatgatcttgagctctgttccttgtagtatttcttctatctaacccatgggaaaaggacagggtagcaaaagtagatggattaaggctgttttatttcatcctcttttattatctggattaattacagtaggagctctattaactgccctaagtttaaacgatttaccagattaaccagtgctctgtattccttctgtaaaacatacgaccaaaagcgcttggcatgctgaatgtgcacagctgtgatgcttctctctagtgagcactcatacctccacttaagtggtccatttaaaaaaattttttttattttttgagatggtgtctctctctgttgcccaggctggagtgcaatggcgcgatcttggctcactgcaacctccgcctcccaggttcaagcaattctcctgcctcagtttcctgagtagctgggattacaggcatgtgccatcatgctcagctaatttttgtatttttgtagagatggggtttcactatgttgcccaggctggtcttgaactcccaacctcaggtgatccacccgccttggcctcccaaagtgctgggattataggtgtgagccgccacacctggccaagtggtccatttttaagaatcagttgtccccaaacctgtttgtgctgtccttgtgactgcactaagaaatttaattaaatattgtaccaactattgaattgtgactgcaaagagtgtcattttttgttaaaatcaaagtaacacgtctacatagtttaaaaagttaattaatgctttgaaagtaatgcactgtaagtgcaagacaaaacaaccacccaaaacagtagacccctgccttcttgtctttccctactccatacaggcaactgcttgcatttcttttagctgcctttttttttttttgcataaagctccacttttatagtggggccatgcggggccacatggggaagctccagtgtcccctggaggcagaaggagccaggggagagccaggccagtgcctcaggaatggcgagatggggtaaacagtttaggactggctagtttgagtaatttctgcaagctgtaaacactagggatggtccttagtgcctagtacctgactctgggatgactaaggaagaggactctgcctcctgggatgtagaggtcaggtagaggcggcagggcttggctttggttagtttgcatatagaaggcttgctgagccctttgctatctctaagaattggctaattttttgtgtgtgtgtgtgatggagtcacactctgtcactcaggctggagtgcagtggcacgatctcggctcactgcaacatccacctcccaggttcaagcaattctcctgccccaccctcccaggtagctggaattacaggaatgcaccatgacgctcagctaattttttttttttttttgtatttttggtagaaacagggttttgcatattggccaggctagtcttgaacttctgatctcaagtgagccgcctgccttggcctcccaaagtgctgggattacaggtgtgaggcactgcacccagccagaattggctaatcttgaaggtacagtctatccccaccagaaagatctttaaaatgttaaaaatcataattttcagaaaattaaaaagtataaataacacaatgcttaaataaatcagatactatattgtgtcaattccatgtttttttcttgaaaacatcccagttagtacctttcatctttctgctacaaactggtctggtcattcgctagatcagctgcacagctgctgtcctgagaacgtccttcccttcatgctggggattcttttgtcttccactcctgtcttctggttaccatattttaaaaatctttctagatatagttccttgttttggtgaaaaaaaccaacaacaaaccaaactattcagcatatttttgagaaaggagtacagaggaaatggtttttaggatatataagaatattattatttagcattctgagggctttgttctcttctagcattaggtcgtgttgagaaaccccaaatctgttccgattcccagtccttctttttaggctgactctgttctccatctttagattcctgctcctttattatatgacttttttggttctttctggaagcttttaggatgttcttttcctttctcatttgaaattttacaataatgtgctttagaatgaattttttccttcattatgttgtcctcagtgagtcctttcaacatagaagctcatgacttcaaattgtgacgttttcttattattttttctgaagatttattatttctatttactgcctctgtggagatgattatatagcttttctcctttatgatgttaatgtgatgaatttcataaattaatttgcaaatgtcaactcaaccatgcattcttgagatacacacaacttcatcatgatatattatcattttattttattctgtttttccccccatatcgtaattgaaaggtaattggcatataatgagctgcacatattaaagtgagcaatgcggtaaattttgacatctgcatatatctgcgaaaccatcaccacaatcaagatattcaacatattcctcatccctctctctcaccgcccaatctctgggcaaccacttatctgctttctgtcgttgtagattagttttcattttctagaattttgcatgaatggaatcatgcaatatgtacattttcttttgtctggcttattaaactcaatgtaattaggtattcatccatgtttttaagtatagcaacagttcatttctttttattgttgagtagtattctgttgtatggatatatcaccagcggcttattcattcgcttatagatgaacagttttttttctactttttgcatatttcaaatgaagctgctgtgaacatttttctgtaggtctttgtgtgaacatatgcttccatttctcttggataaaaacctatgtgtggaatggctgagtcatatggtaggtgtatgttcaactttttttttttagcttttattttaagttcaggggtacatgtgcaggtttgttacataggtaaattgtgtcatgggggtttgttgtacagattatttcatcacccaggtattaaacctagtatacattggttatttttcctgatcctctccctcctcccacccttcatcctccagtagggcccagtgtgtattgttcccttccgtgtgtccatttgttctcatcatttaactcccatgtctaaatttttaaggaactaccaaactgttgcccagtttgagagctgtaattgtcccatattctcactaacacttgttatggacaatctttaaaatttagacatcttcatgggtagtaacaaaattgataccttatttcagttctaatttgcttttctctagtgacatagaatattgagcatcttttcaagtgattatttacaatgtgtgtgtgtgtgtgtgtgtgtgtgtgtgtgtatttttgagacagggtcttgctgtgttgcccagtctggagggcagtggctcaatctcagctcacagcaacctccacctcccgggctcaagcaatcttcacacctcagctccccaagtagctgggaccataggtgcacacctccacacccagctaatttttgtatttttagaagagatgagatttcgccatgttgcctaggatggtcttgaattcctgagctcaagtgatccacctgccccggcctcccaaagtgctgggattacaggcgtgactgtgcccggcctgtatgttttctttggtgaaatgcctcttcaaatcttttgtgcatttttttagtacattgtttgtgttcttagtattgagttgtaagagtttctttttttctttgagttggagtcttgctctgtcacccaggctggagtgcagtggtgcaatctcagctcactgcaacctctgcctcccaggttcaagtgattctcctgccttagccttctgagtagctgggattacagatgcacaccaccatgactggctaatttttgtatttttagtagagacggggtttcaccatgttggtcaggctagtctcgaactcctgaccttgtgatccgcctgccttggcctcccaaagtgctgggattacaggcatgagccaccgtgcttggccataagagtttcttataaattctagataaaaattatttgttgaatgtatgttttacaaatattttctcctagtctataggttgccttttaattttcttaacattatcttttgaagagcaaatgttttttaaatgtgatgaaggctgagtgtggtggctcaagcttgtaatcccagcattttgggagactaaggtgggcagattgcttgaggccaggagttaaagaccagactgggcaacatagtgagatcccctctcaaaaagaaaaattaggccgggcgtggtagctcatgtctgtaatcccagcactttggggaggccaaggtgggtggatcacgaggtcagcagattgagaccatgctggctaacacggtgaaaccctgtctctactaaaaatacaaaaaaaaaaaaaaaaaaattagcctggcatggtggcacgtgcctgtaatcccagctactcaggaggctgaagcaagagaattgcttgaacccgggaggcagaggttgcagtgggttgagattgcaccattgcactccagtctgggcaacagagtgagactccatctcaaaaaaaaaaagaaaaggaaaattaaatgcgatgaggtccaatttattgatatttnnnnnnnnnnnnnnnnnnnnggtgtccccagggctggggcaagggggtaatgggatgttattgtttaatagctacagattttcagttggggatgatgaaaagttctgcagatggatagtagcactggttgtacaacaatgtgatgtacttaatgccactgaactatatacattttaaactggttaaaatggtaaaattttatgttatatatattttaacatagttttaaaaaaaagaacaacaacaacaaaaaaacaaagacagggatagtggctcaagcctgtaatcccagcactttgggaggccgaggtggagagatccctcgaggttagcagttcgagaccagcctggccaacatggtgaaaccctgtctctactaaaaatacaaaaatgagccaggcatggtggggcatgcctgtaatcccagctactcgggaggctgaggcaggagaattgcttgaacctgggaggcagaggttgcagtgagccgagatcacaccactgcactccagcctgggtgacaaacggagactccatctcaaaaaaaaaaagaaaaggaaaattaaatgtgatgaggtccaatttattgatattttcctttttatactttgtgtttatgttgtatttaagaaatctttgttaaacccaaggtcactaagatttttttcttaagttttcttctagaagttttataattttagctcttgtatttaggtctatgatccatctcaaatcagtttctttctgtttttttttttttttttgaaatggagtcttgctctgttgcccaggctggagtgcagtgactcaatattggctcactgcagcctccacctcccaggttcaagcaattcttctgtctgtgcctcctgagtagctgggattacaggtgcctgcaaccatgcccagctaatttttgtatttttagtagaggcagagttctactattttggccagactggtcttgaactcctgacctcaagtgatccacccgtcttggcctcccaaagtgctgggattacaggtatgagccactgtgcccagccttcaaattagttttgtatatagtatggagtaagggtcagggctcattttttaaaatttttgattcccaggttgctgtttcccaggttggtcttgagctccttggctcaagccatccacctgcttcagcctccccaattgctgggactaccgaggcactccacagtgctgggcttcaaggtttatttttctgcatatggctattcaattattccagtaccattcattgaaaatcttattccttccccattaaattgttttggcatctttgttgaaaatcaattgatcatgtatgtgcggatctacttctgaattcttttttctgtttcaatgatatatatatgtgtgtgtctttttttatcatccctaatttattttaaaatgtgtctatctttatgccaatcccacactgtattgattgctgtagctttatggtaagtcttgaaataaagtaatataagttctccaactgtgtcctttttttttctttccaaatttgttttagttattttaggttatttacatttccatataaatcttggaatcagcagatgaatttttgcaaaaaatcttgctggaaatttgactttgattgtgtagaatctacagaccaatttatatatgtagatcaatttatcatgttaatgtgatgaattacattaattggttttcaaatattaaaccagcattttattttaaaataaaccccacttagttatgatattttatcttttttatataatgtgggatttgatttgccgatattttattaaagatttttgcatcatgttctttttctgaaattttattttgttctaatgtcataaaataagttggaaattatcctctctatctctactttgtgaaagaatttatattacattggtattatttcttccttgaatgtttgatagactatactagtgaaagcatctgggcctagggttttctctgtggaagattttcagttacaaattcaattttactgagtcaggtttgataagttacatttctcaaggaatttatctatttaatcattgaatgtattgaacattcatttgtttataattttgttttgttattgaaaatgtctgtaagatttatagtgatgttcccttttctattcctgacattgttaatttgtgttctctctccctccatccctctctcactctctcttgtcagctggtctgtgggattatcacctttattaatcttttcagagaaccactttttatttctttgatttcctttattgtttgttaactttttagtttattgattccctctcttagctttattacttccttccttctacttagtaggagtttaatttgccctcatttttttagcttcttaaggtaggaaatttgattatattttaaacttaaaaaaacttaaagctataaaattccctttaagcactgttttagctgaattctacatattttgattgggtatgttttcatcattcaattaaaaacatagtttctaattttttcttgcaatttcttctttaacccataggttatttggcagtttgctgctgaatttcaaagtgcttgggaggttttatagctatcttgttaaaaattgatttctaatttaattttgtcagagaacatactttgtatgacttaaatcttttaaaatacgttcagactgatttagggtccagcatatggtacgtcttagtgaatgtaatatatgccattggaaatgatgcacattctgcaattgttggttgtaatgtgctataaatgtcaaccaggttaacttggttgatagtattgttgaattcctgtgttccaaatgatattttttgtctgtttattctatcaattaatgagaaaggtttattaaaatctccaaccattgttgtgcatttatttctatttctttagttctgttgatttttgttttatatattttgaagctctgagtacatctccctgatgagttgacccttttatcattatgaaatgtcattctttctctgtaatgcttatcttaaaatctactttgtttgatatgaatgtagccacttaagctttcttatgcatactgtttgcaaagtgtgtgtgtgtgtgtgtgtgtgtgtgtgtgtatctatctcaatccttttagtttctgcctatctctgtctttttatttaaagtgtgtttttgcaggtagtgtatacttggatcttgtttttatattcagtctgacaatttatgcttcttgattattgtgtttagtttatttgcatagtgtgtagtccattgacatttggcataatattgataatttgtgttggagcgtattgtcttcatttctgattgtcccatctggttttgttgctgttttgttgttcctctgttccacactttttgtcttcttttgggttaatcaaatattctttggctttgcatcttatgtcttctgttggatttttatctataccttgtcgtatttttctttagtggtttctctaggggttacactatacattattaattaatcatagtccatttagaattaatattgtacactttacataaaatgtaaaacatttgtcacagtataaagtctattccttccatcttttgtgctataattgtcatatattttatttcaatctacattatatactccacaacacaaagttattatttttgctttagacagttagttgtcttttaagaaaatcaaaagaaggaaaaaaaagatacttttaaaatatttacctatgtatttatcatttctggcattccttattttttcctgaagattctgattttctatcatttcctttcaacccaaaatgctttttatagcatttcttttggtgtagagccacaggtgacagattcctttagccttcatttatttatctcatttatttcatgtttttcccttctttcaaaacacacagccttgcactgcctgtgtccagtgcctgaaaacaattggctcatagattttgtccagattgtagttgtttatggtaggagggataagtccaataccagttactctgtcatggctgaaaggggccatctcttctgtttttgctttctagaattccttttattcaagtattggacttctgaagctgatcttctgaatatttttccccgcccataattctatctgcttattttgtttcactctccagggaactttctcagccttcagctcgatggaaaagtctaaattttctatcatacctttaatttctaagagccctttccagtttttacagaatttgtgtgtttttaaaatttttttctggtcttagtaagtgtacatctttgtagtttttaaatgaattctgataaataggacacattttgaggaagcaaggtgttctgttatccttctgaaggcaggtatagcagtttcttagaagaggtttcttctgctctctctgttgcttttgatttctcttctctatacattttcatctttcatgttgggggctattctcaaatgtctggcaatccttgagcatcttttcatatttaaaagtgaggctttatggccaggcatggtggtttactcctataatcctagcactttgggaggacaaggcagggggatcccttgatcctaggagtttgtgaccagccccatctctacaactctaccaaaaaacaaaaacaaaaaaaacaaaaaggtagccaggggatggagtgcacttgcagtcccaactacttgggaggccaaggcaggaggatcacttgagcccagaattttcaataccagcctggccaacatagtaagaccctgtctctacaaaaaattaaaaaaaaaaaaaaaaagcattagctgggcctggtggcatgcacctgtagtcccagctacttgggaggctgaggctagagaatcgcttgagcttaggagtttgaggctacagtgagctatgattacaccatttcacaccagcctgggcaacagagcaagcccctgtctctaaaaacattaatttaaaaaaaaatggctggtgatagctcacgcctgtaatctcaacactttaggaggccgaggcaggtgaattgcttgtgctcaggagtttgagaccagcctaggaaacatggcaagttccccatctctacaaaaaatacaaaagttagttgggcatggtggcatgcgccagtagtcccaactactcaggaggctgaggtgggaggattgcttgagccggggaggcagaggttgcagtgagctgagatcaagccactccccttcagtctaggtgacagagggaaacccttggaaaaaaagaaagtgaggccctagaaggctatggggtcagggcttgtttcctgctggatcacagtgccagtaaggacctatgcgtcttgttcggagatcttgacagttggcatgtatttgtagacttatagcatccatagagaggtgttctccaatggcttgatggacagaataaaccagctgccagtgtccttggagcctactcagggaaggaggccagaggtctgtctggtgagtcattctgtagagtcttacatcctctctctgtttttggtgagaaccctcaccctcacttttaggtggcctggtgctctgagtccagaacctccagttcaacctgctcagagtgaagtctacagtccttttgagctgagaggatgcagtccctttttatctgggttggaagaagacacttgggtctcattattcttgatgaagaataccagcaaatcttccttacatagccccgccatgctgcccctcggggtctgcaattcctgagccattcagtatctgctgtgtgaccccctttaccttgggcagcctgctctcgccaagtttaaccctgctgagcctgctgggccggcgtctgttttctggcatttctcttgctgttgccttttctcctgttcactttgtcccttttgggttattcttttttgatcccttgactctcattttagtagggtttgaggaggaagggctgataaatttgtgcccaatctcctgtgtacccaccttctactataaagaaatggaaacaggaaatcattttaaaaattatgttatgggctgggtgtggtggctcacacctgtaagcacagcactttgggaggctgaagtaggaagatcacttgagcctaggagttagaagccagcctgggtaaagataaagagggagtattggactcaatctttacaaaaaaatgaaaaagtttgccatgagtggtggtgtgcacctatgttcctagctacttgggaggctgaggtggaagaattgcctgatcccaggaaagggaggctgcagtggactttgatcatgtcattggactccagcctgggtgatattgtgagactctgtttaaaaaaagaaaaaaaaaagttattatgtggatgatgcaagagagactgtggaactctactcagagtttcattgtaagcttggtcctacactaggaacttggtgaataaataaatgtacatttacatttttaggtcaaaataatttgcttgagttaatatgtctgtaggaggcattattatttttttcacaatttaccacttttactggggctttcgattcatcaatctattctattcctgtgatgtaaaacacagtctccttttaccttataacctttatttaatagcagatagtggttgtctggataagaggaaattggaagtccaggatagtgaattatgtctttcatatttttgagacaggatctcactatgtcacccaggctagagtacagtggcaacagtcatggctcactacagcctccacctccctggctcaagcaatcctcccacctccatctcctgagtagctgggactacaggtgtgcaccaccatgcctggctaattttgttcattttttttgtagagacagagtttcactatgttgcccaggctgggctcaagtgaccctcccaccctggcctcccaaattgctggaattacaggcatgagacaccatgcccagtcacatcttcctcttttccaggtgactaaatagctaagttacctgtggaagtggactgaatctagatgatagtactgctctcagtcctctctttttcaattgttcattaattctttcaacaaatatgtgttggctgcatgccctagtgcatctccctatgggaatgcacagccattgacttaatccacgcagatgtttcctggttgttcataagcataaaagggacatagttaccaggcacagtggctcacacctgtaatcccactcgggaggctgaggtgggaggattgcttgaggccaggagtttgagaccagcctgggcaacacagtgagacccctatctctaaaaaaattcaaaacaaaaaaaatcttagtcaggtgtggtggcacctgcctgtagtcccagctacttgggaggctgaggcaggaggatcactcgagcaaaggagttagaggctgcattgagccatgattgtgccactgcattccagcttgtgtgacacagcgagatcctgtgtctaaaaaaaaaaaaaatgggacacagttgttgtgaatttctttttttttttttactttttgtctgaaggtaaaaatgtatctttgttctcttaatttttgtcaggggggcaaccactcatgtcaaacaatagtggtaaggggaggaaaatattatgcaaagggctaaatatgctgtaaaaattaccttttctatgaatggggtcatttgaaacactttaataaaatacactggttaatagtcattattggaatcaagggctccacataattttaatcatcattcagaatacttcactgtgcagcaagatttagcaatgttataggccttggggaaagttttctgcatttcttttcaagtttcaagctttcatgttatagtcctagagacacactcttcccaaaagcaggaggaagaaacagcttgctgaatggtatagccagacccctttctggattcaaatcttctcaattctgggaataaatcatttggaagaatgacttttcttggaaaagcatagttcacgtcaatagtatccaaacagctagcaaggtgtttttttttttagacaggatctcactttgtcatccaggctggagtgcagtggcataatcacggctcactgcagcctcactgcagcctccatctccatggctcaattgatcctcccacctcagcctcctgagtagttgggactacaggtgtgccatcatgcctgactaatttttctatttttttagagacggagtcttgccatgttgcccaggttggtctcgaactcctggactcaagcaatcctctcatctcggcctcccaaagtgctgggattacaggtgtaagccaccacatctggtaacaactagcagttttagctgacaaagaaattcagccctaaatgacctggcctgaagttatttttgacatgtatcttccccactgctgcacaaggggctaaaggaactctctaccgtgatatctatgtcagtgtcttatgctaggattaagagtatttatatgcacaagggctgtcatttttcaaaaacctttctttcttcctctgtcattgtttcccctccagctctccaccctgtgcacaagatactgtcctggtcaaggaggggagggaaggagtctgtaaacagtgcccgtaaagaggcaagggcttgtgaagtgatggatgctgttggaacagagcaaagtctggcaggatggacagaaaatgtgggaaccaggcctagggagggtgggaagggtgagaggatcagaatcaaacgctggagagggaggtgaagaggctggggcacgatggaggtggggaagcccaaggattagggggtaacccgcacatagagggaaggagccagggttttcttggccgtattttatgtctgcctctccttttattttattttttagtggcagacttctgagaaataagaaaataagggatgagtatggttcccataagagtaggaactcacagtacctttcataagcttataattgattttcccatctctgttttcccaagcctgacaattcagacctggaggctttgcgcctgagagggggaggggagagaaactctactagtgcatcattccggccacagcccaggcttattagcatttgagcagcaagaaggatctatccctagaagcttcctccctgccttcttcctggaactccccaaggagtgaggaacttggggagggaggagatgatatagttgaaagaagcaatattaacagtcagggagttaaacccactacaatcagccacatttcagaaaaggtaaacatgccatttttatatagacttagtgcccaccaccccctaccccctgccaaatcctggttatagactaacagttgctgttagatgcttatgaaaaataaccctgtttcccaggatgagcctaacttgggctcacactaacttgggctgggttcatattgatacatttcttcctttttctcccctaatttttgtctggaggaaaaaatgtatcttcgttctcttaattttgggctaacttctactgcaggattttctggcctgaagaaagttcttccatatgagtgtagttgtgaacaaagcgtagctccaggagttttgttctgcatagtggggagcggtggaaaccacgaggctatcgcaggtggtggacttggcagagagaggagcatatgggtttgacagcggaaatagatgtcaccatctggtacccgggcccttcagatgattccattacctccctgtcctaccccatatctaggttgagtgcggatggcatttgagatatatttgcttaatttttttttcttttttaatgacatagtcctggttttaagcaaatggagataaaaggtgatgtgctctgttagggatgtctgccaaggcaaagctcacagaagacgggagaagtttctgaggatagactacctctgacattattgcttggattggagctgggctgtttcctgttagaaaaggcagaatacaagccccagggaaggggccaatcggtgtgccagctactggagcgcaaggaggattcattcctggatgagaggtgactcagcagagagatttcctagagacacctcctgcctcctccttgtatgacgttcaaatcagacttctagacatacagcttgttaggtgtttagtgattaacttttctgtgggacttgaatgtaaatgccagactatggcagtttgggatatggtcagttaagccagatatgctttgaatagcttgttagatttaaacatctagaattttgatggctgtgaactttgaggatcttacttgggattatggaattatagagacacagggcaaatgagataaatggggttctcttttgtagttttgttgttgtttagttcatgtggtcaggttattcagtggcatgtcccatgcagatttcttacatctgccatcagctatgacatcatgcctggattccagtaacaggatggcatttcatcaaattctgaaagtcatcattatttggactagaacaacctattccttaaaatgcctagtaagacgaaatctggaaacaaccccccaggttggaactccttaacaaaatcagggcacctttgctgcagttggctgcagtgtcacttacctggagaaggcgccttgttcaccccaggatgacctgtctgtgggttaaaaaacggtgctgtcccctttgagtcagaatggtgctggccattcccctgtcgtcttttcctgccaagttggattcagtgctgcatgctggatttctggcatgctggagttagtgatggggcaaagatatgtttggaattggatgaaactctggacacctcttcagctccactgtttagacagcagctggctggagtggcctcccagtcagtatcatccattctcgagactagaggcaatcccacttctgctgatggtcacccagaattccatctccccacctcctctccagatccatgagaaagaagaggaagagttcaatgagaagagtgaaaatgattccggtatcaacgaggagcctctgctcacagcagatcaggtataagtatctctccaggttatcgggaccttttgttcttttgatggagaaaaagtccaagagaacacacttgccacatccatttaaggcagaagaaagatatgtggtcatgtggtgcctgtgctcatgactcagagtattttttgtttcttttttttctttatatatatatacttttgagacagagtcttgctctgttgcccaggctggagtgcagtggcgtgatcttggctcattgcaacctctgcctcccggattcaagtgactttcctgcctcagcctcccgagtagctgggactacaggcatgcaccaccatgcctggctaattcttataaaaaattttttggtagagatgtgatttcaccatgttggccaggctggtctcaaactcctaacctcaagtgatctgcccacctcaacctcccaaagtgctgggattataggcatgagccactgtgcctgaccttttttttttttcattttgagacagggtctcactttgtcacccaggccagagtgcagtggcaaaatcagggttcactatagcctcaacctccttggctcaagcgatcctcccgcctcaggcccctaagtagctgggactacaggcatgcatcactatgcccagctaattttctgtacttttagtggagatgaggtttcaccatgctgcccaggctggtctcaaactcctggactcaagcagtccacccgccttggcctcccaaagtgctgggattacaggcatgagccacggtgactgtccaactcagagtatttttgataagggatttcatctctctttctgcctcaggttgcccacctgcagtgaacatgaatgtcattcttgacacttgggatagttggggtcagtctctgataggagccagagacaggcatagtgtttagtagctacaatcctgctaagccttcttattgaaattcgttgtactcggagtcaagacactcaaacaagggtcccaaatacctgttttcccaaaaagagaagtgacagatgaggcttttgtgtgatggatattttcttacatttcatagaacactcaaaattttgggccttccgaaaggagtcttagagccacttcgactttgtgaaaaaagatagagtgcttcgcattcaattgagatcatcatagctttaataatttattacttagagaggataatgttcagtttctggattccttatttaatgttttagtcaacaaatatttatgggtgcttattttgagctaaacactacataagtttccacaaagtctttctgcaaagctccactggcagccttcggtgccagaaagtgcttttttagcagcaatggtgctttttcatatctgtgatagaaaggtgggaattgaaacacgtgaggattaggagactgaagagaaccagatttttaaaaataggggctaatagctattcttgtgacttgtaggaggatctacaattcaatgatatgaactcaattataactcctcttagagaaaaggacattcagccataagaccctgacagggacttgtgtcatttggttgcattctgtaaaatggctttcagtagtcaaagactgggtatttcctaagtttgtgagtagaggtgaaaaggtttgggaataagaatggaaattattctaaaggaggagaccctgaaaccccttacctttggtccagcccactgtgaagaaaccacctcaaagagtacaatgctggcctcggggactttagtccatccatggagaacagacaaaggtgaaggttgggacaaaactcatctaaagacctgctttcagcagcagtcttctttatttgtaaataattaatgtacaaagtaattcactcttttttttgttgttgttgttgaaacaggatctggctctattgcccaggctggagtccagtggcccagtctcggttcactgcaacctctacctcttgggctcaagccatcctcccacctcaacctcccaagtaacatggactacagacacacgtcaccacaactggctaatttttctgctttttgcagagatggggtttcgccatgttgctcaggctggtcttgaactcctgagctcaagtgatccacctgcctcggcttcccaaagtgctgggattacaggcatgagacaccatgcccagctagtaattcacttttgttccttttggcagatatctaattttccctccacttctgggagctggctcctgtcaatagtctagattagagctggggttcttatctatttgctgctctctagactccacctatccttctattatttcattatctctattttcatttgttgctgggcagcttcagttcctgtctaggtgaattctggagaaatagttgttttcctccccattttgtgttgttctaggagcacgctattttttacagtcacgtgtattatgtcaattaatggactgggttttgtgttaaagttgggtgaatgaaatattttcccacttagaaatagctcagcacattgaagtaaatgttcccttccaggcagctctgccttgcttcctgaaagagcagcttatttccaataagtcatttatctaaaaggagctcttggaagaggttttacattaaagagtgccttacattaaagaaagagtgtatgcaagcctttggttggaactatttttattattcagtatttatgtaaaaacaatattgctttagaaattttcagatagctaattaggaacatccttaactgatcaaaattcaagccagaatgcccctctagcagagaacagagttagcactctctcgtgtaccttcttcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaaggtgagggccctgggcgctgggctggccgaggaggaagcacctgctcggggccaggctctgggctgtgtgctttgtacatggctaatagaaccctgactgcctcagagcagagccttgcagatctaggtggtcagcaatacctttcttactcggcatcaggagagaagtttgcatttttgagaaaagaacaaggtagtcgagcaaaatttaaatgttaaaactaaccaaagaacaagactaaggcagaataagcagaagaaatctgaactactatataaaagcaatgaatgatgctaccataaaatcaatgaataaaaaaggtaatagtaacagctcatatttctgaagtgctttctatgtgccagaccttattctaagactttctttcttttttttttgagacagagtctctctctgtctgtcacccaggctggagtgtagcggcatggtcttagctcactgcaacctccacctcccaggttgaagtgattctcaagcctcagcctcctgagtagttgggactacaggcacgtgccaccacgccctgctaatttgtgtatttttgtagagacgaggtttcgccatgttggcaaggctggtctcaaactcctggcctcaagtgatctgcctgcctcagcctcccaaagtgctgggattacaagtgtgagccactgcgcctggccttattctaagacttcctatgcctaatctcatttcatcttcacaccaaccccatttggatcaagctaactgagtctttcagaggttacatgacttgtccaaggccactgttagggaaatatgattagaaatgagatttccttcctgttcagaaaacctctccacaaagacaggtgagaaagaaaactattttgttactatttttatttatttatttattttttagagatagaatctcgctctgtcgcccaggctagagtgcagtggcatgatcttggctcactgcagcctctgcctcccagcttcacgcgattctcctgcctcagccccctgagtagccgggattacaggcatgcatcaccatgcccagctactttttgtgtttttagtagagatggggtttctccacgttggccaggctgttctcaaactcctgacctcaggttatccgcctgcctcggtctcccaaagtgctgggattacaggtgtgagccaccatgcccggcctagaaaactattttattattgaataagcactaaaccaggatgggagccacatcacagacaactctctgaagagactgcaaagacagaaagcagtctcactcttgtgtagctaagtggatgaatggaacccattacattgagtaggttttgcaatttggagtcggaagggagttaggcccctctgctcagaacaatgagagatgattatgtttctttttcttttctttctttccttcttttttttgagacagagtcttgctctgttgcccaggctggagtgcagtggcatgatctctgctcactgcaacctccgcctcccaggttcaagcagttctcctgcctcatcctcccgagtagctgggattacaggcatgcaccactacgcctggctaatttttatattcttagtagagatgaggtttcacatgttggccaaggtggtctcgaactcttgacctcgtgatccgactgcctcggcctcccaaagtgctgggattacaggcatgacccactgcgcccggcccgatgattatatttcaaagcagtaacctccaggcccttgaagaaagcctcctgaattataagaatgacaagaggcttattttagccatgacaataatttaatgtaaatgtaacatatgtttattttaaagatttaatctaaatctttgagagattgaaaaggataggtagaagaaattctgaaagaaaagggaggtgggggagaggaaaagtctcttcccttattttcaacggggagaatcaagcctctcatttaaaatttgtatttgtgcttagtccatgcagaagccataaggggtgaagctaacatttgaagccaggtaggttaactccagaggccatcctcttaactctctgacacaggtttatagtaattatgactgtgcacaagaaacggctggatgaagcatgaaatgaaaaagtgtaacacagcaaaggcagaacaattcaccagccgtagggtatcaaatgcccacgctgcagaaggggccccatcctaggagttgatccacccatggggagatgggaacttagaaacaggggagggagaaggtgggttggtcagggttcaaaggtcaactgcgggttagaagtggtgaaagcagaggcagaatctggaggcctgcatcctgcaagtcagactttggctttgaatagcagcggcaggaggtggccggcagagagtctgctcggtgctgaactggacttggctgcctcgctgcattcccgactgcccttgtcaggcccttcccagccacacaaaggtcccaaagatagacgcgttcagcaaaagacttgtgaaaacagctgaaatgcagagtgaaatggcaaaaaaacagaagggggagagggcagctccaaagagcagaataaggggaaagcccaaccaagtcagcaaatatccgggcaaagcagaaacaaagaggaagagggaaatggattctgaggtgaaagtgaaggacaccattagacgctgtacatttgaaaataactaaaagagtataattggattgtttgtgacataaaggaaaaatgccttagggagtggatacctcattctccatgatgtgattattatgcattgcatgtctgcatccaaacatctcatgtgctccataaacacatacaccccctatgtacccacaaaaattaaaaattaaaaaccagtcaatcaattaattcttcctcccctgccgcaaaaagataccattagatggagacacattttaaaagatgtttcccaagtatattttattttttcaaattatatatatgtgtatatatacacatatatatatgtgtatatatacacatatatgtgtatatatatacatatatacacatatatgtgtatatatacatatatatgtgtatatatacatatatatatatatatattttttttttttttttttttaaagtagaaacagtttcaccatgttggccaggctggtctcgaactcctggcctcaggtgacccacccacctcagcctctcaaagtgctgggattacaggtgtgagccactgcacctggcctaaatttttttttaagtgtttaaaagaatttttaatcagaaaatgcttaaagggtataaagtttttatttatttatttatttatttatttttattttaagatagagttttgctcttgttgcccaggctagagtacagtggtgtgatctctgctcactgcaacctccgcctctcaggttcaagcggttctcctgcctcactctgccgaatagctggaattatagtcaggcaccaccatgcctggctaattttgtattttaagtagaggcagggtttcactatgctggccaggctgttttcgaactcctgacctcaggtgatccgcacatcgcagccttccaatatgctgggattacaggcatgagccactgctcctggcctaaagtgtataaagttttaaagcatgatttagacctgtatacaagtataatctcaactatgaaaatatataacatgtaaacagaaaaatttggaataaaatatccaaatctattttaaatgaaagaagtcttaggagacttcttaaagttatatatttcccatgatctcagcttcccttttctttcctttgaaagtagctgactgccgtatgctaacccgctaggctttattttttcatgcatagtcaccaatcttccaggtttcacatatttttgaatacatgcactgcgacacaggaccagagatgtaaagaagggctcagatggtcggcttttttgttgttgttgccgtatgctatatcttgatcagttcttgggaataagcaccaacgtctctattgctcttcagtatggatgacaaaaacctccctcccatcacttttccatccccaattcttgacccatttcacacaaggaatcttatggacacagatagaaaatagaaggaacaaaccatccccatttttgagaatagagtccacagacttcctcgtgggctgtttcttcttcctcctttgtttcctgagaggggtgttctcttctgcagtcagtacacaggcccccgccttcctggcgtgctcgtaaattgtgaaggtctttcttggatctttaaggagttggaagggatctcctctgaggggcagtcccatcttgattggtggtggccccaggagcctccccagcgggctctggtgtggatgcaggtgttatgcgggagacggtcttcccctgcagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaaggtaggtgaacaaccaggtggaagactgggtgcctccaacctccaaccctgcccgtttcagtgccctaccaaccctgcaggggactcatcaacgtttaccgagcagtggtggtgagcagcacactgtgacagacagggggtcagaaagggagaagatatcacctatctcctccactcccccaaagggctcacagtctaacccaggaagacagtgtgtacattaggaaataattgaatttggcttgtgttctctgtaggcaagaccttaaagaaagtggagtgagggtatttcgtgttgggagtcttgagatgggcctcagaattctgggtccaaatccctccttgtgtcccaggttccagtcctgactggtctctttagggcgtgctaaggtgtttcagtgattgaaaatgatcaggtgccttattattattgttattattttttgagacagagtctcactcttttgcccaggctggagtgcaatggtaccatctcggctcactgcaacctccgcctcctgggctcaagcaattctcctgtctcagcctccctagtagctgggattacaggttcatgccaccactcctggattatttttgtatttttagtagagatggggtttcaccatgttggccaggctggtctcaaactcctgatctcaggtgatttgcccatcttggcctcccaaagtgttgggattacgggcatgagccaccgtgcctggccccagatgccttattgttctattgttctatttttgggtttaacccaaacccctggttctcatggttcattttttttttcttttttttttttttggtgagatggagtctcactctgttgcccaggctggagtgcagtggtgcgatctcggttcactgcaatctctgcttcccgggttcaagcgattctcctgtctcaacctcctgagtcgccgggattacaggttcacaccaccacgcctggctaatttttgtatttttagtagagacggagtttcaccatgttggtcaggctggtctcaaactcctcacctcgtgatctccccgcctcggcctcccaaagtgctgggattacaggtgtgagccactgcgcccagccactcatgcttcttaatcaggggagctcagtagaattatctaaggagtttttttcaaaatgcctttccctaggctctatcacagacctatggaattagttctccgcatgtacattttgaaaaaaacttcccccatcaggacagttgctttaagacagcctcttctgatagctgaacattttgttttcccctaagatctttgcatcatggttcatttaagtttgactgaactgctttatttttctatttgcatgatggaggataaaaggaggaaaactgggggatgcagaggggtcttgtagccctgagggacttactaagataagagttcttgagactctgtttattcttgcaaagctcaggcttcaattctggcctgtctctgtaagccagtgtcttacacttactgtctagtcacagaaccctggggcgttatctgggacagcctggtagctgagaggtccctgggtgtggtgacagtgtagcaagaagcatttgcccttcttgagtctctctcccccacagcgcttcagcatggaaggcatctccaacattctgcagagtggcatccgccagacctttggctcctcaggaactgacaaacaggtacgcgtagtctccctgctccaagctctcttcctagactcctgcagcttggcctccccagcaacgcagggggacagtgactcaccagaattatcccagcatttatttagggggttaggggtcctaacacttttttctcctcttaaggaggaacagagaatatctttttaaaaggcaaacttttttttttttttttttttgagctctagtgttctaggacatgggcaagacttaaaactcaacactgcttgtaggtctaagaattaagttgttttaaggatgaaatgcattaagagggagtccatttgatgatagatcccatcctagagtttagttaactttccaccacactggatcacctgccaagccattcccactaagactgcctctgcagcttcccagctctggttggaacccatgctgtggctttttgttggctcagtaatttccctgtgacatagcttgcatttctggttattaagacagcattcacaacttttatcaagcgcctgctatgtgctaagctctgttgttaagccctcaggtgcaaaggtgaaaagtcctgacccctgtcctcatggagtgtataatctaatagacatggctggcacgtgaacagaaagtttgagatggtggaatgagtgtacatgaaagtgtatatgttttaaacatatttgtagctgaattctaagtgctagaattctagaactctagaattctagagagtctagagaaggggaagagattttagcagcatcgatcccagtcctcttgttttatggcagtgagaactatggcctggagattcaaggcatttttccaaagccacacacactgtcagtggcaaagccaagactaaaatgtgagcttctggccgggcgcggtggctcacgcctgtaatcccagcactttgggaggccgaggtgggcaaatcacccaaagtcaggaattcgagaccagcctggccaacatggtgaaacctcatctctactaaaaatacaaaactagccaggtgtggtggcaggcacctgtaatcccagctacttgggaggctgaggcaggagaatcgcttaaacccgggaggtggaggttgcagtgagccgagatcaagccactgcactccagcttgggtgacagagcgagactctgtctcaaaaaaaaaaaaaaaagtgagcttcttagctttgatctagagctctggcactcaccacctcaggcttccttgagactcctttgacagcccactaggccctgatgctggttttgttgtaggagcacctgacatccagcagagggagcaaatctgacatcagagaccctgggcggggttgaggttctcttgcatatcttttttgacaaaagacaaacaattccttctcaaattgcactgcaaagaataagaaaatataatccccttggatttattctctgctttcagtctaaaggagaaaaagctccccaggattcctaaataacagagaagtttgtagtgtaggaagaatctagaagttgggatggagagaaatgtgggaaagtcttacttttaaagagacattccctaaagaggggtaagaagttctgaaacagtgacgtaccagtgaccatgaatgtttcagagaaggtcagatttgcagtgtgtgtcttagagaaaggctaaatctcaacccagaggaagcatgtcttctgtctcaagccccctgcatgctgtttgtcttgcagtatctgaacacagtcattccttacgagaagaaagcctctcctccctcagtggaagacctgcagatgctgacaaacagtgagttcctcttgttctcagccagatcagtggctcctttttctcccttcctgcctgtacgttgtacctccgtgccgcaggcccgagactcctcaaagcaggtttacatgggccaaaataccctccaaattactgcgtcacatcctcccgcacagtgtaaaattaaaatactctgcagtgataaccagagctgttttttctttctcctggttcccataagggaagaggcctgctgggggaaaaaaaaatgagctggtgaaagaggttggggtgctggtgcaggggactttttgttttcccctgcagttcccaaggcttggcatcctctgcctccctgttctctctctccctgcaacttgaggttgcctggtcggcacttgtgccccttgaagcagggcgcctggtctctgggtctggctgtatttttaatgagaagcaaggtttcttgggtggggtaaggctgactggaaaaaatagagtccagctttccttccaggaagtgactgcctcctctcctccactttgctctattgtcaaatattaataaacattctgaactatgagggaaaacagtgtgtaacaaagagccttttgtagacagtaactgtttatatacatcaaacagtacgacccccaaagggctggggggcacatggtgttagccatcagtgtcagcttggccctcttaggacgagaaaaatcctaggctgagatgtggtgacaggcccagaggatcacgagggaaattccatttccttggcaaccgtgccctgcagagagtgacagctaacgaggccccgcccactgcagcctgttctggagggaaggggccagtgcggggctactggatacccaaggagaggggaagttgagcttctgttcagctgaggaggatggatacctgctggggcctggtgctgaaggtgaccaaacgtttcattttttgtcaatttggagagtgaaagcaggaggttctggcaaacagaaatcctgcctacatcatgcctgcatcaatagacactgtgtccttgagaatcaggaattttaaaatcaaagtacagtgacttgtccttaactcattgtaaactcctttatttgcataaatatgcactaagtttctttttttttaagggagaaaatagagatgaactgacatttatagatgtttgtgttttcacacaagttacatttggaaagtaatttggacaaattatgaaggttgatatatgtaaagtattctatcatagctcaaaaaaataaatagctattaatttgttgcagatacccattcaggaattcagtgtgaaatcttttcattttaattaagaaacagacttttttctattttgagtggttttgtttacattttttaagttcattaaaaaaattatagctagagtatatccatcatttagactactttggaaataaggaaaagcaaacaaagaaaaataaataactcattgtctactccactatggttaccattttggtgcttttcagacttaatattttgtatcttttctatatagttgagattatactggctgtaaaattttgtgtcatgattttagtcacattagttaacactttgttaatgttctttttatggctatctcttctatcatgtggatatactaccttccaacattttattgcttttagaaaaaaaacctgccatcttttctgaataccaattctcctgtaggttatgaagcctctcttttttggcagatcctcatatgaatttgtgaacaatgcctcttctctcttctactctttgaactaagtacataggccaaagaccagctcctgcgactagccaatccttgtaaattttagattttggagattaatttagatacgtattggcaagagcaattattgtatttttacgtgatcttcgtggtgtggcatttagtctgcttatgctcagttgcaaagtgttcttgacaactaagctgaaatgaaggcatgtctaaaaatgcagaaaaaaataaaacaggccgagtatggtggctcacgcctgtaatcccagcactttgggaggccgaggcgggtggatcacctgaggtcaggagtttgagaccagcctggccaacatggtgaaacccccatctctactaaaaatacaaaaaattagccagatgtggtggtgcacgcctgtaatcccagctacttgggaggctgaggcaggagaatcgcttgaacccgggaggcggaggttgcagtgagctgagatcgcaccactgcactccagcctggatgacaagagtgaaactccgtctcaaaaaaaaaaaaaaacccagaagaaaccaggaccccctagaatccacttaagctgagatgaatacatgtctaaagatacagaagaaataaaacagaaacaaaccaacccctcaatggcctcaggttgagtctctttttctggacctggctgctgactcacgccaccattggattttcttcctcactcactcctaattcttggattcaagtttcattaccctgtcttgaaactagtcaaggtaatcaatcaaaggaggacaaggatatcgaaatgaagtggcaatcccactgttgcagctgccttctgaccctagctatcagtgccagttgatctttagtgttttcttggcttacaaaagtaatacatgctcattgagaaaagccagaccccacagaaatgcagcatagaaaagaacatcccctattgtcttacactcagagataactacttaacagtttcatgtattattgttctagattttttttctatgaacattagcatttaattataaagttaataaatgttctgtaacctttcttcactgataactatgtcttgtacatatagctctctcttatttttcttttcttcctcttcttctttttttttttttttttttttttttttatagagacaaagtcttgctatgttgtccaggatggtctttttcttgtttttgagacagagtctcactctgttgcccaggttggagtgcagtggcatgatcacaggtcactttgggaggccaagtggggaagattgcttgagcccaggagttcaagaccagcctgggcaacatggcaaaacctcatctttactaaaaaaaaaaaaaaaattagctgggcatagtggcacgtgcctgtaagtctcagctacttgggaggctgagagggggaggattacttgaacccaggagtttgaggctgtagtgagctgagaacacgccactgcacttcagcctgtgtggcagggcgagatcctgtctcaaaaataaaaaagaaaagaaagtcaccagtaggtccactacctagagacaaacactgtggctcttgctgtgttctcgtctatcaccatgtgcaggtttgttacgggggcatattgcgtgatgcctctcaagtactttggactacaggcgtgtgccaccacacccagctatcttttttttttttaattagaaatgaggttctgccatattgcccaggctggtcttgaatgcctgggctcaaggtctgggttacaactgaaactaaacctgtcacccaggtagtgaacatagtaccggataggtagttttttagcccttgcccctgaaatgctgacccctgatagagccttctagacttttgctcaatactcaataaatgtctggttcttttgaatcatttctctctcactctgggctggtgggtcatgtggccctagaagtgaacctctgaccagatggtatcttagttcctctctctgtctcctttcctagttctctttgccatgaaggaggataatgagaaggtgcctactttgctaacggactacattttaaaaggtaagagcagccccaggcctcctggagcagaaggggttctctggagctcctgctccagttagggaaccttcccagcttgcccatgccagaccagaccaggcaggggccagggaaatcagggacaattgaaaggctttggagtaataggttttccctttgggtgttgccaggaggccgcaggaggagattccatcacccccgagtcaccagtgactttccttggagcaacaaaccaacaaaggacttattgtgaaaattctgcagagtttgggctacttagtatttagttgggaaaaacaaaacctgatgataatttaatacttttcaagcacttgaaaggaagctggagacataattgactacaccctttcataactttttaaccttgtcttatggaaactggttgtacatacaagagtagaggaaatggcataatacactctcaggtactgatgagctggcatcaacagttattaagtcccggccaggcttatttcatttacgcctctacccaacttctcccctcccatgttattttaaagcaaatctctgtcatagttttcatgcataactatttcggtatgcatttctaaaacataggaactcttgaggaaaacatagccataataccatttcacaactaaaacaaatgaagagtttctttctttttttttttttttgagatggaatctcgctctgtcacccagtctggagtgcaatggcgtgatctcagctcactacaacctccgcctcctggattcaagcaattctcctgcctcagcctcctaagtagctgggattacaggcgcctgccaccatgctcaactaatttttgtatttttagtagagacggggtttcaccatgttggccagggtggtctcaaactcctgacttcaggtgatccactcgccttggcctcccaaagtgctgggattacaggaatgagccactgtgcccagccaagagtttcttagtactgactatccaatcagtattccctgtttttcccataaagtatttttcagtttatttgtttgaatcaggggccaataaagatcagtaggttgcaattagataataatatgtctcttacatctctttgatgtatataggttccccttttctttctctcttccatttcttgaaatgcatttgttggagaaactaggttgtttgtgccatagaatttcctcattgtggatttttgctaatttcatccccatggtgtaatttaatatgttctcctgtcttctttattgcctgtgaactgatagaactggaagcctgatcagatacagcttccgattttttgataagcactacattataggtggttataggtttccagacttccatggggtgacatatattgtctgattgtctttccttttgtgatgttaatagtccttgaggattgctcactgtctagatctattattttattgttttttgtcctgcatgcacacaaaactatgtacggttgcagagggaccatatttgtgggacctatagctaagaaatcctgagatatattgtttctataaggatcagaaggactaatcttaaatttcagcaggaggaacttagagtaaacattaaaaataacttgtccagcctgggcaacatggtgagaccgcgtctcaattaaaaaaaaaatcagccaggtgtagtggtgcgcgcctgtagtcccaactactcaggaggctgaggtgagaggatcacttgaacccaggagctgagactgcagtgggggctgtgatcacaccactgcatccagcctgggtgacacagcaagaccctgtctcaaaaaaacaaacaaacaaaccacaaaacaaaacaacaacaacaacaacaacaaaacacaaaaaaccacagaaagggtttgtgactcaaagattttaaaagagcagcacatttctcaaaggaggttctcaaaggaggattatagaaacaggttatataaatttggtagtcggagggctggactttacccctcacgagccactgagttgtcactgaatttgtacaagtgattaatatttactcagcacttgccacatgcctctcaacaaccctgcggggtaggcgcaggtacgttctattgtattgatgaagaaacaagcatggaaaggtgaagttaatttccctaaggtcatgtagttagtaatggctggatccaggatttgaactcaggccccggagactacacgcttagttattataaccagcaaccacctgccattgtctctcccttattctaggcactaagtgggggctgtcaccactcaggagctggtgtgactgctctcagctagggctatccagggctcggaggtccccacctgcaactgtgttctgaccgctctcccctcctctcttctcgttgcagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaatattcttcatgtgctttggagtgtgatgtccattagccctctgctccagactccagagacgggctgtatagcattctttgcacgccggcctgtggcctgtggcagccagtgctgtgtttagggaccgggcgcatgtcctgttgtgggtcgtggtgggatcatgggacacagtggggctgcatacagcataggcagaaggagaccctctgcaacctcagtttttgctgctcagccacatgcaagggagctgcaccaggggctgcagaaaggagctggtcagagtgggtgagacgggggtgagagtgtgcaattagcagatagaaagtgggcctcatggaggagccacacagctgcagatctcctggtgggatggccaggctggccctggagaccctccccaggctgtccacggggacctggaggctcagggcctgcgggaagtcagctctgctgagctttcccaacgtaggggactgcaacttgtttcctgta[450 bp omitted]ctgtgtaggaagtggtagagtcaggctggcatttaggtttcttatccagtgagacttccattgattcccaggagtttagtgtctgcttgaactaagcatgccacagagaaagccatactttatcacatcagcagctccacagaaggccacagaatccatctaggggacacagaaggcactcccagtgccctgcctcccttcctgggcctctgctttttttttttcagacggagtttgactcttgttgctcaggctggagtacaatggcgctatctcagctcgccgcaaactccgcctcccacgttcaagtgattctcctgcctcagcctcccgagtagctgggattacaggcatgcagcaccacacccagctaattttatatttttagtagagaccaggtttctacatgttggtcaggttggtctcgaactcccgacctcaggcgacctgccctcctaggcttcccaaagtgctgggattataggcgtgagtcaccgcgcctagctcggcttctgcttttccagaagcagaacactagcaatcttagctaggggtggcggagacttatccccccaggaaaactgctgcaatgcctaaagctctagtccaggcatctgcccagagcagagcttctccatagatagagccccggctgccacaggagcatggaagtgacaactcgtcctgtgataaaagggcatggaaagggcagttcagttcggcagttcactggtgctaaggctgaacatgcccagggtcattagtggtgtgaggtcattagcatgtttagcactctgccggcgacggggtttttcaccagcctcagcaaaggggaagcagtgaattcctgagagcttttcttcctgccttggatttgtcagatctgggtcagccactcctttcccccaatttatcctgccagcaggtgtctgaagcggcagagacaagctaatcaaagctgctgggagttaaaaataaatctcgagtgttggggatacactctggctaggaggaggtgagcagggcaggctgaaaacagtggctcctcctttctctct

SEQ ID NO: 16309 - DNA, 11874 bp, Human
tccaggacctgctacttaatttgcagatcccagtgcaaaataaaaattcaggactccttgttcaaaaagtattatggggccaggcacggtggctcatgcctgtaatcccagcactttgggaggccgaggagggcggatcacgaggtcaggagatcgagactatcctggctaacacagtgaaaccctgtctctactaaaaatacaaaaaattagctgggcatagtagcacacacctgtagtcccagctacttgggaggctgagccaggagaatcatttaaacccaggaggcagaggttgcagtgagccaagattgcgccactgcactccagctcgggcaacagagcgagactctgtctcaaaacaaacaaacaaacaaaaagtattctgacgttcaagctggcaatagcagagcattcctgcttttccattttccaatctaactatcaggcccttctaagtgcatggccctgtgtgactgcacagacggcacgtccagaatgccggccctgcccatgcccctttccagctggtgatggccccactcccctctcctgtcctcagctgctttcttagacagatcctcggagcctcctggcagcaacccagccccagccacctccagaagtttccagggccctgttcagtaggcactcagcacagattccccaaggtcctgggggaatcttcaccccaggccaccactcacatcctcctcaaatcaatgcacagttatcgagccccacctggctaagccttaggaagggaggacaagtggataaacgatcactgccctccaggagttcagtttatagcagagcgaagacttgaacaagagcaggaccggacaagaatcctgtcaattcagagaaaaataatcacagtttattaggaaactgaatttcacaaaagagagagcataaagatgggctttcgtgaatgggcaagatttgattaacccgatgaggaaaggggcattcaaggaagaagccatggcatgggcaaaaacttagagataataaaatgcatggcacgttctagaatcctgaattgtacagtttggctgaggtgtgcagatggtaaaatagtgggaaaaagctggaaggaaaatgtacagagaagagctacaagggtaatagtgaagtgtttgtactcccttagtggaaacaccgaggggactttaggtcgtgatgtttaggttatttgggagcaaagggagaagacttcctccccttggccctcacagcctgcccgaagagtgcaaagcctcacgcttttgcaaaacaggccgcacctagcccagattctggagctgattcagtccatgcctctcgacccacagtttgtcctgagccctgacaaaggtctggccccctcctgcactcggaacgcggaggacccgcagctcgtggattcgcgcctcagtgcccaagctggtgttgatgggggttgcggtttcctgccactcactccccatgggtcctgtggggggcgtggggatgcggggagagggtttcagaataggatcccggactgggagggaagggacaccatctgggcacacccagtaggtacgaccggaggtgaaaaaagagtgggtcccatcccctgatggccccgctcgctatccactttaagtttatgttatggatattttcaaacatattcaaaagtagagagaagagtagaatcataacccaagtccacaccgcccagcttcaacagttatcccctccaagcccatcttgtttcagctaaccctctcccaccacccattttaaagcgggatgtgggtgtcctgagggaggtggaggctccccagttggagagcgggtgcccgcacctctggaggctgaggcacaactgggctgggagttgagcgcataccgagtaggggctgcgggggagcgggggcagggccggcggggcggggccagaagcccggcggggttgggggcgctctcctagtgactcaaggcgcgcagcgctgggcgcaaagcgccagtctccgccttgcgagctcagagtgtgcccgctgcgccgccgctgtccgtacctgccgccgccgccaccgccaccatgcccaacttcgccggcacctggaagatgcgcagcagcgagaatttcgacgagctgctcaaggcactgggtaagctggtgcagagggcgcgccccgacggggagatgcggcccggaggtgccctggtcccggaagtgccccggtcctggagggggtggaagttggggagcccaggcaggagggagtccccggggcaatagatcgccttgtctcccaggcgcaccgggtctcggagaagctggtagagatcccggaacccacgcgttcagcgaacgtttgctgaatgtttggcgccctcctcgatggtgcggactttatctcgtgctagatcatagcgaggagagattactggagagcaaggaggatcagggacttaaatttggagactcaaatttgggaccaggctctgccacgaattcactgtgcaactcgaggaaagtcacttaccctctctgtgcctcagtctctcatctcgaaaacaagggcgagggcagggaaacgagtggatcaattttaaggcccctttctaaagttagggtatgaccagtgcccgaccggtcccgagactggcggcgaggccccgtgacccaagcctgtggtgcaccctgcgcaggtgtgaacgccatgctgaggaaagtggccgtagcggctgcgtccaagccgcacgtggagatccgccaggacggggatcagttctacatcaagacatccaccacggtgcgcaccactgagatcaacttcaaggtcggagaaggctttgaggaggagaccgtggacggacgcaagtgcagggtgaggccccagagccactacagcgtccccgtgtccccgctcggtgcccatggcccactgctgctggaggaacctgtgtctccctttgcagcctgtggcgcgccttccttgcagggtgtgtacactggctgtttgcagagggggtttgtgcatcctagttgcccctggctcaagacaaagtattaccttcattccatctcaaccccatccctacgctgcctcccggggtgctaacagccgcgcttaaagagcgggctctgggttgcgccgcgttcccagcagtggcttttgcagcggtttgcagcgccaagcgcaggcggcgcaggaggaggaggaggttgcaggagccgccaggttctctgtcgcaggtgaagccgcagctcttgcattcctttcccgccgtatcccccgcgcccgcccgggtccctgggccgcctgggtacgctctggatacagttttagcagtcccgatggccccgtcacctctcccttcccgccttcggcctggttccttaaaggaacggcggagtctttccaaaagcaaggcaggttctggctgggaaaatggactagttgccctctcttagtcctcaagggcaagagtttttttttatttctccatgcatcggcccagggatgaaccggtggattgaagcaaggggttgtacattcgttttttgcatgggcaaaaattgcatttggttaaccagatggaaaaataatcaccggtgctaccacttatttaaaaagtgacagaatgtctccctccccttctccaattttttttttttaaagaaaaaagtcgtaacattccagagagtgggaaattgtttctttcacctttcctgagcagtgcctggtctgatctcggaatgggactctctgagcaccgggcttggaaggacaaagaaacaaagccccccagaagcaggctgatctaggaggcaatctttggctccagaattgtcatagcctggaaatgatctccacgcttggagggggtgggatctgaagcctaaactgcactgcagaaacaaagagcaggacagcatagagtgaagggctgggagtctaagagaggaggcttggcaataggcagggctcagtctggggacatccaatgttggctactgccaggaagggtaattctgatttaaaaaaaaaaaattaaaggttcacacaacagccgggagagtggggctttatgcaccccccatccccccacaccttgcctaatgaatgtgtcccatgtgttagttaaaaactgattatgtgcacattcagctctggcccaccccccagcccagctgtaccacacttagctttgtgcagacactggggaaaaacttcaggaaatccctccttttgcctcccacctccaaaagcatgaagagccttcagattgatttgctttttaaattttttctaaagggatgtaaccgggaaagtggcagcattttaaccctcagagccaaagacaccgaggtttatcagtgcaggggtgcactaaatctgatgaggagtgaacagaaaggacgttcctatcccaaaatccatgcagggaatcgtgctcctgataggctgatgacagatgtggttacaaacttggtgtcttaactgttgtcaaatcttgtggttctgatgtgaaggttcttgcttttaaaatccaaattatgttcacctgaggtcaggagttcgagaccagcctggtgaaaccccatctgtactaaatataccaaaaaaattagctgggcgtggtggcaggcacctgtcatcccagctactcaggaggctgagacaggagaattgcttgaacctgggaggtggaggttgtaaggagccaagattgtgccactgcgctccagcctgggcaacagagcgagactccatctcaaaaaaaaaatgaataaaaataaataaaatccaaattgtttgaagggttagctaatttttatataaatgaatcatttcatgctctaaattttattcctagagatgtaaagcatgcctaaggcctcgctgcttcagtaagagattgtttgtgtgtgcttgtgagtgtgtgtgtgtgttatacaaggtgtatttataccccataaaatctgtgaccagcactctgaatttggactttataaggctcagcggagaagaatctgtggcctgctgacagggaccatgtgttgattctctgcagagcaattatttttcaatgctcattgttgtccctgctcccgctgctgagactctaattaatgtcactaatggttttcccgcctgcagagtttagccacttgggagaatgagaacaagatccactgcacgcaaactcttcttgaaggggacggccccaaaacctactggacccgtgagctggccaacgatgaacttatcctggtagggaacccttgaccctgaaataatcctgaagttcccccagagggggccccagatgggccccacaaatatgtcctcctcactcggccgttcagagaaagacaccatttgccctggattaaaattagagcagaaaacccgagatgacagttcaggtcagaggaaatcattgttaaatggttggcaggaaagaggagtggctcagaggatggaataggggctggagacaggctggagtgcctgccactatccacactaatacatcccagtggcggtgacatgctttaagccaagctcccctctcatcaggcttggaatgcttaggctctatgaggtccccacgctcacatggcagaagggattttttttcattctcattcccccttttgctggctggaaaaggtttcagtaatttttatcacatcagcactcagaaccttagagaacatttttagctgtgatttgcaaactccaatggcctttgggagccaggcaatgaatgctaatttgggaagtgtctgagtataacacagtgtggagagatgagcccctgtagaactaaaaaagataggcttttccttaaaagtattcagatcccagcattctggggggccaaagcgggtggatcacctgaggttgcaagtttgagaccagcctgatcaatatggagaaaccccgtctctactaaaaatacaaaattagccgggcgtggtggcatatgcctgtaatcccagctactcgggaagctgaggcaggagattcacttgaacccaggaggcggaggttgcagtgagctgagatggcaccactgcactccagcctgggagacagagactctgtctctaaaaaaaaaaagtattcagacgaaaacattttaaacacctgctcctagccaaacaaaacttacctagtgaggccaaattagaaacctctataatttaagcacacacttcctcccctttttttaggtagagaacaaaggaaggctgagggcagaacaatccccctcgctctccctttgtgttacaaaactgggctgggattggtggctcacacctgtaatcccagcactttgggaggctgagcccaggagtttgagaacagcctgggcaacatagtgagacccctatctctacaaaaaaaaaaaaaaaaaattagctgagtgtggtggcacatgcttgtagtctcagctactcggaggctgaggtgggaggatcacttgagcccaggagtttgaggctgcagtgaactgtgatcatgccactgcactctagcctgggcaacagagctgagaccctgtctcaaaattaaaaacaaaaaaaaaaacaaaaaaactaattaagggttttgcaaccacccttttcttccagaccagaaaagggaaagctgttttgggtaaccaggaaattatatcctttgttctccattaggtattttgttaatctctgctccatcttagtgaatgtcaccttgaaatgttgtgaataggagactgcctgctgaagggtgctaggaaaggacttgcagtgtgacctgagcataggccttcccttcccaagctcttccccttgctatacaatgaggggttaagctgaagtctgatccctgaggtccctctcagccttgaaattacatgtttattctgcaagaagaccctaaattgagctattacttgaaatgagactgcttgatctttctctctctcctcttgtccttccctggtatgatttaacatgctttctcctttcacagagaaaggactggcttaatttgcaacctggttaatattgtttccagggaaaggatacttgctgggcttgggggagcaatttgaggctgagacatggaaatttaggagaaaaggcgtatatggtttactggtaccagagacagcagagggagatgattttagagttttagaatgtagctgagggttcagtaggatcggtttgctctgagaaagagtgattttattaacctctgtagtatacgagcagctggagtcacaggccaaattctgctagatggaccccatcactttcaaatcctccctcctcccaacttcagttctatccctgcattcttccctggcacagcaaacatatatacaagactcaaagggaaagggagtattaactcttggcattttggatctgaaatgtgggcttttgtttcaagggttattatcattaataaatctaaaacgcagagagatgcagtctctatataacaagaggcaattattctagttaagttgaaataagctctcccagcgccaacagtaaattgcccccaggctataagttgccttcctttgaaaactgagtatactcccacaaaccactctggaatattctacagagagtttctgtcgggaacctctaagcatagtttgcaggctgagaagggcgcttcaaatgtggttggaaatgcggcgatttcttctcatgtcatgaagctatttgttagctggggagagctgtcagctagtgagaatagtttctccagggtacagcgttcaatacccaaatgctggcagccatttgacaatccatggctgtagaactcaaagaattatggaaaattaacatggttctgaggcgtccagacatctgcgaggtagacttacggtgggaaagtcaagccccacaccccctagcatgcagaatcacctgcatttcttcccaatagagaagaggctaggacaaaggtgtccaggagtgggtataactgccagtctggtcaggagatccctagcatgaaaagctagtggctgggtgcagtggctcacgcttgtaatcccaacactttgggaggctgaggcaggtggatcacttgaagtcaggagttcgagaccagcctggccaacaaggtaaaaccccatctctactaaaaatacccaaaaattagctgggcatggtggtgtatgcctgtaatcccagctacttgggaggctgaggcaggagaatcacttgaacctgggaggcagaggttgcagtgagctgacatcacaccattgcactccagcctgggtgacagagtaaggccgtctcaaaaagaaaagaagctagtgatgggcatctgcttcctcagtcactaaggacttgaactatttccctgaagcacacgtgtcaggataatgttttagcatatgttctctgagagcatctcgtgaccaactaagatggcagggtaagaatataaagatcctaggatagctaaatgcctcgtttagtggttttaacatctctgtaatttcaggccactttaagaatctgaaagataaggaccttctggcacataaatgtacatttgcaaacaaacatactcacatcaggtttacagactggggaatttctgtttcttggtttttgtttttgttttttttttttttaacatacatattgctttccctgttctaactgcctgtgagaggtccaggagagcaggcctgtgagtaattgctagttttgggggaaagttgagacagtttacttgtgggcaatatcatttcaggggccagcagaaaaatgtcctcctccatctgtgcaatgattcgtgtcctccctacagcaaacaaactaagagccatagaattttagctggaagagcctttgcgatgatcatcttgtcaactccacccctctcctcaacaccagcccctgcctgcccctttcccaaacaggccacgagaggaaaacatttgcccccaagcttagccagctgtgagctgcaggggctaggtttggatgccaatgctgtgcttttgcagctgagaccaattttctagcttgcaggtgacttgagtattacatatacagcatctcagcctgtctcccaggttagatgactgcttcctggaaagcagttctattccttctccaaagcaaggaacagaactggctggtgagtgctgggcctcatgaccccagctgcctgagcttctttctatcttgaagtcatttgaaaagagacagagccacttcagaaatgtccattgtgacattctttccctttcagtttaattttaaaaccaaaactcctggcatttcttatgtcagcattttacaggttccataagcaaaggaaaatggtatataacataattctatactctggttacctctttaccaatagcgcttaagggggaaaaaatatcccttaatgcttagcctgagcacacacacaggaaattgaatgtctgttacaaagagtttttaacagggcaataagtggccttattagtgatatgctttaaacatttttgcacaggcatctgcactgattggttttccttttcttcttctctgcagacgtttggcgccgatgacgtggtctgcaccagaatttatgtccgagagtgaaggcagctggcttgctcctactttcaggaagggatgcaggctcccctgaggaatatgtcatagttctgagctgccagtggaccgcccttttcccctaccaatattaggtgatcccgttttccccatgacaatgttgtagtgtcccccacccccaccccccaggccttggtgcctcttgtatccctagtgctccatagtttggcatttgcacggtttcgaagtcattaaactggttagacgtgtctcaaccttttcccttttttggtttgcctcttcagtttcaacgtgggagttattgtgtacctactgtccttagcactgtgttggtctgtgcggtactctcagctttggcctgctggcctcggtgtggggctttgagcatacgtcagcagttgcaagctgggctcccgcagactggctggatccagactgcagatccaggtgtgattgcacctcccagtgtggctgttcaattgaattacttggtatcagtagttcccagcaggaaacggcacatttaaaaggggttaacagggaagagctcataatgaagggactgtttatactggcaggatgaatagagccagcaaaggatggggaggcacccaaagacaagcagtggagggattcacccccaggcctgaagatagaagggaaagaggggtcaccagaccatgagagctataacctaggagaggagccactgccaaaaccatggccccagtgtttatggggtcaggggagacttggcttggaacaagggggataaacatcctaatctcccacctttcagtctctacctattttgtccattggccaaatccaataggaatggagagggcagggaagagggtgctgtttacaagggtcaccctcccaggatgtggccagggggagaatggatctgaacatgcgcatggacaacaacccacacagttgctgacttttaaacttgaaaatcagtagatttcacataatctgaatctctatttccttaaatgaaaaactgggaaaatctggcatccccagacctacattcccacagggtaacaactggccaggaagcttcccgctttttaaatggaactcataccctctgcttccccttagaccccatcctggccccagcttcatttacattgcctgcctggcttctgtccttgccatcctaagtgccaagaccagcttggttggggagaccctcacccagcagtgctagaggaattaagacacatacacagaaatatagaggtgtgaagtgggaaatcaggggtctcacagccttcagagctgagaaccccgaacagagatttacccacatatctattaatagcaagccagtcattagcattgtttctatagatattaaattaactaaaagtatcccttatgggaaacgaagggatgggccgaattaaaggaatagattgggctagttaactgcagcaggagcatgtccttaaggcacagatcgctcaccctattgtttgtggcttaagaatgcctttaagcgattttccgccctgggcgggccacgtgttccttgccttattcccataaacccacaaccttacagcatgggcattatggccatcatgaacatgtcacagtgctgcagagattttgtttatggccagttttggggccagtttatggccagattttgggaggcctgttcccaacaccaagcatgcagattctcagcaaagctgggtcagagtgggccatccaacagtgtatgggcaagagtgaggccaggagaccctcaaagagcttacactctggcagggcagacacccaaggcccaggtgctatcacctgagtgtgaatggggacacagtttacctgaggcgtcacccttcccccctcccccagcccagaaccctaggccgaaaggatgaaaacacacacaggatgaaaacctacacaaatctacatttgcttatggaggacctcagccctccactcaaactctacctacctacatgtggaactcacaggggacaaatctattgcagaatagaacacatctcacatcctgagcctgcttgttggggctctatgcactgcctctgctgtgatgcccccccatgaaagtgccagtggctctgccaacagactgcttcccacggtcccaaagccaccaggccccgatgcatcagaatggggctggattctgggtcagagtcaggagaaaacctgacactgggctatcctttgtcctcaggtccctgaggcaccttggattg

SEQ ID NO: 16310 - DNA, 10625 bp, Human
gacccttttataggaatgtgcgactggcaaagtgggcatgtggcattttactgttcatttgccctggacaggctctgaaccagcagatgatgtgcttaccagggcttgacttgcagggaggagccaagtggttggtgtccagaggtcctgggttcaagtcctgttcccactgctcattggctgtgtaggatggggaagacacttgattcttgagcctcagttttccctacctgaaaatgggagactaatatctacctctcagggtgatttggggattaaaataagtaaagcaatccacagagaagattagttcagggcctggcacagagtaagcacttgctaaacgatagctggtgttattatctgtttgagctgggtaagtagtcaggtgccttgctaaggacagtaggcagcaggaccacaagaactggtagaacccaaggaaggttgggtggctgtgctgaatggcttgataaaggtgggcctggggtgtgtcacagggtcaagccacttaaaaggagacctgggctgatctggctttgggggtggcagggccggcccaagcctgggagatacagggtcatacctaatccattcaccagcagcctaggacatcactttaggcaggttacctacctcagcccacagtcaatgccccttacacttgtcccacccatggcagcacttaatggacacaatttttgtttttagaggcagggtctcgctctgttgcccaggctggaatgcagtggggcaatcatagctcactgcagcctccaactcctgggctcaagctcaagtgatcctccagcctcagcctcccaagtagctatgactgagccacgatatccagctaatttttttttcatttttgtagagacagggtcttgctgtgttgcctaggctggtctcaaactctgggcctcaagtggtcctcccacctcagcctcccaaaacactgggtttacaggcataggccaccacatgcagctcacaatgtcatctaaatacaatttgtacctgtcttgggatggggggctattctctgggatgacagggacctggacaagtggacatagggcaaagaaagactgaataatgggcagggggcggggaggaagggagcttccaagtgagacagtgccaggatgccttacacctttgagggtccatgcagcttgttgaggtgggcttgatttcctggaggctgggacaggagctagggacctgacccatcagtgaggagggagggccaggcccaccagggtagcagcctgggtcccgatggcccccagttagagaggttatgggtgacccattcataggggcttcctgagggtgtgaggactgctgagagctctcccagagagacccaaccctcagggcttaagttggggtggtggggccacgaagtgggcccaggctttgatggaccctcaggagtgtaagggggaagagtggctaagagtttctgcttggatttcccatcttgggctcaacccatggcccttgatgctccctagttatgtggccttagacaaatcactcttaacctcttcagccctgtttgctgagcagtaagctggggtcaggatgcatctgtctgcacagtgatgtggaggaggattaaattaggtgatgtgttaagtgcttagcacagtatcctgagcatagaaaacccttatgagagcccaaaggagaaaaaattaaaagatttggacccaggcccaaggagtgatggtggtggtgctgatggggtgggtgtggtggaaatagggaggcctggacacaacctggttatcagcacagaggtctgggcagaactcacctccctcccaacttcacaccctgtgggcagagcagagagcctcccattggccccttacctggtcctggctgaggatgttctgcagaggcagaggcctaggcaggacagcaccgggctgctggggcttagggatggcaccccctccagcgctttttctctgctttcctccaaggctgcattcgcgattctatgagctggcccccaacctcgtcccaatggactacaggaagagccccatcgtccacgtgcccatgagcctcatcatccagatgccagagctccgggtatgtgcaggacctcttgctggcgagcaggggatctgtgcctctggaccagcagcagaggcccccaggtctaggctgaacccagctccaccctttgtgtctgcgtggctctgagcagatcacagaacctctctgtgcctcagtttcctcatctgtactctgaataaataagctatgtgggctctgtaagggtgctgtacatcagtggccacccaactgcaggccatgggcttgtgctcatttgcttgtccctttgttaagtggccccaagcctgctgtagttggcagacctgtgtctgctttgttagataacttttctgtctcccccttgtctggctgtggcttctcactgaggtcagcatggtggtcatccatagcatcatttctcagactttaacgtacctgttaaaatttaattttaaactccccagggatcttgtccaaatgccaattcaggctcagtacatgtggagtagagtcaggattctgcttttcgagcaagctcccaggtgagactgatgctgctgatcctcagaccatatatatctgaatgtttcgtttcatgagttccttatccataatatgtaaagtgcattcagcattaagaaggcatttggggcacaactccccattgcagtgggacttcgtcagtagccccttgccaggcctgggatgtgtggcttgaaggtggagtcagagtgctatatggcatccacttggggcctgcactctggttgtgacctcagtcctgagagacaatgggccccaggctcagccctggaccagcaccccgtctggcccagcaaggggctcaagagcaagctcagagggttgctggagcaggtgagacactcatgggtaggacccaagtggtctgtctctgagcctcccgcactggcctgggctgggcacggaatggcgctagccaagcgctagctcagttgggatggaagggctgcaggatgagtgatttggggatctaggaaggcatccgtgtacagctccctgggagaggcagcatccaaggtggtctaggggagaattcacaggagcagagtgacagcagacctgggcctgaactggctgtatggctcttgctgcttgactggtccagttatctgaccccacatccacctcccacgatcctggcctgacacggcctgagctgagggccaccagtgccctgggctgtcatcttcttctgctggggacagagccctacacatccaggcagagcctctgtgtgcttttctgggtaacaggacgaatctgtgcttctgcttctgcttcagatgaggcagtgcctccagtgataacacactggctgtgctcagcatttttttttttttttttttttggagacatggtcttgctctgtcgcccaggctggagtgcagtgggacgatcatggctcactgaagcctcaaactcctgggctcaagtgattcctccacctcagtctcccaaatagcgggactacaggcgtgcaccactgtccctggctgtgcccatcttaatgatgtgacatgacccagtagaatgcttcctgagctcttacatgtgccgggcctggtaccaacaccttacatactttagctcatttaatcccatcacaacccaattaagaaggtgttattattattccctttttacagatggggaaaccgaggctcagagggatttggtcactcctccagggtcacacaggctgtccacagtctggctccggggccctcctgcttatcctgcacccacagtgattgctgtgtgtgttttcttcaggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatggtaaccagggctagaggagggggcctgaatatgcggggggggaacatgtggggcccttaggctgtctggttactactggctcctgccctagggacaccaagaacagtgaagctgatctgtcctctgaagagtgcctgtccagtggggtggccaagggagacgatcagtccctgagagacatctgtgagggtcctgagaacgaaggagggagggactcacccatcccaggtcgggtggttagtgtgagaggggtcccaggcatgacctttaagcagggactagcagaggcttggactggagaagagggggctggcagacctgacagagggcgcagcccatgcagacacagggaagcgcagagcttgataaggagatgggaggaacttggaaggtggtgggacagggggcggtatgagtctggagagaatctggggccaggctgtgggagccagccacagagtttggacctagtgatccagacaccagggccactgcaaggtttccagtgaggaagggcagctctgttttctagaaggatcactcagcagctttgaggtgtaaaatggaggagccagagaggctgcctaggccatggtggtaaggccaggcctgcaggggggcctctggagcccccccgaatactgcctgaggtagggccacctggattcaccccgcccagctctgccctcaggctggctgtctcaccagccaccagagggcggcgggcactcatgagccaaggactcatgcttctcccacagccacagggagaaaacttcatacccacgagctcaccccctctgctggcctgacagacccatggggactggtgtcaaatcctcagatagacctcagttgagatgcctaaggcctaggaaggggctgggacccaacttggacctgaagagtcaaggtcaaagctcctgtcctcagcacgtttgatcagacactggatcccaaaggcagcagggcctatcaggggctgacattttgctttcttttttcttttcttttctttttttttttttttttgagacagagtcccactgtcgcccaggctggagtgcaatcgtgtgatctcggctcactgcaacctctgcctcccgggttcaagcgattctcttgcctcagcctcccaagttcaaacgattctcctgcctcagcctcctgagtagctgagattacaggtgcccgccactacacctggctaatttttgtaattttagtagagatggggtttcaccatgttggtcaggctggtctcgaactcccgacctcaggtgatctgcctgccttggcctcccaaagtgctgtgattacaggtgtgagccaccacgcccagactgacgtttcactttctagttatcatgtttatttcagaggactttggtttctgtctgtgcacccacgttttgcttgcatattagaaagaaaatacctgccagtctgccctccacaaactatgcccacatggctcatgtaaaaagcttctcagattccacccaacatccgcccggtcttggaccccatagcattgctcctgggacgggctgctgtctgcccaagacaggggcgtgcagatcgcatggaccgggtgggcacaggaatacatggaagaactgtggcttccttgctgctctaggctgggggtggagtggggagaggcagccagggccctcctagtctggcgctggggaggcctggggcctcatttgcaacaatgatcatctcacttctgagcctcagtttactcaggttaaatggccacaggaattcagccagccagccagcaaatctttccagagatttgctatgtcccatgccatgggcagagatgaatactccctgacgcataccctagagttgtgcccaggcctctgcagagatagacagggcagagtcaccccaagagcttgggctctagggtccaacaatgaccgggatgtgacctcaggcaggtacctctccttttcacctccctgtttctttttttatttttgagatagagtctcgctctgtcaccgaggctggagtgcagtggtgcgatctcagctcactgcaagctccgcctcctgggttcacgccattctcctgcttcagcctcctgagtagctgggactacaggcgtccaccaccacgcccggctaatttttttttttttgtatttttagtagagacggggtttcaccgtgttagccaggatggtctcaatctcctggcctcgtgatccacccacctcggactcgcaaagtgctgggattacaggcgtgaaccaccgcgcctggccacctctctgtttcttcatgtgtatagtggagattcaattgtgcctgcctcatagttttgttttgaaaattaaatgagaaagagcatataatgctcacatgatgggtctttgtcactaccattaatgtcagagtttgccaatgggcaacagaagctcatttgcggggaagaggacccttatcgctagaaagccccgccactgggaggtgatgtgtgagccaaaatttgaaggatgaccaggagtttgctgggaagggaccccaggcagaagaaacagcacatgcgcagatctggtagttgggctcaaaatgtaagaagagagagttcactttgatgtggccaggcatggctcggtcctctgaaccattttgctgtgctttggggcagtggtagtgccttttgctgggtagaatcaaaccatgttccctgctctgtgtgcacaaaggccaggcacaggcccctctctaagggtcttttgattttgagtctcctgacccaccgtgtcttctggtcacacaccactgaggcaacggggtgcagtttagaaaacatgggtcttagagtcccataggccccagtcagaatccctgctccatctccgagtggctctcccaccttgattcaatcgcatggcctttttgggccttagtttccttagctctagaagtctaaagggaacactgggtccactgtgggctaaggccaggaagggctatctggcctaagcctgaagttctcaggaaacctcagatttggacttttgacctgcttcaggatgtggtttagtcattgtggggttgttgttggtggtggatgtgggtgtttaagcgatgcctggtgggtaagccctcttgggggcagggatccagtatcccaagagtgtgcatggagatgctctggggacatcagaagctggtggaggtagtggggccagctaggaggaagagctatagtgtaggggtccctgggtgcacgcagcctggacttgaacatgtccaacccctgccctacagacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcaggtgctgccactacaggggccgggcttgggcagggcagagcagggcaggccgggatgttggggctgaggcccctatcactcgctatttgtgagcagtggtgtgcggccaggaagcaggaggtcacgttcaagccacccttgccctagacgtgtgactggcctttgtcccctgcagggggaaggttgaagacctgggggccccttcagtgataagtgggggcagaactccctgggcaccgctgttcctccgtcttcccccagtgttgattacctgcatccactatgcagggttccctaatgaggcactgtccagcatggggctggggcctgctgtgcttttccctgaggagcctttacctgcccgacccagggcctctcaccctctcttgccctttctctctttctagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggtacctttgcttctgatccttgaaatcccaccattggtgtctcacctctcggcattaggcagtgcctcctgctttaggcactaactttgatttcagtgcgtgtgccatcgggaggaaaacacattcatgccccgaaccttccgtgaattccctgacagtatctctggttaacatttgggagtgctaaccactcaggcacagggacagttgcttcagtctcaatccttaaacccccaaggagggagggactcttacaggcctatatttcaggaaaagctgcatagccaagtggtcactaagagtagatttcccacaaatgcaacctgagcccgctctgcccagggtcagggcagggaggaggggcacgtatggtgttctctctggagatgatcagtcctgttttctgcatcccaggcctgggggttgttgggagtggggtagcaagccagctgtccacccttatagagaaggggacatgtggataggaagggaagtgacacacaaaacaggaagtttcctgagggacagagttccaggaagagccagcctgacctgagggtacagctggagcgaagaggcctgaagcagaggatgtggcttctggccctcccctccttttcgctgatggggccgcaaggaggggaactggttttgttctcggtagcaattgcatgatgtcacttggccagttagaaaggtgtctgtgctagcacacagcctgccacacattcggtaagtgctcagtagtgggaggcaggttcagtcagtctgcctgggcctcagcatgcttatctgggaaatgggggtggtgacccctgcctttggccaatctcattcctctccagtccctcctgtgcatggatgggaggcacaaggaaagcaggacatagccaggagctgcaggcacctgcaaggtcctcttccacctgctctcaggcaggcacctcggctgtctcggagcctagttctgtagcaggctggatgagtctcaagatccaaagggtgccttcaagtgagctgaggcctttgcgataacccctggcatggcctgggtaccaggaaacccactggtgggctgccggatgccaggccctcagaatttgtgcttcctgtacgtgaagaagagcctccgaagcttgtcaggctgcaaggaaggaggagatactggggcctggggtcgctggacagggagggaaagacccaggctccgaggacccctcattgaccttgggttgggggcccaagcctaggacatgaggccaggttggaattctgatagttgattccacaagcctctcccagtgcccgaaatcccacctttagctccccaatttcagatgcagggttcaccctcttctggctaaggagagaaggggaagaaggagggtagaaagggtggcgagcctcaccttacctccctggagtgccctggtctcccctgacccacagctgggggcctcaggatgcactggtgtccgaggtagggtggggtgaagctgtacccaggcccacagagatgggagaggacatggggcagccgcagggaaagagcagacatgggatgtggcttctgagggtctccactgccaggtctgtggtccccagagagtgaggatctcaaaggctgctatccatggggtgtgtgggcacagccctgccctgagggaggagccgtcagcacttcccaggaagatctttccaccaggagcccaggcaggaagatccgcgtgtgcctgactgagatcagaggacttgcccatggggaagggactctcaggttttattgtctctgggtataggcagagtgtagttgggaccgagggctccagagagttcatctgcctccctgagaaccctgaaccagccccactcctggccaccgctctccacactcctggtcccctctcttccttacttatcagacccctgcagaaactgagagggaggggaaaggacccc

SEQ ID NO: 16311 - DNA, 15220 bp, Human
ttggtcataacaggaagtctcaaattctcgaccatctataggtaatgtatagacaatgggagaaatagtaggagagctaatatggtgcctccaaacaggccacataactgacacagggtttgccaggactgtttcagatccctcataatggtgttgattttagagaagcaaaattgatacctattagacatccaaatggagaaaccaaataggcaattgaataggagaatctggctcttggaagaaagtttgtgctagagatagaattggaaatctgtcctgtgatttaatgcagtctcctagacgaagagggcaaaggatgacagcagagcctaggatcactcatgactttcagagttgcccgttctgcttataaatgcagggcaggctgggcgcaatggctcactcctgtaatcccagcactatgggagaccgaggtgggtggatcacttgaggtcaggagtttgagaccagcctggccaacatggagaaaccccatcttcaccaaaaatagaaaaaattagctgagtgtggtggcgtgtgcctgtgatcccagctactcagaagactgaggcagcagaatcgcttgaacctgggaggccgaggttgcagtgagccgagatggcaccactgcactccagcctgggagacagtgtgactctgtctcaataaataaagtaattaattaattaattaaaataaaataaacgcagggggaggaggccaaaaaggttttttataacaaactatcatttttaacacctcataaattcccattctattacatttgtaaccaactctcttactcccaactttcccaaacacggtggcttcattccctagtccttttagagtgtcgggagaggaaaaggaggttagtatgacagggtaatgtgtctcaaccactgtcattaatttaataaatattgagtagtgaaaaagtaggaatcacaaagctgcatcagacagggtccctaccctgatctctttcaggaaaggggggagtcagagagggaaaatataaaaacataaatagctatagaatagtaccatgaaagaccaaggccttatttggaagaagtgaggagaagtaaccaaggaagaccttttgcagcagagagcttgtgccagacatttgagggtagaatggaatgtcttaggtaaagatttggagtaaggacatttcgtacagggcagagtgaacaaattctctgatcaccgcaaaaggtaaggcaaactgacaaattgatccctttttaattttgtttttaattaacagaactaaacctaacggaaagaatgtgttgccggagaagaacgaattgatggccttttattaccacaggaaaaagtaaatgtatctgggcagcccctcaagtctcagcaaaaggaacgtacagttcctgccatgtgccggtctcttctgaagaaaagggggcggtgggggtgggggcgcaggtctttaggttgtttattcctttctctctgtccagtggcagagaagcccatacttttgaacgcagcttgttggctactgtaaaagccctgctctgagcaaggaccaatgagcgctcggagcccaaactcttggaaacagtttgtggccaggagtacttgacattgagacagcctccgagttgtaaacaagggcgagcctgggcgggaccccagcccacgcgactcggagccccgtcccaagaggctaatcttaagcccacgttgccccagatacctgtttctgcttcctcttccctgttcttcccaccctttttccgtcacagccgcgggcaccggtgccagggcactccgtggtcaccgtgccaggccattctgtgatgaccgcggccggaggggcggagcccatagttctttctctgatctgattggcgcgacctggagttcaggacgcgtttccaagttccagtgactcctcctgtttgggactcggggggagagtgcggggagacaaataaaacctcgggcggcggcggctggtgggaagacttgaacttgaatctcgaaccactgcatctccgactctgcccagactcttcactccgcggcaccctcaaaccccagcccaggccggggcgcacgagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggtgagaggggacacagggcccaagctgggtcctagggttggggaactgccttaactttcagccttggtagagggagggctaggctcaagctaaaacaactggggttcactttgctgctgagccctggagcctcgacgccagcacacctttccttttcctagatttggttactttctgacaggggtgcctccaggtcaaggccacctgcaagcctgccgacgctggatggtttgacttcatctgcacactcttctttctgacccgctcttccagtcaaaatactttttgctttcggtcaccgtttaacaatggactggaaactttatcctctccttcacagcatagtactgcttggagaagtttctgaatcgtattaaatagcctcaaattaacagattttattccttagccacctggcatccttccacagggtacatctctctgcattcctgacagatttctttgtctctttatcattatagttttccatatatttgcattgttgctgaaaatatttacacatttgttgcagtaatcttataaggaagatttcaagggtttaaatgtgatatcactactctggaaatatcacagctcccactccagcctcttatcccccaactccaattccatgtccccactcattaaaggatgttgtgttgttgacattgtggtgtgaccgaatcctgcagtcttttataaattctaagaactgtgggatattcttacttcttggaagtgaatcctcttcaaaaagagaagacaataattctcctatatctgtcactttttaaaagaaagaaggaaagacgaaaggacgaagggaattagtcaattaaggagacaatcgcccctgaattatcgattaacagtaacccaactgagagtgaaatataattttataatatatgtgtgttcaatatttgatagttaatgctatttagatatatcatttagacacactttttctcaaaactaaattgatttcatttattataggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtaagtggtgaaccatattgaagtctctagttttgaaacagttacccgggtatgaattcttatactatgttaacatcataattggaaaacaggtgatctgaatggtaactacttttgaaagatgtaagaattttaaaattaatttagggtaagttatcattagagaagttataaaactataaacagacatttttaccctgaaaaagtagattactttataataaaattttgagttctaggaaaaatttgaaaaaaattggcatgcaattttaattttcaattatagaagagcactttcaataataaaagagtttgatattgcaaaagaaatcctatgcctagaaaccaattcacatgactgctatttagggaaggcctaatctttgtaacttacaaagtgattgacagagtgggctctgggttcaaatcctgcctctgtcacttctagttgtggaatccttggcaagtgtcttaaactctttatgccattgagttattattcccatctgttattaaagagattaaagtatatgcctcagagggatgtttgagtgtaatgaaatgagataatccataaaaaagaaaaaaaaaaccacttaggacagcacttggcacacagccagcagtcagtaagtgtcagttgttgtcatctcattttataaatgaagatactgatgcttagagaaggtaggtaacccaaaacagcaaatttttgggtcacagaagcaggatatgcacaggtagcagacatgcatgagacccttatcttaatccactgactgcacagccttttgttcattgattcaagaaatacatgtattatatacctataagacaattacaatctaaaacatatattcaatctgtagtatttactattgcagtcaagacttacactcttctatgaatgaatgtagtagaaaaaaaataaaaagctttaaaaaaagttgtttctaagtattattgctagaagaaatgaaaatatttgccaaacaaaacagtcaggaaactgaatactgacctgaaatagttaaagaaacattttgcgttaaattttaagtttgaaagtcaaggattaaaagttatagcattttaaatttatattattttccaaatgttctggaggaaagttttaagtttgaacataatgcttactttctcttttcaaattatttgaaaaagctattctattttcagccatttgtatctgactattaattttaaaacttaaagcatacctgtttctttacaggtatatacagagcctgatggatttggtggaattccatgagaaaagcccagatgaccagaaagcattatcagagtaagctctatgcattagaataagtgtttaaaactttggttctttccagatagattcctaagatatttttagacctaaattaaaggaattcagctctgaataataaatcactaccctcttacacatgacaagttttggcttgttggtttttcagaagcgaagaaatatggcattgaaaatgatgctgagtgtgaagaaatgtagaggactcatttttgatcccccagggagacctatttttactataaatttactccaataatgagatgtgtaggaggatttaccattacataattttaatacatttcagcgtcattggagactaaacattttctttcagagtaactgatagtttctagctacctaaataaggatcttttctaaatctgacaagaaattttgaaagttttttcacaatggcattctagagtcatctctagaatgatgatattagatattaatcattattttataaagagaagacttaatgaatacatctgatgaatgcattggttataaggctaatagttttacatataagctagaaacaaaatgagtctgtttgtgaaattatctcctctactctagtggaagaatctgtagtgagattactaataaaggactaatgttttatcatttgatttgttcagatgggtaatgcaaaaaaaactttagccttctgtgaagtaaccttaggagtataagtgaatgaaacgtatttgaacttttactaaccataaatattgtggcttagctttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacagtaagttagctcatcatgatcatggtatatagacatgggtgtagaatataagccatactataactagatgtctcactaatcagcgggtcacattctcagtgatagtactaatcattatcctgaattttataacaatttttttttgtttttatttttcaacagttcttatatttagtgactcacagacaggaaacccaagccacattggaagcattgatcctaactgtgatgtggtagcagtggtccaaggtatgttctgtatttctgcacttcccttattgaaaatgtacaatatatgattgacatatctataattgaggtgactctgtgaatgaatttatattcacagagtgttccatttattttataaatgttatcttcaaggtcctttgcttttgagagtcagtagtataaacattcctctaaaatattatttaaaaatccaaatataagtgactaacatgccatattttatatgttgtatttagtctctgaagtgcacatattgctaaaactgcaatgcaaacactgtcttaatttttcttcaataaaatattaaaatatatttttatatacataaacctgtaccttagtgaatattttagattagggtaatacagacactgaagattatttgagaactgtacttggcataaactcatttcattgttataaaaaacaacttctattccagatgcctttgagtgttcaaggatgctctgtgatcagtattatttatcatctccagaattaaagcttacacaagtgaatggtaagttataagtaaaatatattttaacctatggaaaattctgtgttctcctaatattattgctttttgtaaatataaagcaacttctgtgttcattttttctcttgcctaaagtttgtacacattttttttgaagacaaggttctctttaactatctcaactggaaggctccaattctgcctattcagttgctaatgaggattcataaagaagaatgttttgaacaaataatatgggattaaagtagcaactatattccaatatcttagatcaaagaaagattacttcctatagaatatgagggataaagagaccagaagtagggaggatatagcagtggaaatatcctcttaaagaggttacccataagacctggagacaaaaatactttaaatttcactataagaaataagccagtgacagatgcatgattccacttatatgagatgtataaaatggtcacactcacagaagcagagtagaatggtagttgtcagaggctgtgaggaaggggaaaatggggagttgctatccaacagataacgaagtttcagttatgcaacatgaataaatcctagagttctgctgttcaacatagtgcttatagttaaggatattgtattgtacacttaacattttgttaaaagggtagatctcatgttaaatgtctccaccccaatacaaaaaaaattgcactattgttttatactactgttttggaagcagaacatacttcaaaaatcttcagctcagctgggttcagtggcatacacctgtaatcccagcattttgagaggctgaggtgggaggtttgcctgagcccaggagttcaagaccagcctgggcaataaagggagacactgtctctacaaaaaataaaaattagccaggcatggtggcacacacgtgtagtcccagctgctcaggaggctgaggtgagatgatcacttgagaccaggaagtcaaggctgcagtgagccatgattgtcccactgcactccagcccaagtgacagagtgagaccctgtctcagacaaacaaacaaacaaacaaaatttcaattctgacaaggtcttcccatactgtctgaatgactgaagtgactacatgatgaacgaaaggcactattttcaccccttcccattctgttctggtaaatagttgcatcttaaaacaaaacagtatacttaaattggaattaccttctcttttctatttaaagtaaacatctttctcaagtaatatttatacaggaacagtttttgtttatggtgacagttaaaatcaagttgctcaaagagtagcctaacagattagggacaagcaaatgtaaataaataccaaaagtagaagagcaaataaagaatggaacgtatctctgagcataaacagggttgttgcataatacttgtagataaactgctccaactgttggacaaaataaagaggggattgtgccagaccttgtgttttctgattcgaactttgccaaggcctggaacgctgaagaataatacttttatttttcttttctttctaattttattttactttttatttttctttccaaaaagcattaagaggtttttgtttgtctgtttcctttatcctcttggtaaaattttagcatatttaacatataagatttaatgtttgggtgatacaaaaaacaagaaaaatcaggtgtgttattttactaaatattaaaaatatgaaaattatagttagcattaatttcaatattatgctataagcacagttttctcccttctgtcttaaaatacatataattttgactctgaaattgtgcagtacaaaaatgttgaaaatagaaataatccacaaaatctaatttatagcactgttcttccacacttacccaacttcacacatttgtggagaaatacaaaaattaatcatatggagcaaggtggttcatgcctatcatcccagcagtttgggaggctaaggctggaggatcgcttgaggccaggagtttaagactagcctggacaacatagtaagaccctatctctacaaaaaaaaaacaattaacaaaagagcattatgtagcaactacaacaacattttgaatataagccagtaatatttactgtttaagtggtaagtttctagggcaggatttggggatggggaaggtagagaatatgccaaccctcttgaagtctaaaatgttaatcacatgaatgtggtggtttattttagtgaagtatttgtttacaaattcttaatgaattttatttttctaggaaaatttccagaccaaccaattcacatcgtgtatgttccttctcacctccatcatatgctctttgaactatttaaggtatgatacttcacaataattgaaattttaccttttaaaaaggtttaacagttatatttttatctcctttattattcgccacaaaacagaagcctcaatatcttttcccaagaatgcttctagtcctcctaagagaaagaaactatacagtcaatgtttgacaaagtacatgtagctcattgtagcatcaacacatatttgagaatgcatcatataattcatgatgtatcaatgctttacagccaagaggaagttcttattattttttcaggtgcccattaaagaactagtcatttattcattcattaagagaggtcatggggtgaatgtttcagtgaatgaggccttgttacctccacccccacaggctggtcctactcctaactcagcagttcaggtccagaattcctgtaggtggtatggctccattcagagtccagaatgtgctaagagcacagtcagtagttccttcaatcatctactttaaagtgcatatgaatcacctggggacttggttaaagtgaaaattttgattcaggaagtctagagtggggcctgagattctcaattttgaataagctaaggggtgatgctgctggtccacaatgcacactttgcctagcaggcctgtagagttgtgcttctcaaactgtaatatgcattagaatcgcctgcagggcatgttaaaacacagattcttgggctctaccccagagattttgattcttcaggtctgagaatgtgcatttctaacaagctctcaaaggatacagatgttactggtctgaggcagccaggtgctaagaatcaaatcctttcatgcgtcctaagattaagttaaattaagatcaaattgaacttaaaccaaaaaatagaaaaacaccttaagctttttgatgcttcccaggagtcccctgaattggagagaaggaagcctaaaaaagacaaatctgcctctaattctgacataactctttccagaacttcctgtttcctaacttattctaatgttactgctgtgaggtactgactgtactacaaacatctgatctactttatttcactccagctaatgactagaacttaatattatttaaaaaccagaaagcagaaagtagacaggtggtgagaaaggaaaatgggttaagaaaaccaagactgtatctgtatgagattcagccaatagacggaaaacatcttttagtttgttctgtgttaaaggacaaaggatactttttcattgatttgatttatttttaagttgaatgatacaactcatagagttattctgccatcattggtaaaagttagatgataatcaaatgcaaattgaaattcaatttagaattattgactgtccttttaaatagtaacaaccttttcacagcaagttttatgaaagccaataaattggttcaatgatttcactgttcatttgttatatagtagtctttggtgcttggatgtaaaacgtaatagaaagatagaaaagggagagctaggaaatggactataaaaaccaatttctacatttaaattaagcttacaaataagaacttgacagctagcagaattggtttccattagacattactcccaggagctatattacatagtaaatgaatatttttcattatacatcctacatgacccattcataaatggctatttacaaagctgttttactactaacttaaaaaaataggaactttgaattaccctctgtgctacttttattttaaacataaaaaaaaaaacatttattgtccctcattcctctgccattgaattccttatggtttgctttgttttagaatgcaatgcgggcaacagttgaacaccaggaaaatcagccttcccttacaccaatagaggttattgttgtcttgggaaaagaagaccttaccattaaggtaaccattctctgttttccttttgggtgtctcttgagagaattaaatagggtcaatagtaataaagctgtctgctttttgcaatagataacagtcatatatgccaggtgatttttaaatgaaggaaagccatttttatttagacaaatgcacattgtttttaatgtgtggctttgatgacttgtttgtttgttttagatttcagacagaggaggtggtgttcccctgagaattattgaccgcctctttagttatacatactccactgcaccaacgcctgtgatggataattcccggaatgctcctttggtaagaacaattatatggctaaattaatctcagccacctagttctaaatgtagagcaaggattgcaagggattatttagacaagttcatcaattaagtaaaattagacatgaaggatataagaatgaatgataaagcaagctaaaaatggtgaaacaagggatgtctgattggaagtagaagatatttatttaggttctaggacattagtatcagtgaggacagtaatttcctgcttgtttgtatttcagtgatcacatacacttctttacctgataacgtctctcttctctaggctggttttggttacggcttgccaatttctcgtctgtatgccaagtactttcaaggagatctgaatctctactctttatcaggatatggaacagatgctatcatctacttaaaggtatcccttgaattcaatagcaaaatcctgtttctaaaaccattgctccttttatagccttgagtgctatggtctggagtgaattccccaaactgagttaatgcaaataatgactacaggtcattcattctcttctctttctgggtgtgtgtacattatttaatatgataacttaccaaagaggaagctgggccatactacctgcctcaagtgaagcaaaattgtttcctaagaaggttaatacattaccaaagtttcagaatgaggacatgttcatgtgaattttttaaggcaactccttttggcatctatgagagtagctgtgcttttattttacttagatttgtgggaaatatatgctaataatgttccagcctgaaaaaataacaggtatcaagatactcaagtccttaagctgaccttgttagaaatcctgggaaaggaaagctgactgttccaaagctgtcagtggggtgccagacattcactgtttgaacttaaaaacttggtgcatgttggctgggcacagtggctcacgcttgtaatcccagcactttgggaggccgaggcaggtggatcacaagttcagtggttctagaccagcctggccaacacagtgaaaccccgtctctactaaaaatacaaaaattagctgggtgtggtggcgggtgcctgtaaccccagctactcgggaggctgaggcaagagaatcgcttgaacccgggaggcagaggttgcagtgagccgagatcgtgcccctgcactccagcttgggcaacagagctagactccgtctcaaaaaaaaaaaaaaaaaaaaaaaccttggtgcatattttcctgtttctggtaaagcctcaatttctttgttaagatcactgtcttgattctgttcatttgccgactatttcaactgaaaatatagatattagcaactaaaacattaaactttaaggctcccattttttgcactggaattacttgccaaatggccttttcaccatctgaaatagttaatgtattcacttcttaaatgagcaaaagtcttcaaactattaagaaagagccatagactgagtgcaggcaccagtgtgctcttattactgtgtcaattaaatgaatgtatttgaatgtttggatacttacctctgaatgtattttgagtaataacttcaagtgcaaattatgccatgcataatttctttggtctcatgtttttccccccttttcttttaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaatgatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtatttttgggagagttaaggtataatttgaaggttggcagaccagttgtgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaatttattaatgtatacattgtgtttttgtctttatgctatgtacagagaaatgtgataattttttataataaatattttttatgatgataaaagacattatgttttaaagttcttttctcaatttacctcaaggtactaagaatttgagttacaataacacagtacaatggtgtttgcctacaaatttgtattcaataatcatttttgcaatgcatatgtttctgcatatttctggaaatttaaagtttcattttatgtctgtgtttgcatacaaacagtggagtaccaaaa

SEQ ID NO: 16312 - DNA, 25122 bp, Human
aatatacattattagagggactgacttcctcataaagtattaaaaagatatcatcaaggaaacaaaacacacacacttagagactttaagcgttgacaaggagaatatgaaatatttaaaaatataagttccttagttaataatagctaacatgtattgatcacttattatgtgccaggcattgaactatgcacattatatacataatctcctttaatcttaactgtgactgcgaataaccaaaatgtattacagagaaattaagtaatttgtctaaactcccctttagaaggaactgagcctagatttataatacaaactggtctgcaaatatgtattcttaatatcattttccaaaattattccccgtgccacgacccttgaaatgcaaagttgctcattgtgccatgtgccatgacatttatggccgtaccaccctgaacatgccccatctcatccgaaataagaagttatttaagtttcagcattctggatttcacaaaccagtacaatggaagaaagggcaggggtggtggaacttgacgtaagattgttgatttttaaatcaacaatctctctttaaattgaatatagttttagggggaaaaaatcaccatattgctgttgatttttttcttttgctaaggattgatacaaacttcatcatatatcaaatgaaataaataataggtccaggaactaaaatttgggttttctgattccttggcaaaatctttttttttttaccttctttaaaaaattattttaattgacaaataaaaattgcctatatttgggagcacatgttttaaaatacaaatacattgtataatgactaaatcacactaaataagatatgcattacctgacataatttttttggtagtgagataccattattttcagtaatctatataaatcaaatagtataagagatacattttttaaaaatttcatctaattgtagttcttggccaagtttgttctacatttagttattcaattttctgtattcccaaacactctgttcatttctcactaatattaagatgcagattcaagtggattactgtgtttcattgtgatttatctgtttacatgtctctgagcagcatataagctccttgaagaaagggaccttgtctatacatgtttgatgcacagctcctggtaagcggtatgaccttacattgttgaataaaggaatggcatttatagatataatctggaacatgtatcaacatttacaataatactcaatttgtgtacgtatattccataatattcatccatatacatccatatattatatatagagttccatgaagttcactactgtattcaaaatgatattcaaatgctattcaaacaattctaaatgatatattttgaacaccataaaatgttacacaaatccataaatagcattactgtataataacctgtaaaccagagttactacacacacatacacaccacacaaattctatttaaaaagctattttaccacaaagtaattctaagaccttataaacactgcctaatggaaaagtctggagattggagccaggcaaaaaaatctgcatttcggttgtctagaactacctgagtgacttcggctgcttcctaccgaacctgaattttctgtgatgtggagacatttaataccacctttagggaactggcttaaggactggaggtaataacgtatgtgaagggctgatgaatgtttgcagtcacactgtagtctctctagagttccttcctcggttgcaaactaagggtttttttgtttgtttgttttacacattatgagtctcttatagtcaggaaaactacacggatctcaactttggcaattcagagagtccgaataacaaggtagagaccaaaaaaaaaaaaaaaaaaaaaatcacctctacaactcggaaaaagcgctaaccccgcaggaagcgctgggccgacctccagtatcccagcattcctcgcgctgctcccgtattctttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaaggtaaccgctgggccccggtttctgtgtcgcgcgaacggtgactcaggcctccgtgtggaggtagcttgggcgctcgggcccagctgggggcaccggcgggaagtttggactcccagggccggcactcgaggcgctaacgctcacccctcagtggcgccccagattcgggtttggggtgttgcgctgggactcactggtgaggcccaatggcttcggcttcctcactgggaggagccaccgtgagtctggacccatagccccgcgtctgtgatggttggtccatttactgttcacctgggttactcaccacttaaacttagttcaagtctacataacctccttttctttttgttttagcagtctttctttgtctttaaacctttccagaattgaattgtctgtagttacgccaatgctgcttaacttttaggatgttacaaatgaagcctcattaagtaggataggagggtaagatacggggtgcttaatacacattattgcctcattcctgttcctcaccattttgatcacttaactgtgacctaacttaatgctttataagaccctaaaacttgccgggtgtggtggctcacgcctgtaatcgcagcagtttgggaggaagaggcaggaggatcacataaggtcaggagttcaagaccagcctgggcaacatagcgagaccctgtccctacaaaaataaaatatttttttaaaagaacctaaaccttacacattttttttttagcttcaaaactaaagacctggttttttcattgtagataatagcaaattgctaacatttattgagtggctgttgttttcaggaacttgtctaagtgctttacttgtaatagcatattccactttcataaatataagaagtaggcctcagtattgccattcttcagataaactgaagctcggaatggttaagaaaccttctgatgtctcataactagttagaaataatagaactggaactgggaaacctggcctgattgacaccaaagctcttaacttcagctgtactgcttctgtttgtgagattgctgttgccagttaggttttcaaaataggctgctttattggctgatggttgatgagtaggatttgtaaatatttaccttataagaaaaggagattactttctgaaggtggtagaaagagaattgtggttaatggggtacacatcctgttgcatcaagcaattactacttcactaaaattgtcccaagttgtataccctatgatgatcctattgtgcataaaaccacatagctggaacatttgttctatttataatgtactgttactttgtttagtggaagagaacattagtgtacatgctacagaaactggtaaactaacccaaagcacatttcttttcagttctggaattaattatgtgttgtaggcattcttagttttttgttttggtaatggatttatctattcagtcatgttttctttagctcgctttcaagttgcttcataatccgccaacatagagctgtgtcgtagaaagctggcctattgaaggtaggatctacttcttactcaaacttaatacttcaaatagcattcttcattatcatatacagggtggaatgttaggcactttatttgcattacataatctaattatcactatcaccttgagaatatggaggcttagagacaaaaagaaaaacaaacaaacaaaacttgccattatgtccaagccaggatctgaaaggtctaactccctgatccaaactttatctgtaacatttagcaaagtgcctgatacatagtaggtggtcaataaatgcatgttgaatgaatgatgaatgaacccgcatttaaaatgagtagttagttgataattgactgcttaaaaacgatctagagataactatgtacctgatggtacacttgatttttttcagcaactttcatcagcttttgcgagtgtagtttgtgcttgttctaagtttatatgtgagcagcaatttttcaaagtgtcagtagttatatagtaaaacaaaacaaaaaggtaaaaggaaaagcaaaaaaaaattattctttctaaggacaaaagactcacaacagacttgtttattaacattaagtaattgaccatttatgggtctccttacagaatgtttgttgtcttcaggtataaatgtgtagaattaattcattcaggaaactttccattttagagtgagaaacatttttaatgcctttattttgttcaagtttctcttctctggtttatgatttggagaggtttttcttaatttgaatttgtgagaaaatcatcccacaaggtgaaaccactcaatatttactcatgaaagttgttctgatgagtaacaaaagcaaaagaaaaacacttcagaaaatatcaccaaagaattatttcttttctgagaatctacatttccgacatgttttggtctagtcaaggtttagagtctgttactattcaaaatgtgatccatgaaacagcagacttggcattgcctgggagcctgttaaaattgcagcatctcatcattcctcaaacctagacctacttaatcagtgtgggctttaccaggattcctaagagagatgtttgaaaaaacattaaagtttgaaaagtattactttaaaacagtgacctattttcaatcttttggtatttgagttttcacttcaagtattaatgccctgatttactttcaagttctttgtgtactttggaaaattatttttcttgtaagtatgccattgacaaattcactaacagatacaaattaaaattggtgttgttaaggcagcctatgaacatctctgcagtctataacagatcttactttcaaacgctttgttgagtgtcagtgctccagaaagtggattttatccactctcgggtaacttggagtatagaggttgccacatgaaagtcgttactggtggttcgactaatagattttcttttgggagtgggtctttcttttgggagtggcgttgctacatcccatcttgcataagaatatgtttggtaggatgttcatttaatcattttaaggaaagggaatttttattgtttcttctctctctcttttttttttttttttttttgtttgtttgtttgagatggagtttcactcttgttgcccaggctggagtgcagtggcgcgatctcggctgactgcaacctccacctcctgggttcaagcgattctcctgcctcagcctcccgtgtagctgggattacaggcatgtgccaccatgcccggctaattttgtatttttggtagagacagggtttctccatgttggtcaagctggtcttgaactcccgacctcaggtgatccacccgcctctgcctcccaaagtgctgggattacaggtgtgaggcaccatgtcagcatagtttcttctcaatagcccttcaatgtaaagtgcaacatctggaaggagtctctgaaggtacaaatgctgcttttattttttcccccattctatagcctgtgaattggtgctacattggcatttcctcacaattattctaattggtgggtgtgtaatcttctggtcattaagcaggagctgtaaaaaatcatatttaggatctttgtgatatacagcctccaacttcttgactacttaaactgatttagaacagcctttattaggaagacattcaaggtcctgggtgtgattgattttgatatgattttggaagctttgaaatggttagaattctaggaccggagggcaacttaaaagtctagagaagatttcatttttcaaatcatacggtcaggttggtggtgatagagtcaaaaactgaagtagtctataatttatttaaaactttttttttttttttgagacagagtctcgctctgtcacccaggctggagtgcagtggcgcaatctcggctcactgcaagctccacctcctgggttcacaccattctcctgcctcagcctccctagtagctgggattacaggtgcccgtcaccacgcccggctaattttttttgtagagatggggtttcatggtgttagccaggatggtctcgatctcctgacctggtgatccgcccgcctcggcctcccaaagtgctgggattacaggcatgagccaccgcgcccagcctaatttatttaaaacgttgactacttttccatatcaaattattgaaagagttttaaaaaatatttttattagtttctctgacaattagatgtggattcgagtaaaagagggaagagaacaagtgctcctttagattcttttattctcttcctgtgccagaattgaaagggttttttttttttttttgagagagaagcttttttagaatatttagaatgaaattgagtttgcctgcagcagcgatagcgtttacaagagtgatattatactaagtattctatactttttctgtattaggtgaaatttctatatagtctgaagaaatcaggagcagaatactacccaccttcccaccctctggcccctggagaaatttctggataagacagtgttatgatgggaatctgtctgttgaggcagacaacagactggtgatcccctaatgctgccagcattctggaataaatgaggcattatcacctgtgccttaaaaagtatgacatcttacagtggttcttaaccaagggagtgtttttggatgtcacactgacttgacaggtaggagtgtagaaaaactgccagcgtttagtgggtagaggtcaaggattttatatttgtgcctgcacgaggaagaactgccctgtgaaaaatgctattgagaaatatttatgtgaacagcatataccaacaggactaaacattcaataggaggattccttagaatcttaaatgtagaagatagatgtgaccagtattgataatgtcacacaccatgctagtcagtttacctagtgccaaaaagggcttttgctgtttttgcattattaaatgtaatatagtggacataaccattaaacatttgaattagttacatggtggtagcaagaaatggagaactcatgttactaaaaatttttaagaaaaaatgtgtaatctgtataatgattcgaagagtacctgttgaatgtccatttttgataattgtgtgcaagaagaaagtttttgaaccccaggatagaataagcatgatgaatctaggattaggcctaggttcaaatctaccattcataaactttcagctagtcacctcatgctagttacttaacttcctctttaaaatatttttgtagtatattatataggataattgtataagtaaccgcttatggtaaaaatttaaacttaatgagagtataaattaaaaagtaaaaacacagtttccctctacaattccccaaaaaagttatttatgtcccagtgataaccaacgttaaatgtttttttctttagtatccttccagaatgtatttataaattgtacttgtttgtatgtatcctttaaatacatacacagaagacatacgatatatactatttcctcctacttgatttttattatttaatgtatctcaggtacatttttgcatcaatataaaaatctacctcatgccctcattgtgttcatcttaaatagtctatttaactagtcccttcttgatagatattagggttttttctttggttcttttatgtatgtgtgtgtgtgtgtgtgtgtgtgtgtgtgtgtgtgtgtttttaagagacaaggtcttgctctggtgctctgtcacccaggctggagtacagtggcgctgtcacagattattacggccttgaactcctgggattgagtgatcctctgtctcagcctccctatcagcctccctagtagctgggagtacaggcatgtgccatctcacctaatttgttctttcaaattttttgtggagatttggtctcgttatgttgcccaggctggtactgaactaatggcctcagcagtcttcccatcagtcttcccaggtgctgggattacaggtgagccactgcacctggcctttaaaagaaaaaaaaaaatggaatatgctgcagtgaataaccttatagctttagggtttttgttgcttgggttttgttgttttttttctgttacagataatgaatatgtttacatctttttctgtgtgtgctaatctataagataaactcctagagaagaattgccaaattgaattggcagactcattttttataatataatttttattttgaaataatctcaaacttacagaatagttgaaagtacagtacaaacatttttctctaaaccatttgtgaataagttgccaacctgatggccatcactcctgagtattttaatgtgtatttcctacaaggacatagtcacaagacaaccatcaaaatcaggaaattaacgcactgatgcattactataggttgagcatcccaaatctgaaatcctccggaatctcaaactttctgagtaccaacatgaaatttcagattaggggatttgggatgcccagttgtaaatatataatgcaagtatttcaaaattcaaaaaaatacaaaatttgaaacacttctggtctcaagcattttgaataagggatactcaacctgtatgatctaacccacagatcactttcagctttctcccattgtctcaataatgtcttactatagagtcctggattacattatcttgtcctgtctctttagtcttccttagtctagagcatttcctgtttgtctttaactttaatgattttcacactttagaagactacaggccagatattttgtagaatgttcctcacctgtgcctatttcctcatgatagaagttctacattgtagtcctggtgctctgttctaatgacatctttttaggtggaacattattctcatttgttccattactggggatgttcacttcaatcactattaaggtggtgtttgttaggcctttccattgttaggttactaattttcccttcctaataggcagttttgggggagggactttgaaactatgtaaatacagtattccagtgatcatcaaacttgtaacttgttcatcttttaaaaaatgtatagcagtgtggactagtggattctgactcagtaggttataatttgtaactattatttggattctcagattgtcccatatttgaacatgcagaactccttcaggctgtcttctgtgtccttttgccatgtctccattattctttgtgcatttcctagcattctggcacaaggtgtattccaaactaattttatacgtgaaatcagccgttgctccaatgtgatttctttttagtggagaatggtatttagaatgcagggtcttcactttgcttatgtttattgcatttgggatattcctgctcccagaccctctaagtggaaggaactagggatgtacaggagtgtgtgtgtgtgtgtatgtataaaaccatgggttcacacagatgtctccaattgcagttcaacaccactggattcattctagttttttccctttctacatttgttattcccttctccaatagtgagaaacctggcttccattatcttcaatgtattgtctatttggtcatcccccttcctaaccaatctttgctgcccccaacaggtgcccttcttgcccgacttgggctccacattttatgccaggccaccctcccatcctctagtgtgggtgacttcgttctgtccaggctctgacacaccagccacaccatgctgcccctctccaggaatgccctccttgctctacttgggcttagacacctcatcttagacctggcatatcttaaattttgacagatactctcaaattgcctttgagaagggttatgccaatttatgttttcatctacagttcaccttttccctcataagcttgctacactagatagtaaacatgttagtcattactgacctcatgaatgaaaaataaaattgtatcattttgatttggattgatttttttaagtaagattaaccattatgtttttctctgagctgttaccatcttaatcctcaatttcattatctgtaatatatggctaataatatttattagagtcatgaaagaattacattattgtaatggttggcctgggctaccataacaaaatagcatagactgggtggcttaaacatcagagatttattttctcacccattctggaggctgtggagtccaagattaaagtgtaggtcgatacagttcttggtgaggccactcttcctgccttgcacaaggctgcctttgtgctgtgttctcttgtggcagaatgaaagagtgcatgctctctggtgtctcttaaggcactaatcccatcatgggagccctacccgcaagacctcattcaatcctgattacctcccgaataccatcatattgaggatgagggcttcaacataagaattttttggggggttttggggggccagggtacaaagatttagtccagaacaatgatacatatgtaaacagagtctggcacaaagttggtattcagtaaacattagtctccttttttctctcccctctaatgtacttaggagtttggattttggatgatgtttaatatttatttagaatttgagctgtgtctgacatgtatttagtaattttgaatatattcaaaattaagcttgttaaatttgtgaattatttgataattgatttagtttgcagtattagaaacttgtaaatttaaaaaaattgccattaaatgtttttccacaagtacttaataatgtggttattcatagaaagacacataaaatagtaacatacattatttaggggtatatacagattggaatgaaaaacccccaaatcaagatgctggtgcttgggaagggatagtgagaggtgtgaaccaggatattaaacactgaaaaactctttgaaaaactatttggttagctatttcattggttctatggaatgagcaagcagtaagcaattgtggtttaagtagtgtttaatgttactacttgtttgttaaacattactcattgaaagatgtgatgaactgcgaaaacattgagaggaaaataagtttcaaaaactgtatacagttgaccctttaacaacatggtttgaagtgtgagggtccatttatacacagatttttttcaactaaatgggaaaaggaagtacgatattcacaggatatggaacccacctgtagagagggctgactaccacttggctaaccatgggacctgaatatacatagatttgggtatacttgggctgtcctggaacaagtaccccgagtataccgagggatgagtgtactcttcttcataagtatttaaaatttaccaaatatccttaatcctttgtctggttgtgtactctggtgtacatgtaatgtttggtggaaattgtattgtttatattctaggacatgtttctctactcacctctctcatcccacaaattgcctttccagtgattagcatgtaataaaggatttattcatttgacatgtatttgttgagtgtttcctataaatctggtactgaaaagtacagagagaatggtattagctgccatttatcagtactaagtgctttacatacacagtgtcattgagtcttcatagctctttgaggtataagttttatacctagggatcagaaaaatttaatttacccaaggtcacagttaattagaggctgtcttgaagcaaatttgacttctatagatatttgtctttgaacttagtaagtagtagttgtcaagggagagaagaatcagtggttttaacaccaagctagagtgctttagtattttggaagtgtttatcctggggtgggactcaaagcccttttctccctaccaccaattaaaccatagcaacattgcctttgtttctcttacctgttgggcttctgagtaagatgtaatttggtttccttcaactgatagtaaagtgcaacagcagttcaaaagaaacagattacttccagttatgtacagtgcgaggtagcaacctttgaacagggctttcaaaagaaacgtaggaaaggggttttcaaaagaagggaaaaggtgtaggtgctttgaagtgaaaaataaatgtgtatgtatattgtatttgcttatgaaatagtagttgcaaatgcaggtggtttgcggcctcagcatggaaagctttaagcctctgaccagtttggacttaatccttaattaactagatgagaagtggtttttaaaatgttttgtttgttttgcttatgacagtgatatgtgtaagtttcctttaggcaatatgctgaaacattaacccagcagaattaatttgaaaagatagaaagactagagtcagggaggttaattagcagattgtcgaaataactcaggtgaggactaagggcgaaataaattattattagaaatgaagtgaagagaatgatgccacaacagtaagggaggtagaagtgatgaagcattagcaactagtttgatatggggtgttgagaataagaagaaatctggggttgtgattttgctcatgcgtgtcttaagaatatgcatggtgaagttgagattggatacccttgactcagtaatttgaagggtagatcagaatgagggtaccaagatgagatgaatctagggcataagggcttggaaaagatgagagtaatggtttttgtaaattttatggaattaaaattaaagccacaaatctaccaggttcaggaagcgaaagaaaaaacaaatacatttttaaaaatttatgctggagaggatgtggagaagtaggaacgcttttacactgttggtgggagtgtaaattagttcaaccattgtggaagacaatgtggtgattccgcaaggatctagaactagaaataaccatttgacccagcaatcccattactgggttatacccaaaggattataaatcattctactataaagacgcatgcacatgaatgtttattgaagcactattcacaatagcaaagacttggaaccgatcccaatggccatcagtgacggactggttaaagaaaaggtggcacgtatacgctgtgcaatactatacagccataaaaaaggatgggttcttgtcctttttagggacatggatgaagctggaaaccatcattgtcaacaaactaacacaagaacagaaaacctaacaccgcatgttctcactcataagtggaagttgaacaatgagaacacatagtagacacaggaaggggaacatcacacacctgggcctgtcggggtgggaagcaaggggagggatggcattaggagaaatacttaattcgtgtgggacttaaaacctaggtgatgggttgatgggtgcagcaaaccactgtggcacatgtattcctatgtaacggacctgtacattctgcacatctatcccagaacttaaagtaaaaaaaatcccaaatcaacaaagagaaccaacaaagtggaaccattctgccagacttatattttttttaattgttgatgaaaataattgggtttggatttcctttttaaaaaatgtaagaatagttatgaatgattatgaagttattttgatcctttgtttcagactctgccacaactgaaagctcaccaacagcctgccaataaaaacattgtttatgacttgctttttgtttgaagttctccactaacagttttggtccttgttagagaaaatatagtagcaaagtggtgccgtgctacgtattgatttcttagtcactgactagacattagatctgcagggtatacgggtgtttgcattatgataacctacagaagtgaaattttcaaaaaaaataatttgtttcatacaccctcagcaggaacacttgtaaatttatctcagaatcactggatatggtgtggcttcattatcatactcatgagtatagtgatgctgtttgtaagtattgctcttctcttttacacacacctaagatggtgaatgttcaatttagtatttttcttttcatgtaatgttctgtatatacttgcatgttttgtatttgaagaaacttggttggagattaggttgtttatgttcagaatacctttatttttatggaataagaattcgatactcttgaaaattggtgtagaatagaacatttgcaaccctatttagtatgagtgggatttcctttttacttttctcaaaaatgctatatttcatgcctttcagaaatttggaaatgtatgttgcagagtaggggaaagtaagtattaaaagaattttctaagttgaaagaagattctttttgtacttaaatgtcaaggtgatacttaggtgaagtatgtcttagatcttggatagctcagattttttaaatttaaagctagtcacagatgtaattctcaactagccaaagtgaagaaagcccaatttgggacaacgtctaaaataagaattgctagaaacttatgtattaggcatctgttactggttatttccaattctgactttttaaaatgtagggtttttttttttttttaaaccagtacacatctggaggcatacacattgaagcaaatacagctgtggttatttacatgattaatcacaattctggcaatgcatttagtgtttaaggtaaagtgtatgctttataaggccatctacatattgaaggatggcattagacatgaggtatatcagatatcatgggtatcattgtttggttatattttgtccttttcaaaactatttctggagttaaccctttaaaactgagtgattaaaattgcttggttgtcagtgtagtgttagagttgaaaattaaaacacaattcagagatccaagaagatgtcagctaaacccagagattacaatagttacagctttttcatgttatacattgagtagagtttgtatgtattgtaacttacatatattgtaacatgtatgtatagtatagagaatttgtaagtgttggacatactattttggggcattataccctatcacataagctttttatgtaatatagttaagtacataatccaggttaatacactgtttaaaatatccatccaaaatagattctggtttgtcagtgttagcactatttttcttaacagtgctcatattaattttaactgcttaataagttgtaatagaaaggttatttctcagattcctcatctatgataattggaagggtggtatgctattacgtagacattagtgcttcttactgcttaagataatggtattaaggctacaaagtttatctagatttatcagataattaacgaagaatttggccagctctttcgtctttgtttactcagtagtgtcataactatgaagtactgtatagtaatacgaaagaactatagaggtattgttatgaatcttttttatatgttctacctaaaatgttgctcacagtattctttttccccctcttcatgagccagttcctttttcctgggactttatctctactttttcctttcctttcccagccattaaaatagggtgagatggttattagacgagggagagatgctttatctttgttgtaaatgatcatcagagtttaactttataaactaaaaaaattgtaccattcttaaatatttttcccctctctaagttaaaagaagtaaagtcaacttgaagacatcacttaataactattgaaataacattttgaatcaaatcataattagatgaaaaattttgtttcttaaaagatagttgctttaaaagataaggctctacagtatttttcaaagacttacaaggttagcagaaaagtgtaaaatattattttatatttctggcttgaatcttttgacacatgattatttcctttttagggaccaatgcagatggaagcgacctacttaacagtttaggaagctggttatttggaagtggttcaagctgagtagaatctgcttgttgtcttagaaccttgaaacagttctgttgtgattttgagttatgtcaccccctttactcaagaacatagtatctagtctttatttaaattatttttttgtaacataaaactccattagacatctttataaagactccttaaaataactatcaaatagataatttctatttccaggctcaacccacatagcatatttaaagcttgagatttgaggttagagaatagtggtaatacgtacgtactttctcaccattctaaacaaaagctgaaatctcaatctaaacctcccctctaccactaccaaagggaggaagaaaatctagaaaactaaaaactacaatattcttctttatgcatatttatgtttattcttcctttaaaaatataaattttgtatcagttgtattaggcagatactagtggtggcttacagtttggtctacttttaaatatttgtatataagttatccttacgttttgcagttttgaatttcacactggtatcttcctgccattcaacttgctttagggttgttggtgttgtgttttgaaagattgtgaagtcgaccttctaaaaatgagttcaaagaaaaatcagtaaagtaaatatcctcctgaaattgtaagtttcttggcaagtagaattttttgtattaacttctgttttaggttatctgcaaactcaagaattgagagaactagacagcataagctcagatttaaggaagataccatttttcatagatatggttttagctgtttttgaattgtgagtgttcagtagcaagcttttcaaagtttttgtaattgtggaaataatgtatgagaaatatttagacagcatctgtttctatttttagactgggctggcttagatgaagatgaagatgcacatgtctgggaggataattgggatgatgacaatgtagaggatgacttctctaatcagttacggtaagttttaagccagatttttattgtagttcagtattaattataagcatggaatatgtaatttacatagatgattaacctcttaaaagctacttaatctttgaaataggtttttgaactgtgtaaagtaagacatattgtcttcatctcctgtgattctaaacatgaacactttgtgtaattgcatacaacttttattctttctggtctttttacaaaggtagtaaaatagaagcatatttgctatttcttatccttaggaatttaattctgtcaatgttaattttctaccaatatcaaataactcagcagaaattagaatcatagagtgctgggacctaatagattggtgattctcaaactggaatggagattggggttgtgagaatgtactgtgtcatattcatgtataaatctacctgatttcatttatttattgaggtaaaattcatgtaacataaaattaagcatttgaaagtgtacagttcagtggcttctagtacatcctcaatattgtgcaaccatcatctctatttagttccagtattttcagcatcccaaaaggaaacacagtacttgttaagcagtcattccacgttctttcttgccctaatccctggccgctgctgatctgctttctatctctaagtatttgcctgttttggaagcttcatataaatgaaatcatacaatattgtgaccttgcgtgcgtaccttttttcacttagcataatgttttcaaggttcattcatgttgtaccatgcatcagtacttcattcctttttatggctgaataatattcatatacatgttccatattgtatattccaatttataataatactatatggatatgccacgttttatacattcatcagttgatggacattcagactgtttccaccttttagctattgtggatagtgctgctatgaacgtacgtgtacatatatttgagtacctgttttcaattcttttgaaaagaaattttatatatatatatatacacacacacacacacacacacacacacacaagtggaattgttgggtcatacgttaattctatatttaactttttgaggaactgccaagctgttttctacagcagttgaacaatttatgttctcactagcgttcgtactagcagggtgtgaaggtttcagtctctccacatccttgccaaaacttatttttcttttttgttttaaattatagccgtattttaatctattttttcttttgttatttgtgcttttggtgtcatatttaagaattcattggcaaattcaatgtaatgaagatttatctttgttttcttctaagagctttatagtttttgctcttacatgtcagtctttgctttgggttaatttttgtatatgttatgaaatagggcttcagctcattcttctgcatatagatgtctagtctttccagcaccatttgttgaagagacttttttccctcctaattttattttgattcaggctgtatttatttgtcttggctacaagaataaatagactgtcatatactttgctcaagtaaagatatagaagatatatgtattccagtcttctaatttactagtctagtaagcttgttcaaacagaaagtgaaatagtttataataaatttttaaactttgatttctaatagtaatgcagtagcaccagctcctacactgcatttttttttattggctctataaagacttagaattttgctggagactgataataattttacctatctactttttttctcatttttagaaatagtataatttacctttcactgttatactgatacttctacagtttttcatttccgtgtctcaaatattgctgactgatttttgactacatcttttggttcttctagtaccctgagatgtaattatccagagccttgagattttaaactgccttaatgcagttatcttacctgtcttagttttcaattttgtcttaattatgttgtttttccttttatagttttatggacaagataaaaatgatagctattgaacaataatcctgctttttctctaaaatctgttaatgttacatcatctgttccaagcattgtacctgctctttctcattcttcatgatcagtatatggctcttagaagccccttctgttctttttacagatttcagtttatttcgaggatcagattaattctatgtgtacaagctcatgccctttctttttatatctgtctttgttttatgtccttcaaaaaatgagccacattagagaacaccctactagcttttgaaaaatatacattcccttttgttccgccttggcatcattatgctattagactatttattttcaggtcttccaaatgctgttgatctctactctgtgtttttaatcacgtgtcagagttttcttcctgatatgtttttgacattttgaaattgaggctaaacaagttttcttcctttgacattcaaaatagtcaaatttctttgaagttttgtttcttttatgtctttcattagcacttttctcttaaaactgattgatacattgttgaatactataatttttaccaagaaactttcagtagtaaatgtattgataattagatttcacatcattacatgttgcctttttattgctttagaaatagaacattatatatttgtggcttactgtttttataatacacccccacagtgccattatgtactcttgtgtttctgcctttaggtttgtggatttctataggtatataaatctatttttgttgttttttcactgttgttgttttttgcctgaggtatataaatcttgatgcctccattagtgaataagatttttctttttatttccccatttgagtcatgagttctttcttcactaagattgttgccacattgccagtggtgtcaaatagaacttgctgtagtgatggaaatgtttgagaagctgctgtatagaagcaatcagttacatttggctactaagcacatgaaatgtggctagcacagctaagggactgaattttttgttttattcaattaaaatagccacatatgactaccatattgaataaaacagcctcgcacaatccttgctttaaaaaatttgtcttgattaaaagactcacacaaagttattcttcctagtcttttctgtaaagtacatggaaacccttaacatagtatcataagtcatggtaaagaatggagtttactgttgtctgatgttatttggtcctaatcctatttaacagtggagaggcatctcagactctagtgtgaatcagattgctggggttccaaccccagatctgcctcctatttagccatatgaaccttgggcaactcacttagcctttctgtgacctacttttgtcacacataaaactcagatgataattagtgctttactgctagagttattataacgtttaagtgatttaacatgtgtagagtgcttagactgtggtgtgtgtgtgttaaataaaaactgtccatgtcgcaggccccccactttccacattcgtctttctctttccgtgtaattacctttaacagaagtagaaagaataaggccactttgttcttccaggtaactcaaagtcattctgattttgcagcttctgatatcatttgtttatgtattaagagaaataggtagtagtatgatttttctcaaccctatttcacgtcttacataaaaactctaagaagccagtataggccaggcgcagtggctcacacctgtaaccccagcactttgggaggccgaggccggtggatcacgaggtcaggagatcgagaccatcctggctaacatgttgaaaccccgtctctactaaaaatacaaaaaaattagctgggcctggtggcgggcgcctgtagtcccagctactagggaggctgaggcaggacaatggcataaacctgggaggtggagcttgcagtgagccgagatggcaccactgcactccagcctgggcaacagagcgagactccatctcaacaacaacaaaaaaatccagtatagttcctgatttaccaaatcagatatagccattgtcataaagctgagtagtttcttggatagtaagaggacttttcaaacctactagtggccattagtcttttttcttgttttgttgcacaaagactgctgctgttttcgtttcagatagtgtatgttcactgtgtatgtcgtatgatattaacagttgtgctgaggttttctatttttgtctttgttgatttttccactcagcagcctcatgattattagtgtttttgttttgtacttggtggcctcaatttttttcttttggttttttaaattctagcaaagaatttttcatcttttctaagaatttagctgatagaagagcatttcatcatcttgtttgtgattgtaaacaatttatacatgcagttagtgaccagccacctcccattaggaaagccaatagacacaaacctgaaggacagatttggtatacttgttacttaaattgtaggttgaactttggggtttttttgttcattgtttttgttgctgctgttaaagtgaatattctacagagtagaaaactaaggtttaagaaagttgtaaaattacttttattttaaataaattataaaattttaacatgagataaaattcaaagacagttaccacattccctcaagattggcagcaagagtttttgtatgaaacatttgagttttctgtgatcatcagaatcttttagcttttcctttcagccttgactcttattttaatgtatactacattacatttgtataactttctctcatttagctctcaaaacaatggagataagttgttataaatgaagggcagatactataatctccagtttcctgaggggcaggggaagggcccaaaggaagcaaattagttagcaaaggaagggccagagtcagagtcttgcactggagtcttgactcctaatccagggtttataccaccaccccatagcagaagacaaggatgattcatttgaacaatctgtggccttgatataatttatggaaattagctcactatttgtattctaaataactaaaaattttaggaaagcaaaggagttttgagaaatgaatgctaaatactatacattattccggtcatgtgtttgcattggaatagtgtagtggtgtctaagccaaatttacttgagaacaaatgtctatcttattggatgtaatgatgtaaagcatattaatcatactttaagtttactcagtgttttatcatggattagccatctactaattttgtcataaactttgaattgtggcaaataaggttagagcaatacatatatgtcaatatggaaagcaatctgtttattctttctgcatatacaacagtaatatagtaatacctgttatgatcattgtaaaatccctaaaggtttgatagtgatgtgtactttgcctgaggttaatgagtctcaaaacttatgtttaaatatttattaggaacagaacattcatatagcatttggaaagtatttgaaggatagcagtaagtccctcacatttcttccacaaatagacttataagaaaattaaggaagataaaatacaagttaaataatgggaaaaacaaaattttatagtattatattgactcatatccaattttcttatgtttttttttcagagacaaaagtaaaactattcagtggtattgtaaattgatgtctcaggcatagctcatttatttgtttatttattgtattgtttctaaaagaatgtttattataaagaatacctagtgatgttctttctgttttatcttagagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataatcttggtttggttcagaagtcttaatcttttgcttctaatcaattttcttgtcatgattttccaaaaccttattatatatagatagtaaaatttcatattatgaaattttcttttttttttttaatgttaactgagtgaggctcaggttaaatgatctggagtagatttcacctgattcccaattcagtacttttcttaaaccacatcaattaattgttacttctattttataaggaatttcttttacatcacattgaaccttaatctcttctgtattttgatagcttaggcaacatttgctgacatttataaggtgacctttcaaaacctgtgttttaaaaatattaatcattttaaattgctgtaatttacttagttcctgagccattaataatattattaatggttgttagcgtattattggtacttaaagtccaaagtagtttaatcacagtaagaatggtgtcttctattaaaattgaggaagtgggctcaagatactttatcaacaagtgcatattttcaggtactacatagcaggctcatttagtacaactgagttttcacagagtgatagctgttgccacatcacttttgtgaatgggagatttaatttggtttgtaaaggattctttgtgatgacttaaatgtacggggtattttttaggaatattttcaaatgtaaatgttgttactaagaactacaatcaatctgtagtgttgagtaatttcaaatgtaaaatttatgtaacaatgcagtgcagataccaaaataggggttggtggcctgaaatacaagttatacttcaaaatgattttgagcataaatatgtttctgtttttaagacaagcataaacctaccttgcctgcctaacggaactgctagatgatcaaatggaataaggaacaccaaagaactttggaaagtataaaagttttgaatggataagtgatactttttttctttttttttaaattattattatactttaagttttagggtacatgtgcacaatgtgcaggttagttacatatgtatacatgtgccatgctggtgtgctgcacccattaactcgtcatttagcattaggtatatctcttaatgctatccctcccccctctccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacgttttcttaatccagtctatcgctggacatttgggttggttccaagtctttgctattgtgaatagtgctgcaataaacatacgtgtgcatgtgtctttatagcagcataatttatagtcctttgggtctatacccagtaatgggatggctgggtcaaatggtatttctagttctagatccctgaggaatcgccacactgacttccacaatggttgaactagtttaccgtcccaccaacagtgtaaaagtgttcctgtttctccacatcctctccagcacctgttgtttcctgactttttaatgattgccattctaactggtgtgagatggtatctcattgtggttttgatttgcgtttttctgatggctagtgatgatgagcattttttcgtgtgtcttttggctgcataaatgtcttcttttgagaagtgtctgttcatatccttcacccactttttgatggggtttgtttttttcttgtaaatttgtttgagttcattgtagattctggatattagccctttgtcagatgagtaggttgcaaaaattttctcccattctgtaggttgcctgttcactgtgatggtagtttgttttgctgtgcagaagctctttagtttaattagatcccatttgtcaattttggcttttgt

SEQ ID NO: 16313 - DNA, 36592 bp, Human
ccacgaggccatgtgatttccacggctgggtcaaaaaaggcgatttagtgtccatttcagcttgctagaacacttactcttggagcccagccaccatgcaatggggaagcccaagatgccccagggagaggcccacttggagtgaaactaacagccagcaccaacttgcccgccttgtgaaccatcatggaagccaatcttctggttgcacaggctgatgcagcacaagcagagtgtgccttcctgccaagccctgcccagactgcagacctacacactcccaacacaatagcactctgcctttctgcctaccagcatgaattatcctgggtcctctataaaatattctgaaaagtatctttgtccagtttcatttacttttgcagattcttctagtcacagaaccacctattgcagacttctggttatttgaaattctcattattacctctgaaccttggcttctcatctaaaacgttctgttaataatagagactacttcatctgtttcataattgaatgatgtattaaatttattaaccatttagcatcgtgccagcacaaaatatttcttattgttcttagtaggtttcttgtattcagagttccagtttctttagtgcgctattttttctctctcatagctcaatgccatttcacaggccatttcctatgcttggcatactcttccctacaaggtcaggtaggttcttactcatcattgaggacttcacttatttaagaaggcttccctgagttctcaagcagttaatgcctctctgctaaaatagcaccttggaggaacctgtattacagacagcccttaacacattggattgtaactaattgtttactggtctctcttctccattggaatctaagttcctggaaggcacggtcagtcttgtcttcatttattcaccatctactgtctgttagtgtgctaggaaacactgtggttaagtagttaagggccaggtcttggcggatctgcctggggacaaaacagctccttggaaaaggttaactatctaagcctcatttgtaaaatggaaacaacacctcctcacgattgctgtgaagatgaagtaaagtgcttgcaaacagtccatcacacagcaaaccatccgtcatcaggataaaacgcttccccaacaattcaattttcgggcacccccactctaattctctcataggacctcgcactctataggtaatctctgctttacggattactctgggttctttaaacctctccttggtcattcgtcctgttaacaattctgagtctcaacctttaggtctaggcgttcagaaccattcttcccgcctccaactcgctccaaacccttttccttcagcctaccctgggcctaggggcgtgtcagaggtccgatttatacaatttaaacatcaaaactcccccaacagcgtgtgagtaactggagagacccccagtcagagctttgccaccgagtttcggtcttgccctccctttgaggaaggagcaagacgatgagccccacctcagtcgttcactgcagagccagcagggaacgcgcgcaatgcaggctgagctgaaagaacgaacgcgtgagctgaaagaacgaacgcgtgaatgaatgaatgggatacgtcgtaggccaggcctctgttacgtcgtccaccggcgcgggcgtggccacggttaagagagacgcgcgcgcagtcgcgcgcgggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggtaaccgcccaggccggcctccagctcttcgctctgctctcgtcggctcagctgggcaggcagcgcggcctctcgcctccttcggcccgcggcccgctctgggaggcccgaggcggcgcggagaggggttggccgcggcggcgagggaagtcgggtgctgaggagggggcgccggggagacttccggccgcggcggggcagccggacagcggggacccggggcttccaggcggctgcccggcgggccagggagtgctgtcccacgccccggcggagggtggggcggcaaggctgggggtctctgggcttgggcgcgggcctccatagcttctgagaccacccccccgccggaggccgcgggcgcgcgggaatcgcggcggggctcgggcgcctggtggggattgtggcccgacaaggtccctcggcagccaagcccctcttctccgccccgacggggccgcggaggtgcggcaaccgcgggtgcagaatgaatgaaccgggagggtcaggccgggcggggccctgcgccccgggaagtggctctgggaggcccgcgcgtcctgccgcggtcagcacatgctcgcccctggttgccgcggctgcctgggtcccgggacgtgggggccccgcgccccgctgcccttgcttccgcgatctctctcttctgaatacgtttccgctcgtttatctctgcgaagtgattttactctggttggcaaactctttcagagctgttccgaggaaatagttttaacacaaggctgggggagggccgcagttatgggggattctctttctctctcctcttctctcctctcctctctttttcgtagatatgaggcctcgctatagtgcccaggcggcttccaaaactcctggcttcagagatcttcctaccttggcctctgtgggggatctcgtgaaatcttttgcccctcaattttgtgcgttttaattattaattggctgtttatgaatactgtgttttgacaagtatgtatggaaccatgacattttcgattctttgattttgtaaagtcttaaggaaatatcgacaagtcttcagacgtgagatattccttgtcatcacaacaactaaaccttaaatttttgtgtcggtttttatgaaggaaattagttgcacatttatgtgactaaatgcgccagttaaagtgactcaattgcagcatcattttgcttgatataacctggtgaacgtgtatgttaatcttgctcattcttgtgaaatctgtggggagatgcatactaagtggaagacctgttaggcttcgaggatgatgtactgtatactgcttcatccaattgcatttaaatatatctgagatgagggagatgtcactgacctaagggtgctgatgtagagaaataagacgtttttgtatggtagaaattcttagaaatgagagaagtagaacagattgtcagggagcactggagtctaataatgtgaatcttcatagtccgaaatttgttgtgtgtggatttatctaggattctgtccaaggagttttaattgtcatatgtattggcaggtccgtacaacgtggttttagttataatgcagtcacatggtccccaaaggtcatgtttattgaggccccagttgaaaaatgaatagggagtgatagagccatacatcaaatatccttgttttcgttgttacttaggttattgactaagtacataatgcaagttgacattcatgataattctctgaaatacatagtgaactaaacatttaacacgcatttttctatttttgattatgaagatatgcccagtaatatgaaagccttggatgaaaaaataaattctgtggaaccttgtttataaatttacagaaatggtttaaggcaataagttgaagtcctcatgattcaatccatttggcacacagtaatttacactgggcatttacattttgctgttgaaactaagacagtagtaactcatactgtgatatataatcttaattttacggtatcttgttgacaacatctatctaatgaatgacaccttgatttgggttttatcttactagtttagtgtcatttatagcttaaaaggatggttttctctaatccttaaacagaagactaaaagactagatttttaaaagtgtccatgcttgtgttatgtaggttgttccataatcagtgacaatgctttaaaaaaaatcagaatttatttttaaaagttgcctcttttctgtcaatcactatacaaacttctgtgtggtggatgggggtaacggtattgtcctgaggcaatagggacatgactttgttgattggactgttaatttgttttatttctgggtgatctttgactttcttcttttctttctgttttcttttcttgagactcgtctcactccgctcccaggctgcagtgcagtggcaggatcatggcttaccacagccttgatctcctggtcttagatgatcctcccacttaagcctcttcaatagctgggactgcaaggtgcatgccaccacacccagctaatttttgtagggacggggtttcgccatgttgcccaggctggtctcaaactcttgacctcacacaatccacccatttcagcctcccacagtgctgggatcacaggcgtgagccactgtgccccgcctgacctttgactttcaaaggatgaaatttagtgttgatataacatcagtgttagcattctcatctaatgaaaatgttaaaataaggtggcttgatttgcatgactgttaatatgatgctttctaacttataatgatcactatttacatttgtagatttcttaaccatttgattcttacagacatttttgtgaactagacaatatattttgcagtctagaaactgacttaaatgactttcctaaggtaaagctggtaagaggcagaatttggatcttgattagtgtaacattcccctgtctcttgttactgtaaaatgactaactacaaatacaagatgattttctggactactattcacccagttgctatctcatttagattcctgtatctaatccagtagcaaattctgtaggttctgctttcaatatatgtactaaatcagacactttcccccctgtctttcaaacctctgttcacttccatcatttactgcctggcctcctgtattagcctactttggagcagcagctagtgttatcttcttaaaatatagaccatgttactcccctgctaaaaactgtagaggttctccatcacacttacattagaatcttgccttcccccccaccccttagctataaggccctgcattcatttgggatgcctacttctgagcgcatctgcacttctctctctgggtcactccactgtagccacactgttgctttgctgtaccctgaacaataagtggttgagcttattccagtcacaggactttcctccagtttgttgcattgcttgctttgtccagttgttccgttcttagctcatatgtcataccctctacctaacctgtcccgtataaaccagtttccctttttcctcccccacaattttatcctcctatctccctttcttctgtataagtgcttattactgttcgaagttatgttatttactgtttatttctctctattccccattaaaccttcatgaagttagggactcttggatatcccgggcattgctcattcgtgcctagaccaatccttggcacatagtagatactgaaatattaatagactaactgaatagatgagccttaatctcaatgagcaataatttgacattgttactccttggtatattctgtctgaaccaatgtctgagctaaaagttaaagctagtctcgttttccacccataagctcacttaaaaaggacatcaatcttttacattatttcttttttgtgtgcctactctgcttatgtatctttttttattaactaggaaatgcacacatagagcacatttgaaaggctctgaaggatacgtagagaatccctcatctgtccttcagcattccagttcccctgcttagaaaaccactgtttttgtttgtttgtttgtttgttgagacggagtctccccctgttgcccaggctggagtgcagtggtgcaattttggctcactgcaaactccacctcccaggttcaagtgattctcctgcctcagtctcttaagtagctgagactgcaggcatgtgccaccacacctggctaatttttagtagagatggggtttcaccatgttggccatgctggtctcaaactcctcttctcaagtgatccacctgcctcagcctcccaaagtgctaggattacaggtgtgagccactgcacccgacttcaaccactatttttattgtgtatccttacaagaagaccagagcaactttctgctataagttaggcgtcttctccttctcatgcaaataccttgattcccttctcttcccctctaaccacctatgtatcttcaagttgacttttttttttttttaagagacagactgctgctttgttgcccaggctggagtgcagtggcttttcacaggcgtgatcatagtacactatatacatacagcctcgaattcctaatatcaggtgatctctaccttcagcctccagtatctgggattacagacatgcatcatagtgttctgctttggctcttttttttttctcaaagggctgtttaatggaaccttatggttagactttattttattttttcaaatattggaaatttaatactttttcagtagagatggggtcttgccatgttgcctaggctgttctcgagctcctaggctcaagtgattcttccacctcggcctcccaaagtgctagggttaacaggcatgaaccaccgtgcctggcctagactttattgtaactaattgcttattcataactttcagaatgtttcctaaattgtgctatataaaaaatgctgtaacgaagttttgtatgtatggcattttgcacaagtgtgagtgatattgagtcttagtagttctgttttaagctagaatctttagtttcgtttttctgccttatcttctggaccaaagctcttttagccaataaaagtgactgaagctgggcatggtggttcacacctgtaataacagctctttgggagactgaggcccaaggattgcttgaagccaggagttgagaccagcctgaggaacatagtgagatctccatctccaccaaaaaaaaaaaagtgagcagttaaagcttaaagtcataaaggttaggaggtacctaaaatgtccctcaaatgagaggttctgcataatcctgtcataaaggagaatcactttcgggaaccgataagtgagatctatagttatggccttggtcaaaaccaaatctgtttcagctttacatgttacgttgatacagtgactgacattcctttaatggtcttttcagaattaatcatgagggctgagcactgtggctcatgcctataatctcagtactttgggaggctgaggcgggaggatcccctgagcccaaggtttcaagactgggctgtacaacataatgagaccttgtctctacaaaaagataaaatgaaaattagccaggtgttgtggcacacatctgtagtcccagctactcaggagacaggtgggaggattggtttggcccaggaagttgaggctgcagtgagcctagatcgcgccactgcactccagcctgggcgacagagtgaaaccctgtctcaaaatagtaataatgataataatgaaaatgataaaatacagtcttgggaaaaagtagttaacttaccctaggggttgacttatttgattaaaacctagtgagtcaacctgctggaattagaattttaccagtctttcgcagaatttactttatgtctcccttccccactggtcccttgtctatggtgcttaaaaatttacttaagaaaatacatttaattaattttttgaaacagggtctctgtcacccaggctgaagtgcagtggaaaaatttactcttctatttggtgtgatttagcctcaaattcttaaaaatcagatacagtctgattttacattgagacttgagtttacttttttaataggattttttgaagtacacacattttttcctgttactgtttaaaagccactcatttgataggtattctagtgcataaggtatttttttttgtaagaaaagtgatttagaaaactcaccttttatttatttgagacgggagtcttgctttgttgcccagcctggagtgcaatggcacaatctcggcttactacaacctctgcctcccaggttcaagcagttctcctgcctcagccactggagtagctttactctctgccttgaacattttttttttcttattttgagatgaagttttgcttttgttgcccaggctggagtgcaatggcgtgatctcggctcactgcaacctctgccccctgggttcaagcaattctcctgcctcagcctccctagtagctgggattacaggtgtatgccaccacgcccagctgatttttgtatttttagtagaggcagggtttcaccatgttggtcaggctggtctcgaactcctgacctttggtgatctgcccacctcggcctcccaaagtgctggaactacaggtgtgagtcaccgcgcctgtcctatctgttgttttaagctctgaaaatacttgtctgataatgttttcttccaattaaaaaaaggcatggaaaagttaccatgatgtttcagaaatatatgtacctccaggtgggggcagggaaacttagccaggtatggtggttcatgcagtaatcctaacagaagactgaggcaggaagatcccttgaatccaggaggccggggctgcagtgagctattagtggcaccactgcaccccagcctgggtaatagaggcaagaccctgtctcttaaataaataaataaataaataaataaatacaaactcattatgatgaagacagatttgttataagttgtaattaaaatcacctttggaatttaagaaaaaacttgtaaaaaatttgactaggaacagtggttctttagttctttcagttgtctcacttaagaattttctgacctcttcctaggaaaaaaagctattttttttaacgtatgacttctggggattcagattcttgccaagtttatttgtggattccctaggtctccatgtgctccatgttaagaatccttgaactgcttttgatagtgattaaactttcaggctctaaagatactgttttaatatactatctaatgttttgattatgaaatgtgagcataactgaaagtaagttaaaaatagcagtcagttcagtattcttttttaagctcctctgtgtcaagcagttcctttagtccagattgatcaactcctgcacaagtgaaattaagttttgtcaaattatcaagtactttagtattcactgtgctaaatgactgtgactggaaatgttatgcatttgctttgctcaagtttggaattttttccacacgtgttaatgaccactcttaaaaccagagtttttttttgttgagacggagtctcgctctgtcgccaggctggagtgcagtggcacgaactcggctaactgcaatctccacctcccaggttcaagcgattctcctgcctcagcctcccgagtagctggaattacaggcacgcgccaccacacccagctaatttttttttatttttagtagagacgggtttcaccatgttggccaggatggtttcaatctcctgacctcgtgatccacccacctcggcctcctaaagtgctgggactacgggagtgagccaccagagttttacacattagagaacatctgttctatccttttctttctctggtgaggaatttgtaggccaaagaagttggatgaccagattcctgatgtacaattcggttcttcttcttttttccctataccttataggatagtttacctgtgtaaatggatttaagaagaaaatatgctacagattcaagttgtatggattctgaacacacattatgttttctgttataatgaactatggatgcatatgtgctatagaaataaatactagaaacaaggaaatgaggacagcagcatccagcaggggcttttgacattacaattatagtaatcagagttctgatttaggtgccaaattcgtatcttatacagtgctgctttctaaaaacaaaataaatatgagaggcatagtttatgtaataatattatatcaaggaaaagaattcttatgtgtgtatgcgaaaaacgagttggactgttgtttcattagagttgaaattttctttgcaaatgtaatatatgaaggaatgaatgtggatataccaattaggcaattaaataatagggaatcttttaacttcagctaaaatcttagcagcttttaaaatttcttcccaagtgaagtgattgatggccctagggtcttttgtggcagaaacatgactgtgtggttggaagaactggataattggttaagagccctcagaatcaacagaaatacttcattattattcattctttcaagggctacatgacaccattgggggcattttatattttttaaaaatcctggccaggcgcggtggctcacgcctgtaatcccagcactttgggaggccgaggcaggaggatcacaaggtcaggagatcgagaccatcctggctaacatggtgaaaccccgtctctactaaaaatacaaaaaaattagctgggcgtggtggtgggtgcctgtagtcccagctagtcgggaggctgaggcaggagaatggtgtgaacccgggagcagcagagcttgcagtgagcggagatcaccccactgcactccagcctgggcaacagagcaagactccgtctcaaaaaaaaaaaaaaacctgaatgaagctattctaaaatttcttgagtacttaggcacagacatttttggttttgaattggccagtaactgagatgcttctgaataattaggattctactgtaatttaaagtaattttagatactggtttcagaatctaaggttgacatattttgcattaaaacaactggctatgttgtctttagattttcaattttttttttagttttcaataccttcacattatgtctctgtcagtttggttaattttgggcaaatgaatttatattttgaaagtctttacagttctagggattgaaggcattgtagttaaggaaacactagaaagaactaacaaatttatatcatgaaaccattggtgatttttttattgctctgtaactttcttaagattatagcttatactcgggaaaatgttagtaagtagctgttttgttttgtttttttttttttgtgactcttaaagacaactagattaccatcttactatgaggcagggacaaagtggttttagtaacataggccgatcccaaggccaaatttcagttttctgtaaccttgtgatttgcgtgtctctttattatccattcatgagattttttttcagttcaattaattggacattcattgaatgcataatatgcatttaccagtaagccaggtgaacaagaaaggcatccctgtgtaatggaaaacacagtcatgaaacaaatttctgtggcccaggctggaatgcagtgacgtgacttggctcactgcaacctctgcctcccgggttcaagcaattctcctgcctcagcctcctgagtagctgggattacaggtgcacgccaccacacccggctaattttggtatttttagtagagacagggtttcaccatgttggtcaggctggtctcaaactcctgacctcgtgatccgcccgcctcagcctcccagagtgctgggattacaggcaggagccaccgcgcccagccgaggaagtgtttttaaacttgaagagtaagagtttgctgggccaagagaaggagggagtgtgagtgagtttttggcacatggggcagcagatatgaaagctggaaggagagacagaaagcatggcatcatctagaaatatagtatgtgatggataatagaatcagggtctcatcaaaaataattattactgtttaatgactgtgttcaaagagttggcatcaagaattgttaggcaaacaaagtgtttctaattatgaaattcatatttagtctgtgaactattcactagcatgcagtgtggcagctgttcctgaagtgaggttggtcatatagtttttattatgtaaaaatagacatctttcattggcatcgtgtaccaggcactgttctaagcatgttacgtgcattaatttacttaattctaattgcagttttatgatgtgtggatattagtatcattcctattttatagctatgggaacctgcacagagggacttattagtttctagagctatgatttgaacccaggtggtctgattctgtagactgtggatactgaagaacatgtctattcctagataataactggcagtgcatgtatttttatactgtatcatttggacacatgaagtggaaacatgtttaagaacaggatctaagtgcttagcttacttgttttgggttgtgttttgtttgtttggttggttggttggctttttttgagacggagttttgctcttgttgcccaggctgggagtgcaatggcacgatctcggctcactgcaatctctgcctcccaggttcaagcgattctcctgcctcagccttccgagtagctgggattacaggtgcccgccaccacacccggctaatttttgtatttttagtagagacggggtttcaccatgttggccaggctggtctcgaactcctgaccttgtgattcgcccgccttggcctcccaaagtgctgggattacaggcatgagccactgcgcttggctgtgtttttttttttaagatagggtctcactgtgttgcccaggcatgatcatggctcactgcagcctcagcatcccgagtagctgggatcacaggcatgcactaccatccccaactaatttaaaaaaattttttatatatatataaaatatatattatgtacaatataaaatatatatacatatataatatatattacatagagacagggtctccctatgttgctcaggctggttttgaactcctgggctcaagtgatcctcctgtctcagcctcccacagtgttgggattacaggcgtgagccactgagcctgccgcttttcttggttttttttaatcagaagtctctttattgtaatttaattagaggctttcctacaaacatgagaccctgtttagtaacatagttcactttaagatggaatgcctctggtctggatggcatattcttttcctccccctccccacccagccagtcctggatttgaggaattttgtggttctggtgagaagggactctttgctgctctttcttaccggcaaaatatacagtcttgaatcacttaacgatggagttactttctgagaaatgcaccataggcaatttcatcattgtgtgaacatcatagagtatatttatacaaacctagatagtgtagcatgctacacacctaggctatgttgtatagtctgttgatcctaggctacaaacctgtttaatatgttactgtacttaatactgtaggcagttgtaatgcagtggtaagtatgtgtgtatcaaaataggaaaggtacagtaaaaatctggtataaaagataaaaaatggtatacctgtatagggcacttaaccatgaaggaagcttgcaggactggaagttgccctgggtgagtgagtggtgagtggatttgaagggctaggacattactgtacactacgatagactttataagcattgtacacttaggctacaccaaaaaattttttaaaatgtttcttcaataataagccttggcttactgtaacttttttattttataaacttatatttttaaacttttgatttttttgtattaacatttagcttaaaacacacatcatacagctgtgcaaaaatatattttctttatatcctataagcttttttctcttacaatcttttttaaaaaaacttttttgtgaaaaactaagacatacacacacatattaggcctattcaggatcagcagtatcactgtcttccagctcctcttgtcctactcgaaggtcttcaggggcagtaacacacatggagctgtcatctcctgtgacaacagtgccttctggaatacctcctgaaggacctgcctgaacctgttttacagtcaacttttttttttttttttaacaagcagaaggaatacactctaaaataatcaataaaagtatagtatagtaaatactaggcaataggaatttttcagttccattataatgttgtgggaccactgtcttttgtgcagttgatcattgactgaaactcatacagcgcatgactgtatttaaagtaccactgaatcagactaattttaaacgagaattttttttctcagtaagtctaaaaatatgttagagttatcttgcattcatttatatatcaagttgagttttgtgttttctttctttctttttttttttttgagacagagtctccctctgtcgcccaggctggagtgcaatggtgtgatcttggctcactgcaacctccgcctcctgggttcaagcagctctacttcctcagcctcctgagtagctgggactacaggcgtgcaccaccacacccagctaattttggtatttttagtagagacggggtttcaccatgttggtcaggctgatcttgaactcctgacctcgtgatccgcccgcctcagcctccaaaagtgctgggattacaggcatgagccaccgcgcctggcctacactttttcaaataaagtgcactgtccaggaccctgtctttattgttgtggttcaggtaagggttaaactaaaagtgctgcaagttctgttcaggggccagcactgactgtgcttagagaagtacttggccagaccttgcctatttcttctcctagtttaattggcagggctgctgatgtattggcaaggatgccaagacaagaatctatgggctattttctctgaacacttgtttctagtctgagtacttagttcatggttatacattggaattatctggggaagtttgtaaatttaacattgccagcccaacatatttttgttgttttaagagctgcttatgattttagtgtacactttgcagaaacactggtcatatgtgtgcttggcttcaatgcaaagatgggtagaatgggagacaaaagtaaaatcatacagctagcactgctttgtatattgaatacaaaggcatcaatgggaacaccaaagaagtgacagactggcctggaaaaccctcaaggttggtttagggaaaggtttttagaggatgatatttgagctgaattttgaagcataagtagaaaagggggagtagaatgtcgacataccagacccaggagatatttgaactaagactgtgtaacttgagtcagcatgtctatgcttggatcacagatacttagcttcaaaagtaatcttttaacttgaagtttcttttcttcagaagtgtagtccatgaatatatattcattactaaaatttctgttggctgggtgcggtggctcatgtctgtgatcccagcactttgggaggctgaagcaagtagattgcttgagcccaagaatttgagaaaagcctgggcaacatgaagaagccccatgtctacaaaaaaatacaaaaattagccaggtgtggtggcacatgtctgtagtcccagctactagttgggagggtgaaatgggaggatcacttgagcctgggaggttgaggcggcagtgagccaagattgtgtcactatactctagcctgggcgacagagcaagatcctatctcaaaaaactgaaaactctgttaacatgctgtgaatatgttatatactaaatagtcaagtaatagatatttattttcccttcacttacttttactattccaatctctaattcatcggtaagattccaaaatctcactgaatattgaaggaaaactcaaatgcttcatttatttttttgaggtataattctcataccataaaattcacccactcaaagtgtacagtttagtggttttttcatgtattcacaaagtagtacaacatcatcacttgctaattccagaagatttttgtcaccccaaaaagaaaaaccctgtgctcattagcagtcactctaccttcaacccctggcaaccatttatctgctttccaattctatggattttcctattgtacacacttcatataaatggaattatacaatatgtggccttttctttctggcttctttcatttagcatgttttcaaggttcatgtatattgtagcatgtattagtacttcattcctttgtaaatattttacctgaagtgttttctaaataaaaccttttaaaaagtgatagtgctgaagggaagcaaggtagaatttttaggagataggtaatctgtattggctctcataaaactagtcacatgtgaagcctgcattgctttagaacagggatttccaaccttttggcttccctgggccacagtggaataagaattgtctcatggctgggcatggtggctcacgcctgtaatcccagccctttgggaggctgaggcgggccaatcccttgaggtcaggagctcgagaccagcctggccaacatggtgaaaccctgtctctactaaaaatacaaaaattagctgggtgtggtggcacacgcctgtaatcccagctacttgggaggctgaggtgggagaattgcttcaacctgggaagcagaggctgcagtgagccgagatcgtgccactgcactccagtctgggcgacaaaagaaaaaaaaaaagaattgtcttaggccacacataaaatacactaacactaatgatagccgatgagcttaaaaaaaaaaaaatctgctgatgcacccatgagaggggagacagcactgtcgtctctcgcagttttcccttaacactcccttatctgcagacttaaactaggagcccctggcagagtcctacctccagaatcacaaaagtgtagaaggaaagtgagagacattgattgactttatatctgacttactagtttcctaaggcagagattttttagaaaactgcctggcctggcccagcccaggatagatagggatgggtaagaagcccttgagatgtggcagtatgtggcttgacttcagacttgtcagattaggggttttatagggtttttttagctcttgttttgattaagcttgtttgacttgcagggtgtctcctacctgtgttccagccacccgatttccttcctcaagaaaactgtttacttacactattcaaattagttattctcagggctatttttatgactttgtagctttttttttttttttttggatgcagtttcacataataacattgctggctcgtgttgctagcaagaactgattccagcatttatgttctttgaatgtattgtcgcattctttcggagactcaagctgtccacatgaagtggatgaatttgacccagtattattgtccatcgtactctattgtaatacatcagccctagtgtgtaagtttgtgcttatttcagttacattaaaatctgagttgtctggatcatttcctcttctggcttagtagtgcaggacgagataatctgaaatcacagaagagtaaaaaatctgctgagttatttactccagctggatctcttaagactgttcaaatttcagacctaattgataatctgtgaaatattaaagtccctaaccaagctgtttcatttcagattcttcccaaaaccttgaggtaggggaaagaatcatctttaatatgtcaactcgtgattattgaggcaatgatcacttttttaaattgaggaaaatgcttattagattgttgaagctgcctagaggggcaaaagaagtgataaggctggtatctctggtgcttcgtaattggtccatttaagtgtatgacctgtaggaatagtgtcaaagctaaggcttttggacagacgtgtgaaatagtttgtaaagattcggtttggagtcttgcaagtctttttttctgcatactcctgctctttgcagtcactgcttggctaggcctactatttttggaagttcttgaatttccttttaacccagtcagtggttttccttactctgtggggttggtctcaggtagttctgcagttgatctgttcattaaccagtaagaaatgcaagacacactggtgtccaacattgggtctgcaaatgttagacacaggccttgatctctaggaactagtttagttggagagacagtaaggtagcaaagtgtgtaagggatggcttacagaaggttcattcctactgtagtcttttgctgacctcttaattgacaattgactttcaagatggtagaaatgctgcttttcatgactaaaataatgttttatggctcagagagccttacttcctaattctctagagcaaaacactgatttagggaatatgaaatgtatgtttatgtatggcaggaacaaagaatctgaggccagactcttgagtttgatttctagctctgccaaatattagcttgggcaacctcatttgacctctctgcttctttatctgcttaatatactaatctagctctatggtaattggaaggattagaatgtaaagaacagaccctaacgtaatactgagccttatgtagtgttggttattactgttttctgactttgcaaagatgctgcttcaccataaacataaaaagattgaatgtcttcctagtgtgtgggaaaatggtttgttcgtttcataaacgaaacaaagttcatttatgtatttgtttcacaaaatagataacattaaatataactctctgaagtgaggcatagattttgtgaaagcacaatgaatgctcatttaccgacagtggatagcaaaatgggatgttttgggtaaataacattttgatttcattaaaattatcatatgtgtaatccattttccatgggttaggtaataataaagttgatctttgcaactgctaaattgaagttttattttttaatccaaagtatttcactgtataacttcaagaggcgccatttatgcagactgtcatacgaatggtcctctcctgaagctgtgcggtatggttagccctgagagaggatgcttactgtgtgggagacaaccctccaatatctgcatgctttcatgtttcctaatttatctcagagttagtatgcagagtgtgaaagactgttttaatttttctttcctgatggtttggattttatacaaaattgtgttactggtacaattggattgagaatgcaaatctgagcgaaatgtaacttgtttttttgtttgcttcgctgaaaagttcaactgctctgcttccatctgttcttgtcttgccttacctattatggagtcctcaggcattaaattttgttgtgattgctgcatttgaaaccagaagtaacctgaagaaaaagggtcgagtaagtaaatacatggtagctatactagtatagtcactagcttgtaggccaggaaaagtacctgtttatgccgtatggtttttaaagaatattgatttgtctgtaaatcaactagccttgaggaaagtggctgcagtgacacaggagtgaaaaaatgtaaacatattaaactgtttttaagggcttttgtctttatcagaacaacaacaacaaaaaacattctagaatgttaattggattttggttattaggagaatggctaattttatttagattaattttatgtatttctttaatgagcaagtgaaaaaaacttgggaaaaaagcaggtgcccttagcaacaaattttctctttatttagatattgaacgttggcataaataccaggatgacagttcataatatccttctccttcagcagggaagactaaaacagtaattataggcctaaagaatgttattacaaaaggggaccttccagtagaaagaagcatatagcaataagattcaactcattctaataataataaagtattcagacaattttggtgctatagagaaccttttaaatgttcaagggacattttagaaggctggagaggtaaatgatttgtctgtggtcacatatcacattggtacaattaaaattggaattaaattcagatgtgctaactcttgagcctcttccccctccccacgctaggtacaccaggctgcttagttgaatttaactgtctaatgtgaaattagctcctcctctaaaaggttttaagtagaagttctttgataaagagattggttgacttgtatgctctcctcttttgacttcatttaatcccaaagagttatttagcttcttaacgtatttaccagcccccaaccccctcctgccttggtctgctaactcttaaccttttcttcacttcctttcctattgagtttagacttcattttagcaaccaacagaagccagctttggctagtttaagcagaaatgatattaagagttattagttacctcacacattcttcaggagggccaaagaaaagagggagccaggaacaaacttcagaatcacatcacgatgatttcagtgctcacactgtgtgcaacacattctacagtgtgtgcggtgtgattattgatgtcaagcgcagaatgctaccactagaactctgctgctgtcttagtggtaactactgcagttctctccagaatgggttatttctttgcttgtgatgcgcaagaagtgctggatgcatactaccaacctcattttgccctaaatgcttccaggcagtccttttgtgtgaccacgggtaagtttttctttttctacaagttacttaaaatttttacaattttcttatctcccagctccaacattatactaaagagtgggagctaaaggaacatatgaatgagtgggggaatttttaacattgtttaatagttaacatagacaaatgactaaaattacacataagggcctgaaatgaattaccaacttgaaaaaaacaagtaaaattttatgaaagaaaaaacccacaatctacatcattttttacataaaagctggatcaaagaaaaaaaccaagttcactggtttttgctaataaatcttattattttagtgttcaccacataaaacaggcttttaaaaaatttccctaattttaattcaagatgaatacagaagaacatttcctacctcacctactaagttatatacccactcccagaacctaaaatatgcaataggtttgttaatagtgcctcgaggaccatggcacacagcagtcccaatgaactgtgttactaagctaggtcctttcttttcattcagcattctgagacatctctgtcaaatcattcctgagataacagagttcattaagatagacagctacattatttaaatcactaaagtcttatttttattttttgagctggtgctaagaaaagttcaggcaatgaagtgttatgtcattcatcaaatcaggaaccatagaaaatggagatgcttgactgccacgagtctactaattatagtgctgaatattcaaaggacatttttaccaccaagaacttcatgagtgttttatgaaggaatagttgacaccatctttagctgtgatgccaatatttggaaatctttgaaaaaacaaagagggaaaaaagatggagacgaggtttttaatctttccagaaaactttaaaaatgtctttagaaataaacaagaacataatagccctgtaatctggttctgctcttcatatattaatagtatcctaactcacacctcctgtaccttaagaccttgactactcacaatgaaataaactgctggatgccaagaagttttactcttccttccagttatttaataccacaatgccatgaacaaaatagcaatgagtaaacatttgtaagtaaatttatatttcaaagtcacgaaacattttagagcatgttgatctcatgcactatcaaagataggcaaaatggtttaccatctgataattccaagtcaaaatagtatataccaatttttcaatcaaatcagtttttttcctatttttatcttaataagactatacttttctggttaccagttcaaaaagaaaaaaaaatttatgacattatggcttaaatttacctttttcatgaagcaccacttcacgattatgaagggttgaaaatagcccttttaactcccgtgctgtttactgtccctgccaaacattagacatttactgcttatgtagttaattgtctttattgtataccatcaagattaggaaacatgggccgggcccggcagatcacgaggtcaggagatcgagaccatcctggctaacacggtgaaactccgtctctactaaaaatacaaaaaatttagctgggcgaggtggtgggtgcctgtagtcccagctactctggaggctgaggcaggagaatggtgtgaacccgggaggtggagcttgcagtgagctgagattgtatcactgcactccagcctgggtgacagagtgagaatctgtccccccagcccccccaaaaaaaaaagaaagaaaaagattaagaaacacatcctgaaaccagactgaatagagcccagcagcttggatttgaatcttcactctgtcattcactagctttggtcgattactctttgtttctcagttgtaaaatgagtatgaggattaaatgagctaatacatatgtagcacttaagtcagtatttggcatagtttgttcttaactgttacccgagattttcttttattgattctctgtatatctgggacagtgcttgataattgcatgtggtccctgcttttatggggcttacagactggtggggaggaaaatatacacagactataatacaacctgatgtgtttagtgggcagaagaattggggaggcaagatagacaagaaataaaggaattcagcttaacagtttttcttcttggtgggacaatttgttagtaggattattctgatttttgtccattgtcattgtcagtgattggaataatcttaaatgctgttcctgagatggaatttaccaatgaacacagcagatacagtattcctcatcagctctgggtggtacctaagcattgcagatgttcgttcaccaagcaagcatttatttagaatttaccaccatttactagctggggttcctctcttcaaatagtttagggtctgagaagtaaaccagcagttattgtgcgtagttacagtaagtggagaggtggtaatgaacaggaaactggaagtacaagggagaaacttttagactaattcagacctgagatacattctgatgtatctcagattatatatactttgactttcagaagtccctccagctcccaagtctccattccttttcactgagcttcacagaaatattgatctggtctaggtttgagggaaaaaattaggatgtagagatttctagcccaagtcatctggccccatctgttcattattacttcaagtggaatagagagtacttacctatttgttacctatcaacccataaataaagcttttcccaaaaaaggaatactctggtctaaagtactctgaaatttagtctttggtacgcagaatcttagaaatagatttttcttccgtttttccttctctgaatctgccacctaagaaattttgagatttaaatatgtgggagtagaagggaaaagaaagaacaagggaggggtgtgtcttgagaatcattattctccatttgactttaggataggcattttcaggaaattctcatggacccagttagcttatctgggggagtctaagtggttaggagcaagataggcacaagaggtgaaagcagaaagggaatacaaaattgtcttagctttgcttggtttgcttttattagttttcttaagctattttcattttatttactgttggaatctataggtctttttcaaggacgtgtttaggtaggtgctaactttggtttggttttaccaaagcaaggagtgatcatataatgtaagtttaaaaagcttagcaaacttgggtacagtaacttttaagagcatcagttttttcatttgcaaaggaaaggtggtgaaataagtagatgatgtcttatgtccactagggggtagtgtgtactgtaaaaattaaaatagttcctcagtgaactctttacttcatcatgcagttagcttgtttgaattaatttttgttcatttaatgtgttttgaaattgccataaatttttttcaaacacaatcttgtgagtgtagcaaacagcaactgttgttacatgcatttctgttattagtgatgtcaaatgttctgacattacttttttttttttttgagacggagtttcactcttgttgcccaggctgaagtgcagtggcacgatctcggctcactgcaacctccgtctcccaggttcaagtgattctcctgcctcagcctcccgagtagctgggattacaggcatgcagcacgaggcctggctaattttatatttttagtagagacagggtttctccatgttggtctcgaactcctgacctcaggtgatctgcccgcctcggcctcccaaagtgctgggattataggcatgagacaccacgcccggcctgacattactttttgtatagaattttttgaggggaaaatagtgatgctttaaagtttctgtacaaaattttacctattatatgaaataaattaaattattcataatgaccaggcagtaacattataacatgattgtcttgtgtttcactctccagactaatttgggagccactaatcattccatgtggctgttgagtagttgaaatatgactagtttaaattaacatgtgctacaagtgtaatttgcacagtgggcattgaaggctatgataaaagataaaatacatcattaatttcatactgatttcatgttgaaataatattttgaatacatttttagataaaatatattaaaattaattttacttgtttctttttacttttttatttggctactagaaaatttttaaatacttacgtggcttgtattatatttctgttggatagcagtgctgtggagaaaagtactcatcagccatttttatcttagtgtatctctaggtggccttatgatttgtaaggaagtagtgtaatggggagcttgagcaaaactttggttctatttctaatcccagctagaaaataggcagtcagttttactataatgagacattatatgtttctaagaatgttatgttatacaaaatcatgtagtaaaattcacagggcttacagataaaatgaagcaaggggtatgcacttgaaaatgtccattgatgataattaactttttgttttgttttgttttgtttttaagagacaaggtctcactatcgcccaggctggggtgcagtggtatgatcacagctaactgtaaccttgaactcctgggctcaggcagtactcccacctcaacctcccaagtacgctaggactatagtcatatgccagcatgcccagctaatttttttagttttttggtttgcagagatggggtcttgctatgttgcccaggctggtggtaacattttttaaatgctcacttattgggccaagtgtggtggctcacgtctgtcatcccattgctttgggaggccagggcgggaagattgcttgaggcaggagaccagcctgggcaacatagagaaacccatctctacaaaaaaagtgataaataaaaatgcccacttatatatatagagggtgaacttgcagattctcataagtaacttacagttgtgtacataatgaagaattgacttgctttattagtgatcccaaaaaaggagcccgtttgttttatcttacaaatttttcataatttttttctttatttaaattttttttctataacacacaactttgtccagaaccctgtttgttaatattttagaatcgcttaaagatgtagtgacaggttggagtttacagagtaggtatcattgaagcatcactcagttttttaacacttatttttcagtaatgaaattggcagttactgagttatcagacagctcttgtttgagatgagctaaaagatctacagttgatattactggtcatatattgcaattttgtgtttcagagaatattctaaaaaacctaatcactgtagacaggatgcactgggatatagatagttactaactggaccaacttttctcacacacaaattagcactttttctaagaatactgtttattaccccaaaattttactgtacatactccaatcattgccttgcagaagagcatctaagacctgtcattgcttcgtactgagcacaaattatttttcaacttaaaaataagagtcctggttaatagagataggttgacagaatgtcagttgttataattgactaactacagtatagtttacagtagtgtgagtctagggtttgctcttcaagacccagtagatctgttgataattagatcaatttgatgtgatatttgattccttttaaaaatatttgtagcattaactattgtatgcgttctataagatgagataccttcctttagacttaattttgtggacatttaaatccataccctattcctttaccaacttacctgtctattttagtaactaacttcctgaacatagtctacattaactaatttcctgaacatagtctacagtgctttctattatgcatggccctaaactcacttctgtttgggattcaatccttggactgcttttaaacataatagaatcacaaaattcatttaagggttattctgtttttctgtaaacaactatggccttcctatgtgatctcatttgtcaacttttttttttttttttttttggtagtgatggggtctcactatgcttgcccagcttggtctggaactcctagcctcaagtgattcccctgcctgcctcagcctcccaaagtgcagggattacaggtgtgaaccatggcatcccacctgcaatgtaaattatttgtgccaaaagatagataaggccgggcgtggtgcctcacgcttacaatcccagcactttgggaggctgaggcgggcagatcactttaagtcaggagttcgagacctgcctggctaacatggtgaaaccctgtctctgctaaaaatacaaaaattagccaggtgctcacttggacccaggaggcagaggttgcagtgagccaagatcgtgccactgcactgcagcctgggcaagagagcgagacttgtctcaaaaaaaaaaaaaaagatagataagtgaaacagtaggaattttagccctttacttcttcacttaaagaaatcatactgtactctgtctttccaccaaagaatagtgtaaaaccagaaggtattttagttagtcatgtgttgaatagtggccggaaagattttatttcctagccagtttttgcctttttaggaaaaaagttgacatcagtttctgtggttgagactttttcagatgctgccatttcagacttgtttcatttagtttggattttattccttttttcccctcccacagtttatgctgtgggtttgttagggaaaccaacagtttagtgaaataattatgcatgtttttgtgtcagtccattagaacttgagagcagcatatattataaggactatttcaaaatgttttctacacacgaaagcttattttagaatgtgttccaattaaatctaggcttgatcaggtcacatgatgtgcttaatatgtacattctttacaaagaatatctgattttgagggtgaactgaagatgagaaagtaaatgccatacctatctctgccactgtgtattgagagtgattttgaagctattttgggatacgcttttggaggcctttctgtagctttttatagtagatacagagctgctactactttgtgtaactggtgagtggtggattgggactcttgggccctggctttcttttttttccagtcacccaatttatggctttctaaaaacatgaagacctggggtaaaattaaaggatggaggtgaggagagcccagaattcaaggaattttaccatccagttattttctcatttttctactcctgctattcatccctaatatcttaacttttttcctaaaaaatgaagaccagcctcttttgttctggtcacatgttaaaggacttcccaaggtcagaggcttcattattgcctcttgagctttttaatactctaaaaatgttttagtttgaacctaaagaacatgtcagtttctcacttgctcttacatcgccatgatcaaaacaaaaaactagtcttaaaataccagagacattacctaaaatggccatgggtttaattaacacattttggggaagcatttgatttgtatttacatcttatgactatttcagtatattactgtgctgagagagaagttatttgttgttgttgtttttaacgtatgccctgtagcttgtggaatgaaacagtttatgatgtatttttttttaggtgaaggcagtgtaaataaaatgttctcatttattgtttttcatacctaaaagcttatttaaatatgaacatttttctggttaaaaataaatataagtagaagttagactatttttccccatacctgagtggctccttttgttttccttccataatgtgcacatcctgccttgaaaataaccctgccttaatgatgttaacgatgaaattctgatcgtttatttccctcttttcataacatcaaatagattcagaattcagtaaatattaattgaatatctattgtgccaggcagtgttccaaatgctgaggatatagcagtccataaaatagactcaaatccatcctctcatggagcttaaattctgaacaaaataagtagaaatgagatttgttagtagtgctgtggagataaagccagggagtggggatagggagtgtgcagggtagggttgaatggggtttgcaatttcagttatgatggcttcactgagaaaacatgaagatcttaggagctgagggagcaagccatatggatatcttggggaggaagaggaagtacaaagcccttgaggtgagcggatgcctggcacgttgaagaactacaaggaagctaatttttgtctggaacagagaaggttaggggatggagagagaacagctgaagataagtcagagaggtaggtggagtgagggcatcatatagagcgtcttttgggggcccattacaaggactatgactttttttttttttttttttttttgagacggagcttcgctcttttgcctaggctggagagcaatggcatgatcggggctcaccgcaacctccacctccggggttcaagcgattctcctgcctcagcctcccaagtagctgggattacaggcatgcgccaccatgcctagctaattttatatttttagtagaggtgggatttctccatgttgatcaggctggtctcgaactcctgacctgagccgatccacccgcctcggcctcccaaaatgctgggattacaggtgtgagccaccatgcccagactttttttgagatggagtctcgccctgtcacccaggctggagtgcaatggcacgatctcagctcactgcaacctccgcctcctggcttcaaatgattctcctgcctcagcctcccgagtagctgggattacaggcacgtgccaccatgcccggctgattttgtatttttagtagagatgggatttctccatgttgatcaggctggtctcgaactcctgacctgaggtgatccacccgcctcggcctcccaaagtgctgggattacaggcgtgagccaccgcacccggctcaggactatgacttttaaagggtctgtggataatagacctgcgagggaggtagtgaggtcagaagcaggaagaacaggttaggaggctgttgtagtatgccaggtcagagctgatggttgcttggatcagaggtgtagcagtggaatggtgagaaacagtccaatcatgagtagaatttgaagtataaaaaaaaccaatttgccaatcaggctagatgtgtgtggcatatgaaggaaaaggtggatcatttggaaagatgggtttgccagtaactgatgtggggaagactttatgggaggagcaaaggttggggatagggaggtcatgttaagtttgggatgcttattagacattcaagagtgtatatcaagcaggtagttatagaggcaagaggcacgatgaggggagaggtctgggctagatatgaattaggggaggcttcagcttatagagtgtgtttagtatttaaattcattgcattacatgagatcactgtggaaatgtataaacagagaggaagccctagaatagagccccagtgcatttcagtgttgcgatgttgggagatagaagaaaccaacaaggaaactaaaggaagctgctgccagacaaggaggaagagagccatgagaatgtttataggaagttagataaagctttgcaaagaggaaggagaccagctggataagatgtcgcatttaggtaagataaagattaagcactggacatttgatttaaccttgtggaaatcattggtgaccttaacaaacaagttagcgataactacagcttgattggagggtatgttcaagacagaagaggaggagagaaattggagacaagcaaagtagaggttcctcttcaaagactttcctccccatctaattaggaataaatagtaacttctcttagaagcaaaatttattcgaagacctgtgcaaacattcttaaatatttgctagccataataaagaaatcaatatactttatgttcttagctcccacaatttagcctaaatatttgccctggcatgcttatactggtccaagcaagcattaggtcatagcctgttcctcttccttatttaaaagtgtttttacctttctcagcattccacaagttacttcctccttcctttgttcccctctacctttacctcttttaaaaagttctaagttgctagccagtcaggacaaatacagaatgtgagatcccgttccagccagtggaaaccggacacagcagtagggtggacgcgtcaggttataaatgaccctgtctcctttgttcagtatactcttgtggcaaaactcctggcgagtgtaccctttctgcaggaagtaaaaatggctttactaaataaattaaatttatgttcaagtgctatttctttatggtaccgaagaacaaacatttcagagatcagtaagatctagtgctcaagaccgattggccctagccaagagtacgtgacatttcatctatacaggagaaaaaccagagtgtatgggtgcagatgcagggaaatgtccaaatgctacagtgggaactgatggaagtatctaacttgtcatgaaataggaagcaggacatcagccacaagtgaggatggggatggagatgctggaggtttgaagagagaagagaaataataataatacaattatttaggggagagggagaatgatgaaaaagagaactaatggtatgattgttgggagtattaagggttcctctgaagttaattgtcaattttagagtaatcagcattgttaaatatatttctttagtcctgttcaggtacctgggcctcttcttatctcctttctttagtccgttacatttttcagaggggaggttttcagtgggtttaaaaactaatttttggccgagtgtgttggcccatacctgtaatctcagcactttgggaagccaaggcgagcaaatcacttgaggccaggagttcaagaccagcctggccaacagggtgataccgtctctactaaaaatacaaaaattagctaggtgtggtggcgcacacctgtaatcccagctactcaggaggccgagttgggaggatcacctgggcccagggaggtcgaggctgcagtgagccaagatcttgccactgcactccagcgtgagtgacaaagtgagatcttgtctcaaaaacaaacaaacaagccaaaaaaaaccaccaaaaaagctaattttactttttaaatagcttggttttggttgagtttagagcaagttgccttacttatgtaatcctaatgttactttattttacttgagtaaaaaatcagttttattaagctaattttattaacatatttgtagacatttgtagccaaaatgtatgataacatcattagtattcgcttgcagtttcattcagctggttgtaattatttaaatggtatttttttgaattttgcattttataagctaaatctgttgggagattggagctgttctattatgcgtagttctaagagatgaactttctaattttacttttggtgtctagcaaaatgacatttgtttcacaaatgtgtttgtttttctgtcataggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaaggtaagtgttatctttatcagcatatgctattattaagctttctcctttttctcttaagcattccatgtttagaatgtaaacattatacaaagatcagagaggtctgtgggagggaagtgaagcagttctgggcctgtttttttcatgctttatcatactgggcctgttgccttcatagataagtggtccccagcactgcagatccgcacagttctgctatcgatccaggccttgttaagtgctcccaatccagatgatccattagcaaatgatgtagcggagcagtggaagaccaacgaagcccaagccatagaaacaggtatctaatattcattctccttcacaccacttccacttttacaaatttgtattaccacttaaacttttctaaagctcttggcaaggaaaagaaatagaaaaaagtataataagtgagatcctgcttatagtatgtaaatacgtcttaacaaaatggcttgctatgggaccccccaaatataaagacaacctgtaattgaaagatcttggagtctcttgtaactacacctggtttaacaaatactgagtgcataccatttatctagttatatgtaaagaatactggaaaacttgaactgtttttgtaacccatttgattaaagtattcagctgtttatggctacggaatttggagtcaagaagcttctgctacagattttaagaaaattagtggggagaattgtgtatctagaaatggacaacttgattcatcctcttgaattttctagaacttcttaattttattgtagtgttttggtaattggacatttacaaaatctttcagccctgatccaatttatagaaaaaggcgtgaatttaacagattacagcatgacatttccataattaatagtggttgtttgccatttatagtttggaaagtaacatattgaactaagtaaaataataatcgtatgtttgtttctgtctacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacatacaaaagcttttgatgactggtaactggtatccttccaaataaatgcattgcttggtaacaaatgttagcttaattcagaatgaaatagttaacaaccctaatattgtaaaatttgaaaactgatagcagctgtcatttataacaattcttgggctgtttaaagggtacatttgactatagctaaggaaattgaatctcactttaaaaatgaaccacacaaaacttcaagaaacgaaatagaaatcaacatttactgcccgtaatattgctcatggttatagctagtatcacatagtgatttacaaaccatgaaattccagatttaaatctgttgcactacaaaaatgtctaaatgatgtctgctaaatttgtgagttatagaagtacagaaataagtcattttcatttcaaatgcagtgaatttctaatttcatggtatcatatttttttcctttgcagttttggtaagactcccccattactttgctaagacttgctttctcaaccagtgggatgaaacgagtgccagtgtgttgactgagccttcttaggacttaaggggctctgggagaggccaaggcagcagttgaaaactgcagcttcacctggcctttgggcctgttttccctggcccacacagtgtggctggttaaaacattctgaatttgatgccaacatttttaaaaattgggagatttgcatgaaaatccagaattcgggtaacttttgaatgatctgaagatctggcaacagtagacctgacccacctttgtgcacgggacttaactgagaggatctgagtagcagacaccctaagagcatgtcattgtcttctcaccagttactctccagttggctagagtcccctccgagcacacctgctagtccttcccccttgtaagcctttgactttgtaatccctgggctaaaggaaacacattattcaacaaaagtgtttcatgtttgcccactagttgttggggatgattaggtggtgagtgaatggcatggg

SEQ ID NO: 16314 - DNA, 17377 bp, Human
atcaagatcatcctggctaacacggtgaaaccccgtctctactaaaagtacaaaaaattagccaggcgtggtggcaggcgcctgtagtcccaactactcgggagactgatgcaggagaatggtgtgaacccgggaggcggagctggcagtgagccgagatggcgccactgcactccagcctgggcgacagagtgagactccgtcttaaacaacaacaacaacaaaaaagcagtgctatgatcgggtgttaacttctcagtagtacttcaaattatggtgagggggtgagttagaagctgaggaatgggtgcagggaagttggatgtggtatgaatgatctaaaaatgagagcaatgtgccaagtactgtgctgaatcattaagtatgcaatctcttttattcctcatagtagccttaaagttggttggtatcattttcgttttaaagatgatgaaacagtgactgaaaagatctaagaaacttgccgaaagtcccacagctatgtagtgggattgcatagactcctggactcagggtaccaacctgagatgagttgttcaagagcattgacttggctgggttccgtggctcatgcctgtaatcctagcactttgggaggccaagacaggaggatcacatgagcccaggagttcaagatcagcttgggcaacatagtgagactgcccacccccaccccggccccatctctaattaattaattaaattttaaaaataacattgacacaacatggaggaggaaaatagagcaagtggagaggggatagagacttaattccatcagctcccctctttcccctcaccactcttcctttccctgtgtcccgaacccgtgtttctaagtcctgactgctattattctggtgtattaaatacatactatttactatttaatacatcttttgttgttgtttgttttctcaaattttttgtggagacagggtctccctatgttgcacaggatggtcttggactcctggcctcgagcgatcttcccacctaagctcccaaagtcctaggattacaggcatgagcaaccatgcccagcctatttaatacatcttatttaatatatagtataatacgtaaatatgtactatttaatatttaacacatattaaatacaaatggtccccaacttacaatagttcaacttaagatttttcaactttatgatggtgtgaaagtgatagacattgaatagaaactgtacaatattcaataaatgatatctaacactgtcttataaaatatgctttgtgttacatgattgtgccgttataagctattataagtgttccaagtacgtttaaggtccactagtctaagctatgatgtttggtaggttaggtgtttttttgttttctgttttgagacggagtgtcactcttgttgcccaggctggagtgcaatggcgtgatctcagctcaccgcaacctccacctcccgggttcaagcgattctcctgcctcaacctcctgagtagctgggattacaggcatgcaccaccacgcccagctaatttttgtatttgtagtagagacaggatttctccatgttggccaggctggtctaaaactctccgcctcaggtgactcacccgcctcggcctcccaaagtgctgggattacaggtgtgagccatcatgcccggcctaagtgtattttcaaagtgcatttttgacttacaatattttccatttatgatgggtttatcgagaagtaaccccactgtaaatcgaggcgcatctccaatctagaaggcagctactccttaataacccctttcccataaaacatgaatctaaatctacaaaccttgttatataataaagcaagatgtactctgttatgatcagtgtgcacgttagagcaagcactacttttccgatcttaattattccagagatgcttgaccaatttactgggtacgtgggcagttttctgattgctgtttccacactctgctttcccacagagagatttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcaggtgaggagactgacccccttcctggccccaaggcctccttcctgcctggtccccaaggcctccttcctgcctggtccccatcggcccagcgcccacccagccttggcttttgcccgtgggccgttgggagcgccagcgcgggggcgggacgcggggcctccgacctcgggtccagtcctctgacctcggcctcacgtctgtggagtgaagatttgagaccgtgggacagtactgctggaagtagagaggaggagtcgaggctgggagagctcctgagagactgatggtgttttggtggaggattggccaggctacctaccgcttgtggcacaagggccctcaatctgtatgtagttcacttacacctgaacaggctgaggtatgcttctcacacctgggtggtcatcgtaatcaccagggagtcttttttgtataaacagtttgggggttttaaaaagccacagtgagctctcctgtcgctcttcagcccattgggtcaaaacacaaaagttgaacaagtacttgaaagaagtagttggaggccaggcgccgtggctcacacctgtaatcctagcactttgggaggccgaggtgggaggattgtttgagctcaggggtttgagatcagcctaagcaacatagccagacccccatctcataaaaaatagaaaagaagacgaagtagtatttacaaatggagcagaaccagagtccttcctgaggtttcacttggaggctggatggagttggcggaggtatgagcctcccagcaactccgtagtttatgtttatagccagcgagcgctcagagcttccgtgaaccacctcaagtggaaagggttcaatccctattctcaagctttcctggcaagaggagtttcttttcttttttcttttttttttttttttgagacggagtttcactcttgttgcccaggctggagtgtaatggcgcgatctccgctcaccacaacgtccgcctcccgggttcaagtgattctcctgcctcagcctcccaggtagctgggattacaggcatgcaccaccacgcccggctaattttgtgtttttagtagagacggagtttctccatgttggtcaggctggtctcaaactcccaacctcaggtgatcctcctgcctcggcctcccaaagtgctgggattacaggcatgagccaccatgcccagccgccaagaggagtttctaatctctttgggtaatcagacccttttagccaaaggttcgggggcttaaaagagcctgacaactattgagatctggcagctgcctggaatgcagctggagcacagagggtgggaggtgggaaggtgctggggaagctaggagagtcagctggggtcagctcctgcagggcctagtaggcctgggtgagaagcttgtgttttattctaagtacagtggaaaccaatggaatgatttttatgtaaagtgtgacgttttaaaaattaccatcaagctgtctaggctgaagaccttaagaaagaggggtgaagatcatctctgaggaggcataaactactgaggcctctcagtttcagtctgatgctgtttggggaagttacttgtggccttttctcttgaatgtgtctgggtagtggagatgctgtctgcagtggcatctgtttacctctctcctattagcttcgtcagaccatggctaagttccttcaggagcacctggcccccaaggcccaggagatcgatcgcagcaatgagttcaagaacctgcgagtgagttgggaggcccgggcagtcgggggcagtcagggagtggggctgagctgcactgctgcctggaagagctcacacagttttctggtaaatgaagtctctctaagaatgcagcccctctctctgaagtgtttgggtctcattgttccagccacatgtgactggctgccttcccctcaacacttattccactctgctccattctgttggcaggaattttggaagcagctggggaacctgggcgtattgggcatcacagcccctggtgagtatagtgtctttccctaaaaagaacttttcttatgtgccctttaagacagttcccaaaagaagcaggaagggaagggaaagattgtgcttaaagaaacccagaactgcatcttttggacctgtgaaagcacccattgattgtcagcccagagaacaggacactcttctattttattagacagtgatgtagagaaggcagagggattaattaggtcattgtggctcacttggatcaggatcagtccaactcttgaactctgcatacttaataggctcacccaggtgatttgggaagtttagaaaactctggatcaagtggttgtcttcatagtacctcagtcttactgcctcccctaatccctataagctttgtcctaccagtggcctctcggcaggaacactctgggcaggtgtgtccctgcagggactgcctgtgtcctcttctgcttaaaccttggagctcatttgggagcagatagcggggggagtagggtaggggctgggcaggggagagagatgtctatctgggcttccaggtgaggtggccagatgatgtgtttaataggctgtccggagggagaaggcagggagctagcaggctctggtttggatgatattaacgtctgaaagaggcccagactggcttgcagtgcccggtaaagagatgagcctaggccaggcgtggttgctcacacctgtaatcccagcactttgggaggccgaggcaggtggatcacctgcggtcgtgagttcgagaccagcctgaccaacatggagaaactctgtctctactaaaaatacaaaattagctggtcatggtggtacatccctgtaatcccagctactcgggaggctgaggcaggagaattgcttgaacctgggaggcggaggttgcagtgagctgagattgtgccactgcactccagcctgggcaacggagcgaaactccgtttcaaaaaaaaaagcccagcctgcttgggcctgtattcactctgggcatgagagtatgagtggaacccaatatacttctccttacatcctagaaagttatatcacctttcataaaatgaaaccacttgaagattaattgaaaccatcttaatgtaaaagcattaggggaaaggctgctgggtactcctaagcaagactctcctactgtgttttgggggtttatgtaccccactccctgcagacaatatgcttctgaatcagattgtattttacggaagaaagaggcagttagaaatcagatgaaaatggccaggtgtggtagtgggctcctataatccgagtgactcgggaggccaaggcaggaggatcgcttgagcccaggagttcaaggctgcaatgagccatggttacaccattgcaccccagcctggataagagagtgagagcccgcctcttgaaaaaaaaaaagaaaagaaatcagatgaaaactctttcaagggaacctgaaaaagaaagctggttacaagttctggtttctgcatgatgtcatggtggctgtttctaatgtcacctgccttcaggctttccttcctgcagttgtaggggcaggtcaaggtttccttagagcctagaacgagcctgacttattggtcagagtgaacatgtgtataggaccttgctaggcttgacccaatcagcagggctgggggtggtatcaggtgtctcagccacttggagtttggatctgctgccaaggaaaaaccgtatattttatgaggagttctgaaattctctgccagcatctcatctgccctctgctgtacagctcacctcaagattttccctgaggctgtggctctcctgtcctgtcaccagtcctgcttctttctttttttttttttttttttgagacagaatctcactctgtcgcccaggctggagtgcagtggcgcgatctcggctctctgcaagctccacctgccaggttcacaccattctcctgcttcagcctcccgagtagctgggactacaggcgcccgccaccatgcccggctaattttttgtatttttagtagagacggggtttcaccgtgttagccaggatggtctcgatctcctgacctggtgatctgcccacctcggcctcccaaagtgctgggattacaggcgtgagccccatgcctggcctccagtcctgcttctttgggttcagccctatgctataaaatctcaccttcctcaggccttttgcagacacatcagatcctctggctttgtatctgttcttggtgctttggacaccacctccaccccaatgcctttgtttttctccaggccctctttcttcatttattcatctgcctctgcatttctgtaactttctgagtagtgggtgctcaggttgttcacgtatcttcatcaagaagtctgtctgggataaagcagaagttgcaatgattgccttctgaatcacccctcagctgaggagcaccagcaggcaaaaccagtccactgagcttgtaagcaggtctgtggcatcagcttattcttgttgctagagagaatttggagtaggtgctacaaggtgcttcccttctgccgtcaaatgtaagattcttaatgaatgtcccgatttaatctgggctgcgttttccactcccttgtaccacaccactcacagttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaaggtgaggaaatggaaatgtaatacacgctaatctcacagtgcaaccaccaactaaaagataccctctccccttgggggccagtcagacctgctttctgtagcatgctgccatgaaccaaatgtggttaggaaggggccatggattgctttaaaatacttgagccaaaaataataaaaataggaccagaactcttgcattgaacaacagacagacagcatttgaagagaactctaagaaatggaagagtaggactagcttcctttgcaaagggaatggaaaaaggagaggcattttcagccttgtagccattgggcttagaagagacttctaggactttaccgataccctggtctgagagcgaagtttgaaggggtttaatgtggacaggaagaggcagtaccagtgagctgctctagggtactctgaggttgtaacaaggcctgttgggggttttccttgcagctgatcagtggtgagtacatcggagccctggccatgagtgagcccaatgcaggctctgatgttgtctctatgaagctcaaagcggaaaagaaaggtgaggccactctcaacttgggagccaaaatgggcagaggtacagacattatcagggtaatggagcaacaattgtgggtggcccctgctgggtttccagaactttctcaaaggtggacagcttcttgctcagcagaaggtctatggcctggctgagacaggccaagatggcttgagcaaatagccaacatcctgcccttaggaaatcactacatcctgaatggcaacaagttctggatcactaatggccctgatgctgacgtcctgattgtctatgccaagacagatctggctgctgtgccagcttctcggggcatcacagccttcattgtggagaaggtgagtataggtgggtgcagggccaggaggcttctgcctcctgacagtggtaccagagatagcccgttcactgatctcaaatggaatcagtgttgtgtgctctgcaaggcccccagaggtgggggtgaggcagagagcagactgcaaggagggtgaccaaaagtccaggaagtccagggcagatgggtcacttctgaagacggtggagccgtcctcagcgccaggccacacaaagaggtctagaaaggggaggactaaaaggaggtcaggacatgacggtcagggtaccattggtggatctgatgaatgtggccatgggagactgaggtgtgggtgggatgcaagtggagactgcccctgcaacagccttgacaacagaagcaagaaggaagcagagcaggagttccaatgaaaagttaggagtttgggtttgtttttagaaatgagagaactgagcagattttttggtcagaaggaaaaaaaagggaagaaaaaagaaaatagagggagaaattgaaaagtgtgggaatgagtgggcagaacacaatggtgagctggggcagaagagagaaggatgggttacaggtgatggtgcaggaaccacttgcctaacgatcatgaggaggaagccaggggccctgtgaaggctggggccacgagtgggggagttggcaagagtttcatgagcgagtattgtaaaggtttgcggtaccctccatagagagggggaaagtagctgtctagggttggagcagtagggacctggctgagattggaaatctcaaggttgcgtgatgccaccctcattacaggctgaaggcagcatgtgccagcactttgctggtcacttgccaaaacatgctgcaacccagtagtccaggtcaaagtacagagggctcagttcagccctagtgggatccctttgggtacagacaggagaacaacagaggataagggaattgaccgggctggtgacagtgtcttggaagtaatgtcccctgggggagggaaataaggccaggggggtcgggagggctcagggaactgagcatatcattgagaaagaagtgtccccatgagaactggggagaacacaagctagtggcagaggaggctgggatcaatctggggcgttagcaccggaaggtcccggggggagcatgggactaggatgctgccatgctgtgcaggtacagggactcaataggaaggtgggtgccttcttcccagaggcctttcctttaccaggcccccttggggctaatctgcaaccaggaccaccttttgtttcctgtaaagggtatgcctggctttagcacctctaagaagctggacaagctggggatgaggggctctaacacctgtgagctaatctttgaagactgcaagattcctggtaagtagcaccgggaatcggggagcccctctcctgacccccttccaggctgatctggctgttctcaagttgagaaagcctctgggttagagaggcttggcattgttagcgcttcagtgacatgtggctaggctgtgagctggggctgctggacagcgctccttcctggccagggccctgcagcggcatgcctaactggcatcacacactccgcatagggtctgtactcagtagccggaggagaagggtcagacctaccctttcccattgatgtccttcagtcttcctgtactttcgcccatccactgcatgtgagtaactcattaactcacgtttttgtaaaatattttaaaaatgagttattcatttttagcattaatgatgctaagaaaaaaaaacaaaacatctgaatccactgatggaatcccgactcagtagagagaaggcagttctgcttgagtatgagtattttctcccctgaggtgtaactgaaatctgacatggtggagcactgtgggagagccagcacagccatcatgtactaaccagaccaggggcatggatttgttgtttggggtttttttttgttttttttgtttgtttgtttgtttgttttgagaaggagtcttggctctgtcacccaggctagagtgcagtggcgtgatctcagctcacggcagcctccacctcctgggttccagtgattctcctgcctcagcctcccgagtagctgggattacaggcatgcgccaccctgcccagctaaattttttgtttgtttttttgagatggagtgtcgctcttgttgcccagggctggagtgcaatggcgcgatcttggcttactgcaacctccgccccctgggttcaagtgattctcctgtctcagccttctgagtagctgggatgacaggcacacaccgcccagctaattttgtatttttagtagagacagatggggtttcaccatgttggccaggctgctctcgaactcctgacctcaggtgatccacctgtctcagcctcccaaagtgccaggattataggcctgagccaccttgcctggccaggggcatggatttgatcaacagttaggtttgctgtctgcctcagccatataccacgcctatcactgacagcccaaaaaagtgtactttaattacagggagcatccagggagggggagctgtgcagctccttctttgttgacaggaaaaaattcagctagcattaaaggcaggtcagtagtgtcaacctgttttcctgcccacacctcccaaggccatccagtctcctggctttactgggtggagaggtgctcagcagcttctgtcactagctctgaatggcctgtctcctggacaaagaagctttcacggactactctgcagggaggtgacattggaccagagctgactccacctgggggaaagagtaattctctggtttctttataggtgcctgtgtagaaagagtcagggagggattgggtgacttctagaccaattaacttttcttctttcccatccaagggagtccagagagggaagggaaagatctaacaactgtagcctttgtggttggcctcgtggatggggtgggagtcctggcagctccacttctgactggaaggggttcacttgatccttttctttcacctggaaccttagttgaataaaggtcaagtgacatattttagtgccttacttgagagccatgtttccaaatctagtacctttgataaaagtgaggaggctgtggacagctctctccctctgaccagcacttatcctggcagctgccaacatcctgggccatgagaataagggtgtctacgtgctgatgagtgggctggacctggagcggctggtgctggccggggggcctcttgggtaagtgtgagaggcttgagggaagctgggctctgtcggcctcctcggcaggtgacccaccatgagcagcagcagccttccccttgcggggccaaagggagctgcctcttggccctgctctctcctgggagatgaaaggaacctcctcttcccatgttgaatttcttcccacagtggggaaatatcattaagtaacagacaaaaggcctgaggagcagggtggcttactcggctgtgaaacgacacctgggctgtcacgcccctgcacctctggccagtcagtgccgtaactgtggcaagactttctgaagttgcttttctcctccctgggattctggccttcccacgctagcattttgccaccacacccggtggtgggatgaggaggtgcccacggggcctttctcctttctgacaggctcatgcaagcggtcctggaccacaccattccctacctgcacgtgagggaagcctttggccagaagatcggccacttccaggtgagccgagtgcttttgctgacatgtactcttcaactgggctaaagttttctttgaaaagagaggaagtgaggtgggcaccgtggatggttactgtctcctctagcaaattgagcttgactgcttggaatgcagtcttcctcagcatgcagcctgactctggaagtcatcaggaagttcaccacattgccacctcgattcctgtgtgaggtggatgaactagacattgtaaggttggagagcaaagcgtgcaagttgtgggggcagaagggaaagaggttgctatttgtagttagaccttctggtccgaagaagctgctggaaggtaataagcattggagtaaatggtgccttgggagccatgcctttcggaggcagtgatggccacttcggggtgtcatgcgggctgtggaacagccactctgtggccctaactcccacacctgcccccatctccatcatcctgagtaaatcccatctcctctccatgcccctgcttcctcatccttggctgtcttgttgccattgctgacctgcttttggtaactgagagagtgttccagcatgttgacctgtgacatccctttgtgcccagttgatgcaggggaagatggctgacatgtacacccgcctcatggcgtgtcggcagtatgtctacaatgtcgccaaggcctgcgatgagggccattgcactgctaaggtgagggccagcctcagtcggggagaggcgggggcagtgggccagctgctgagacttgctgtctgcgtgcctcgcagggccctgctgaccccagcttcctcccgtaggactgtgcaggtgtgattctttactcagctgagtgtgccacacaggtagccctggacggcattcagtgttttggtgagtgatccccacttcccagtcccggggctccctcactcctggggcctgtggctgcttcagaaagcagtttcagggcgggcgtggtggctcacacctataatcccagcactttgggaggccgaggtaggcagatcacctgaggtcaggagttcaagaccagcctggccaacatggtgaaaccgcatgccgggcatgatggtgcatgcctgtaatcccagctacttgggaggctgaggcaggagaatcgcttgaacccgggaggcagaggttgcagtgaacaaagattgcaccattgcactccagcctaggtgacagagcgagaggctgtctcaaaaaaaagcaatttcctctccacttctccactcctcactatgtgcttatgctaggcccagctgagctgggaccttcgggctctttctgtcccagttacaaggaggaaatggaaagcaaatgagaaaactgctagatgccaggagttgctgctgccttcggcaacacccccctctcatcctccccgcctcatagatgctaggaaatgggaaagggagatgtggctgggcacagtggctcacacctgtaattccaacactttaggagactgaggccagtgaatcacctgagatcaggagtttgagaccagcctggccaacatggtgaaaccctgtttctactaaaaatacaaaaaaaaattagccaagtgtggtggcaggagcctgtaatcccagctatttggaaggctgaggctggagaatctcttgaacccaggaggcggaggttgcagtgaccggagatcgcgccattgcactccagcctgagtgacaagagtgaaactccgtctcggaaaaaaaaaaaaaaaaaaaggccgggcacggtggctcacacctgtaatcccagcactttgggaggccgaggcaggtggatcacctgaggtcaggagttcgagaccagcctgaccaacgtggtgaaaccccatctctactaaaaatacaaaaattagctgggtgcagtggtgcgcgcctgtaatcccagctactcaggaggctgaggcaggagaatcacttgaaccttggatgcggaggttgcagagagccaatatcatgccactgcactccagcctaggcgacagagcatgactccaaaaaaaaaaaaaaaaaagctaaatggaaatttctagaaatagttcataagtttcaaatccacaccatcctgaatagcttgaagtgttgtgccatgctgctctgtcatgtttggtacgtgaatcgtccctttgtgcagcctatctatgctatgtgggctacctgcccgttagtagtcacctagggtatccaatcagctgtcctgatatcagagtgcctgtgttcaagtaactcttattttgctcagtggccccagattgcaagagtagtgatgctggcatgtcataatagttctattttagtatttgttattattgttgatctgttactatgcctagctcataaattaaactttctcataagtatgtatgtatagggaaaaaaacaacatatatatgggtttcggttctatctacggtttcaggcatccactggggtcttggaatgtatcctccaaggataaggaaggactagtgtattccccacacccctccctcttgctaccttttgctgcttttctttaatcaccctctcctcctgtggcctgtttctatatacttggcattctgtttgctttctttgttttgtcaatcacttcctttcttctctgcccaaaccctggttgcaggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggaggttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagctactcaggaggctgaggcagagaattgcttgaacccaggaggcagagtttgcagtgagccaagatcacaccactgcactccagcttggacgacagagcgagactctgtctcaaaaaataataggccaggcatggtggctcaaggtctgtaatcccagcactttgggaggccgaggtgggcagatcacaaggtcaggagttcgagaccagcctgacgaccaacatggtgaaacctcgtctctactaaaaatacaaaaattagccaggcctggtggcacgcgcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcccgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatg

SEQ ID NO: 16315 - DNA, 23928 bp, Human; identical to SEQ ID NO: 12392

SEQ ID NO: 16316 - DNA, 39920 bp, Human
  misc_feature (1)...(39920): n = A,T,C or G
gagctcaagctgcctcaccagcaaatgcctctgtttctgaccaggggcaatgaaataaagggacccggttgagtaactggtttctggtccctgccagcccaggaagccagcacccaccctgccttacatcccatgtgccactctcagccttcgaagcaaaaccagctgagaccagcacctgccagatctgaatgcgcagctccaagttctggggggtgggggtgggggtgagccaaggaggtctggcttctctagggcaagggtaggaaggacagcagggaggctcaccctgagcccggcaggcagcccttcctcctcctccccttcagcaaagaaaggcagataaaaacgtgtttttataaatagctccagccccagctgatttgtaaattcagtgggttttttgtgtcaatgacatcaccttcctccccatggcaacccccgacgatatcaaaattgccaagcaacgttggagcagctcggcgccccaaacgagcaggtcgatgcctgaggatttaatggagaaatcccaaagtgagccggggcgcgcggtggaggaggggcgcgccgcagccggggccgctgggccctgatgggcgggagcggggtggagcggcctcgcctgccaggcagccctgggcgcggggctcggcggccacactctggagacagccacggtccaggcaggtgggggagggcgctgctcccgtcctgatgtgccaggagccgccagcagccatccaggtgactaagccggcccactagcactgagtcaccgcccgcctcgagctgttcttgcttctcctttgcatctgattattttgggagctggaaacttggagctgcacctgagtcccgccccttctagctctcccctccctaccttgggctccaggaagatgggacttgctgtgagtctgctgccaccccctaaagatatggaagacgctgtgggggccagaagtgcccggggggctgtggcagcaggcagagtgcaatagcagatatggtggtcaggctgcccgtgtgtgtcctctggaggtgttgggacagaagggcagtcttgtccgagctgactggagtcctcccgggctggctctgaactcatctcccacggggatgtttcggtaaaggagtggcttctggggtcggagtggcatttggagagcgaggctggattggcttaggctggcctgggcaggtaggtggctctgtgttgggtgtggacccacgtgtgtgtgagtgcgagagtgtgtaagccagtgtgtgtgccgtccccctgctggggacagcagctgggtccagcagagagctggctgggggcttgacaggagtttatcctaactgatgctgggtgggcgcaggccctgagatgggcgtcagggagaggggacgccagacacacggcctgagcagggtgaggagcagctgccagccccggcaggcccaggccctgtctgggtgcacaggacagagacacagcaagatgcccaggtaggaagccgtccggaggggctggccagggtgagagcccatcactggggggctggacagcccatcagctgccccttcattctggcaggcctgggtaccaaggaaacagcttcctaccaagaaccatgtcactctcttatgcagggccagtcagcacccatgtgcgtctctgctgagctcacagggacacattcagtgagaagggtgctggccagggcacggcttccccatgatcaggacccagcgggtgccaccctcaagcccctggtccccacagggcatgccccggtgtgtgtcaggaggaggggggaggtcccttctcccccacacagctggcagctttgcgggcaccagtgagtaagctgccagagggagggaggctgtgtgcccacagtggcaggacaataccaaccaggagccttcaagagaagaggctgggtgagaaaagcactgaggttttcttttcctttttttttttttttttttttttctattttgcctgaagggagtgccgcttcctgggctagagacaagcaccagcctgcagtggagaacgcaggaccccgctgcccagaaggagcagccacggtaaggtccccactgccgctgcgtgctccggattcctgggctagggacgggggtgccaaggtgtccaggctgcctcccacctgggacagggaggctaactccacagctgtgggttcctgggtcaaggggctccactccccacccggcctgccaccttctttccagattgattgtgaaacagtccaatcccagctggtctctggctccctagctagagggagaggtgcttgtttctactcttcctgccccagctgggccaagccagtgccaccgggacacccctatccaaggcccctctcactttaccacctctgggacatttcccttgtgtattcattccacaaatatttagggagcactgctgggtcccaggctccaagtcacaccctttggctgggtttgacctggcacagattctgactctgaaactcagcatcagggcaggttcagggagctgcctggccaagcacggtcactcctcacaggccttggtctccccacccctgctgcagggtggatgacctggtcagctttggggacatcgggcccagtgagctcgggtttataaagcactgggccccaccgggaagcaaggctaacgtcttgtggtctccagttatcctttccctggcattgtacaccaagaggtttgtgccgttctgcctggggtcttcctgaggctggttctggtgggaactgggctgcaggaggagaggatgagcttaggagccgtgtggcccccaggcctggtgggcctgggactcagccccacgggagctggggttgaggcctttggggcaagcaaggagtcccctctgcaggcaggcttccctggcggttgtcctggcccaggcttggaggtggcacctgggagccctagtgacagagcgcctggtcagggaagggtcggcaccagaggcaagcccttctgggagcagctgatttggatggaagctctgtgcacctgagagggggagtgtggggactgcacggcctctccagtgccccgaggacaaactgatgctttgtgagtgctctgggccctcccggacttgccagacacagggagggtgcagtgggtggggtctccagccaaggaaagcccgctctgtgcacaactcctaaggatgaccaaaaagtcccctgccctggaggagcacatgtgctcagagtcaggaggaacccataagtgtctctcatgccagtgaattcccacacctggctcctggatgaggagaatgacccagctgtgggggtatctcatgctgcctcacaaaaggtgactctgtgcctaggagtcttccatgcatgcagagctgagcaggggctgctgcccagttggggtcagaggggcggaggctgtcgagcactaggtagacagcaggccagcagcgggcagcaggttgggccaggagggagcagagagtaggggccagggcaggctgagcaggaaaggaaaaggctgcctggggtcctgagggctcagggaggactccagacagctggccttcttatgccagcccgcttctgtgggagaggccctctgcgtaggtgactgggcagggaagaggctaagacactgaaagattgaattcctcacccaaatggcccagagatgcccaccgcacacagtgtcctgggtgcagaaggcaggaaggactcatgggaggctgtcctgtggactgaagcagaaagtccttcccgtaagatgcgctcgtcgccctgagcaggaaggcccaggctgcggaagcagtgcctgagacctgagcagcaggaaggacaccagtaaagctcatcaggaggcatctggccgcctgcacctaccgggcctcaaggagagagcttatttctgggagcctccttggtagaaagaggtggactagccagcaggttggggaggagcattgcaaatggaagcttctgagggcagaatgagttctgaacttgctgaagccaaggctggccctcctgcccagggcgagcagtctgcctgggcctgggaagttgtccccttctgaggaggtgccctccaccccaccagagctcagccctaggggccaggaagggctaaagcgagaagagtgagatgtgagataaaggggaccgtgtctcttcctgggagggtgtggggtccaggcagcaccttgttctggcgcacaggctgccaagcagatgacagccatggcctgactactaggtgcaagcactggtggcaggaagagggggtggacaaagcaggacagagctcttgccctggggatgctcatagccctgcagcagagcagtggaaaggaaagctgagctgagcgtggggccaaccgcgccagaaacaagcggagccacaaagccaccatcagcccccaggtggcttcgtccttttgccaactctgggtccaactcatcgctgaagttggcagccatgacccatccagcccagataatttataaatttacaccaatactgggcaacggttcttaacatagaactttataaagatggacaaaaaagataagttgagaatgacaaacgaaggaagaagcagcttctatctgcagttgcaggaggaggtgaaggctcggggagatagaccagggcgggaagaggcaggatggtggttggttaacatgaagtcagcagcatgagcctcaggcccggtgctgcctcttcctggtgactcgggcaagttacttcatgtctctgggtctcaatttcctctcctgtccaacagagataattatagtacctatgagttagggttgttgagaggattaaataagataataagtgaatgctctgaatggcatgactggcacatacgtacatgttcagcaagagataactattatcaccgtgatgataactggtgtcagaggaacaaagtgccaggagagaccataccttgttcgggggaatcaggaaaggcttcacggaggaggtgactttgaaagaaccctcctctgaggagaaacaaaagctctcagaatgcccaggaaagctgggaagaaacaataatgccaggtctatttttttcccaaatagcatattgtttgtccactgaggctttctaaggaataacttgagactcctctttctggggtctagacttggaggtcttgaggacttgaagtgggctgcccctagtgaagggatcgagagccgggctgtggccctggccctactccttttggggactggaagcttttttcacatgctggtcctaactgcatgaggaactgtgttctgctgagccccatctaaagcatacacttggtgatgtggcaggcagaggggccagacaaggccacggcaggctcctggatcactctggcaagtagcttagaaatgcctagtaatcgtgggcaaggtgcagtggctcacgcctgtaatcccagcactttgggaggctgaggtaggcagatcacaagatcaagagatccagaccatcctggccaacatggtgaaccccgtctctactaaaaaatacaaaaaattagctggacgtggtggcgcgtgcctgtagtcccagctacccgggaggctgaggcaggggaatcgcttgaacccaggaggcggaggttgtagtcagctgggatcgtgccactgcactccagcctggccacagagcaagacttcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcagcctcccaagtaggtgggattacaagcacccaccaccatgcccggctgatttttgtatttttagtagagatggggtttcactatgttggccaggctagtctcgaactcctgacctcaggtgatccgccgacctcagcctcccaaagtgctgggattacagatgtgagccaccacacccagcctgctttttctacaaaggattatctgttctatgaatttaggaaaggtaatcctaaagcttattcacctaagaaaaacaaggcaaccccagagcatgacaggctttcttgggctgggggaactcacatgtgaaaaaacaggttccctcataactacatgagaggccgcaactgcctcagccccagcaaagggacacctctgctggccagcatttcctacaaaacctcatcacgacacatcaggcagggcagagacccaagtattcacatagggccagtgatgactttttttgacacctgtggattctccgtggcaacctattccccaaaagtgctgcctcggtcagccaatcccagtgtctctctgcctaggcaacaatctcttgtgctctggtctgcccacagcctccatgcactcagctccttgggcctcttgctaaggggctggaagcagagctgtgtccttcaggctgtcaaggacctggtgagggatcctctgggtgtccagggaagcaggttcagaaagctcagttcagctggtgctgtattttgatctctgatcccagtgcagcggggaccagcctactcaactcagtgcagatagcaacaaaccagtcaccttgcccaagacctcctgctgcctgcctgcctgcctggtgaccaggactcctaaaggctgcagcagcagcagcagagttaaaactttaaaaccgggaggactggttctgtggctcagcttcctggcctggagaggctctagcctccattttctttctttcagcttatggaattgtgcaagaaagcacagagggtggagggagcgaggggaccagttatgccacagcctcctgcaccaccagagcacagtctcagatcagcaaagaggagctctgaggaggaaaaggctgccccaggaaagagctggccatctcagattgctgtagcacattcaagccaaagggagtccccggaggatgtttcgtccagcccccataattttagagcgggaaacagaggtccagagaaggaaagtgggtcctgaggccacacagctaactaatggcagagtcagtttccagcccagggatccccagctgcctgcccagcactcttgctacccaggctgaacccccacccccgtgctaccaaggggcccatgcaggagcaggcagcagccactgggtaacttgatggcttgggagaggcggcctggcctgacacattgggaggctgggcaggtccccgctttgctcctattgtgctatttgggtgcctcctgccatccccctgcattctgctagacctgaaaccacagcccagcccacgcttgtcagtcaagtgcttcccgaggataaactttgcacacagcacccaggccactcttggggaccaggccactctctgttgaagagatctaactaatttataaattgattgattgaagttctttttgtcccaggtaacttcatgtcttaggccaaagaagggagtcatgatgagtgccagagatgaaacggagattctggggcaaagggtaggggaggcacctgggaggccctgttcttcaggtgatcttctcattagtgtagacttttgaccccaggcagacatttacatgtccaatagccaccatcagaggtcagttcccagaagcaggaggcctgtcacttgccaccggtcaccaggcccaagctagacaagaagactttttctattccactagagtggatcttgctgatgatgtgtctgggatccagaaaggtggggagaagtagaggtctcagctcctggggagggatggagccagccccgggggaagaatgcaaggccgccagtgagcaggcattcagggctcctgtcgaggagagggtggtcaggacaggaggaggggctgcctcatggatgatgaggtccatcatcctagcagaggctgttgtaccagccactgacgagggtgtggcagtggtgttaccagaaccctgctatgtcagcgttcaaatacatgtcccagcaggccaaccacccctgcagcagtcaaggggttctgtccggtgtgtgccagaatgctagggaagagaggaccctgagaaggatggcagcatggcacagacacgccatgtggcagttagacaggtcatgccttctgacccagggcacatgcagaggtccacagactctgaggccagctagttagtgttcccagggggctgcacagcccagagcctgtgagttttgtgcatctggagctaaggtgttctgcccaaagtgttggaggtgggcctcaggcaacaaataccctgcttcctcacatccccttttcttccttggagcttgggcctgggccctcacctagtcaggcacaggcctccactcccccacactcacctgtccttcctgaaagtcagccactgggctccacgcaggggtgtcacagtcagagccctgctccagcctcagacctggggcagtcactggaaactcagaagagagaagacaagacaatgaaagtttcccattcaaggaggcatccagctgttagttctgccagcaaaaatgccagccagagagctaaactgccagcaaaagatatttggatggaactttggaggccattaagagcaggcactgcaaagcaattgtagcgaaaagatattaaatgaatccatcacgtctctaaaatgagtgtccttaccacagatctggctcttgctgttccccagcccttcccagggtagcccaggatgcacctgggacgggcgccgcagcctgcaatggtccctgcatctgaggagctcctcccaggtcaccaggctccttgggactgtcaggcaggtttagcccccagtgtcagcttgtgtttggggaggatggttttatatattctcgttggcacaggaagcctagtacagatgcagaacctgagggaaaggcaggcagagagagagaggctcgaggttctgctgaggcccagggtatcagcagggcacatctgtacagcagccgggcggggacccatggacttttccaaaacacctaaccaggccctagacagtgctaccccctggcgctgggctctctttccggaacccggggtgaacagacctgttgggttgatttagtagcaagtggtagccttgttttctggacgaatcctgggattctactccatggcacatcaaaccaagctccagtgtgcatgcccagggtcggggaggggagctttctccttggtcccttctgcagctgtgagggctgagggttaagaacctttcaccccgtttgggggtgctgctcctccatagccctgtaccccaatgctctagacttcattattccaccaccttccccagggcgggaggtactctttccattacatgcatcaggaaactgaggccagagacatgctgtaagtcttgcgaggcaagagggctcccgtccgcaggactccatggctctgcagctagactccgtcaacttccctcctgcctggggaccccaagggcctggcagtgtcagctccctcggctcacacttccagatgctcggaggttcagaggtttgcacctccctcttggtcccatcagcagagagagatgggtggtcccatcagggtgaggagcaggaagaagcaggtgctggacagcctggaggagagggggaggaagggattttctcccaagagtgcctctctcccaggcttcgggctccagggtgagtgggcagcgacccctctaggagccccagctccacagggctcctcctgccaagcatccagcacacgtgcccccacctccccggcaggtcctgcttgagggcctgaggcgactgggccatctgggtctgtgaagggcagatgtgggatgcaggaacttcaggcagggtgctggcttgtggccaggaaagcctagcacctgattcctagcagggaactcagtgacagagtgggggaacctgagggcccctctgcccctcacacccagtgccatgtgggggtcctcgcgtgttacacagaaataggaagggacggtcctcctacccgcaccccagccctcttgtgtctcacgtgacagcctgcctgggcagtgatttttttaaaacacaaatgccttatattaaggtctgagttggtctctccccactgcccgttcaaacattccatggcaccagcagcctctaagcagcagagttgagagaaccagctttggggtcggatacacttccgttcaaattccagctcctcccctcagtaactggcttacttagtctttctggactggataacaaaatactatgggctggtggcttataaacaacagaaatttatttctcacagttctggaagctgagaagcccaagagcaaggtgctggcagatccggtgtctggtgagggcctgcttccaggttcagagctggctgtctttttgctataacctcacatgatggaaagggccagggatctctctgggggcctctttcataaaggcatgaatcccattcatgagggctctgctttcgtgacttaatcacctgccaacaaccccgcctcctaataccctcgtattagtgattaggtttcaacagatgaatcttgggggacataggtttcaacagatgaatcttggggggacacaaacattcagtctatagcagtaattatgagaccttcatctgttctttaaccactccgagcctcagtttcctcatttgtaaaatgcgaataataattgtacaggacttccatcccagggttcttgtgaagactaagggaggtagcacaggtacatagctttgtacggggcctggcccacgggaagcatgccatcattggcagccattactatttctattattaggggagggctgagtcgcccagaggaaggagtctgaacggagtaaaagagcttgttagtcgccttcctcatccccagaaaacttttcaagtcatggagcagaaagatgcagggaagggataatgtgtttgtctttctaaaccacaagctgatccctatctttcctctttggccctagcccgagcactcagccctggctgttggcactcagatgttacaacaggccccgacagccacaggctgagggataaccgggaagtgcctgccccacccgatgtgcccaccttgctgccctcccagaccatactggcctgccaatgcctctgagatggcaccactccaagagccatgtccccctgtgaaatgtctgttttgggtgtctcttccagagatcctacccaatttgtagaatgggagtgcctggacaattccttcaaccagaaggtctgtgccagcagccaaggctcctcaaaggaggatgtgcctggagccccctgtgctcagcacggcaacctgggaacaaggccagagggtggcacatggatgctgcaggagacactgtccccagactgctcctgacacttcctgtgctgttgttctgccctttcctcctgggcagggctgagctgggcacggatcagaggagaatagagaagggggagagtcacacacaggaattaatcactcaggacctaccctgaatggatgattcagtgtgtatccccagctgtctcaatgtgtggggagaggggtggcaacggggcggatcgtgcaacccggtgcagctgaacctcatgtagacgagactggaagtgcagaaaactggcgttgtgatggacctgagggattccctagtctagtcttgtatccagttctctggcctacccaactgacggttattcttgaatacctccagtgatgggggactcattacctccttggtcagtctaacttgaccttctgcctctctcaaggccccaaacccactgtagctcccaaggggtgggaggaacccagggtttcctagagttattctctatagggtgaggatgggacttggctagtcgccattctagggtacctaagcctggattcaaaccaaattgaataccagttcatttctggtaataatctaacattcatactttattgtagttctgttcaaaagtactgcttggagctgtgatttgggtatataaggcatttgtagtcaaagaaaataattcacatatgcattcatgaatcagtaaaaataatttagggtgtcgattctaggttagacaatataatgctttcattctagctttggttcatggttcatttcaaatcctcagcaaccaatctctgccacctccacgcagcacattctgcttctgcagccagcattcgaccagtgtacccatgtccttgggtaacgaatctgtggggggagccattctggtatcacctggtccccctcccactgccccctcatccaaggcctagcagtcagcttcctgggtgaccacaggaggtcagagtttgtctaagcgggtcaggcctacagtattgtccactcagaggaaagagaaagaatccgcgtgggaaagacacaaagaggaggaggaggaggcgacagagtaaggggaggagaacagaaactaaatataaatatgtgttggggatgttggggatggcagcagggtatggttagctggctggctcccacaccactgtcccacagcacagagggccagcatctgcacctggcaccatgctttccctaggaaagccgagggcattgggcttgtggtgcagccacacagggtacagacctgtttgggactgtcaggttcccacgggttgcctgagctctattaggtgggcgccttagagtaaattgtgtgaaaccaatacagcctataatgcaaaagattgagccgtgagtagattgatgcgtctaaagaatcagtgaacaaaaataagtggccatagtgacctcagttaatcattgaagtctgaggtgcccaacaatgatttttaaaatccctgcactgtccttggtccccgctctgtgacactggcagtcacccagccaccacttgacggcagccatttggagtccacatgtactgagtttccaagccagaacttcctcagcactcagccagaacacagcctttctctgggggcccaagacaaggagagcaaaggtcttctcacttctttatctggggaagagatgagtgattcctgtcccttcccccagtatagaaaacaccctgtaccccaaaagaaacatggcacaggggcagccaggagtgagccccttggaatggccattctgatcttaggcagggactgctgaggacaagcagaggatgccgactctgggacaaaatcacaggcggaggggctccgaaacaggccctagccgctctgggggtgcgggtctcctgccctaggactctcaggctagaaagtcctcaggactcaggactgcgcaagggctgacaagggaactggaatcccttaaatcccgctttcctgcctgcgcaaggggctaccccagcacagtcttggggccctgtccacatgggacagatcatccaaggtgacaggttttccgactcccgcgtgggctctccaggatgtgtgggtgggcacacgcggcccgctcaggtccgggagagtcggcccgcggctctggagcgtgcatctgcgatgccagtgaacgaggtgattacacacagccggcgctcagctgattctccaggtcgggtctccgcgaggcggccactgggccgtggagccgcaggcaggtccccgcggctgtggccaggccagggcccggaggcgaagggcgggcgggaactggggccaagcaggtggagagaaagagttgagcagcacggcgcccctcgggcagaggggctcctggccaaggccccagcgacacttggcaacttctcccgcgctctgggttcgccgccgcgtcctacctgaggccacaccctgaaatcaaaatcgcggtcaggtgaagccggcgctgcaccaacgtgtaagcgcggcccctcctcggcgttcccgcgccgaggtccctcccgcggagggcgggcccggctcccacgacctcttcgagcgttcctgggcttcccgctccgcaggtgggttccccggctgccccggaggttcgcggcgagaggacgggcctcccaacacgcgcagcccccttcctgggtgcccatgccccgaagttcgggaccagccggcgccaggcgaggggccttgggcgcaggcatctggagctccgcgtccctggagcgggacctccctccgcgggcgcccgcccggcgcggggcattcgcgtccccgagagggcgcagcagtggggcctgcgagctggggccgggtggccgcgccgggtcggagtgtggctggagaggggccgccccggaagcggtgctgcgcccaacgtccccttctccccgtaagccccgcaaggagcctgccgcctcttgcacctgagccaggagttcagtcgggaggcgggcgcggagcggttcccagcgcctggacgtcagccagtcgcaacacccgcgggaacacttgctacatttgccataatgcatttctgatctgtttccgcgcaggcctgcggaggactggcccagcaaggtcccaggtcttccctctcctcagcgcctaagagagaggcccagtgcgggtgaggagtcgcgaggaagaggcggaaggcgccggaaggtgagtgagcgagcggcccccggccctagagccttctgcacccattttgaagagcaggcagggagggacagtgggcaggcaggtggccctcctgggctggctccttcctggtactgctaggcagcggaggtggtcccttccaggtgccgtctctcgatccttagtgggtgcatgttaagtcacttacaccactttgccccatggccccacggtaggctggtagacgtcaagacctcaaatggcccgccctgcccccgggcccatcttcaggtctgatgcctgtcctgggtgagggtgtcaccgcggcagagtgcagggaattcatgccggggaagaggttcccaaacaggaagggtggtggcaggcccagtggctgtgcagggcagggtgggaggcagccgtgggagactcccgcaggagttacaggtgaagctgccgctccacacatcccagcccaccgctcattccccagatctccagacctgctcaggtggcatccgatctggagtgtaggtgctgctgggagcactggaggctaagccatgaagagctcccagggtgtaggttgcgttttctgtatcttgccccattctggaggttttttgggggcttttctgacttgtttttctgggtgaagggggcagaggggctcaggtctgtgtccatgctcgtttttggtggccggtgtggcataggttgccgcattggataagaaaacgcctggttccatgcaaggtgaggttcagcctgcagtgccatgaattctcctccatagtatataggacagtggccgaagacacatttggaaccgaagagagtggggtttgaatctatccagactttgcctttgactccttagacaagttgcttcacttctctacaaacttataaatggcctcatctgtaaaatgggaatgcgaatgccttcctcctcattaggcggttgtggggagtaactgcctcatcagcctccagctgctatgttgggaagggctaagccactccaagttctcccatcctggagagctttgagggcagtctggctgtttggcaagctattgtcagagggtattagagcaaagcaataggaataaagtaaaggtaggggtccttggagggcgagtagtgagagaccctaattcagggtctctggacctcgtggtgacccagggaaggggccattcctggaagaggatctggcttgggcatcagaaacagcagcgccccctgcacatcacacatgttcatgtgttcatgggtgaccctggaacctcaactgttgcctgggatagagggagcctctggcttgagcttccagtcccatctctgttctgcatagctgtgtgatccagagcaggtcacttgacttctctgggcactgggcattgtggatgagcctggagtttggagtcggagagatctgactttgaatcccagctccacacttactgtcttggacaattacttctctctgagcctcagtttcttcatctgtaaaacagagctcgcggtagctacaattagccattagatgtactaataaaaagcacctagcacagtctatccatgtggtgggcactttataagcatacctttcttttcttgcctcctccttctctctccagctccctgctgtctttaaaatgggcccaggaaagcaggttcagcccaactcacaatggtgttgtgagtgtaaagttgtgagtgttaaggaggtgaaatagaggtctggaaagttaagagctgtagaaaaaaaggcaatcttgtgattagggatgccagaggttccttctgcttagcatagggttccaatgccagaggttccaatgcttagcatagggtcctagctaggcattgaggaccctatgctaaggactcagacctctgtgtgcagaggctgttgagaatctagggtaggccgggcgcggtggctcacgcctgttgacacaagtgactgaatgagctgtattactgtattcttttaaacagcagcccattatctctcccctggggattcactggggccagtggtatgggaatagtgacaaaggcagagagcccaaacattttggcaggttgcatgtcatgctgtctgccctggcccatgctgcatctgtctgggtccctcaagtgggacagcagagcctcagggtcctgctcatcctcccagggcctctccgcacttcagcacactgaccctgagcaggttgtttgaatcttgtgggcatccacatgagggccacaacctgcgtctaggaccctcctcccccgcaggtgacagctgagcagaaaagcagatgaaatttccttcccccgtgtattttgggagccaggatagggtgctggggtgccacctctcctgactctcaagtcacgtgaagaggagcagatggcagactcggaccccagtagaggctgaggtgagacagagttcagctccacacaaggatcagcgaggggacagaggggacagaaggcaggggctgcagggggagcttttcatcgctgaatgagttctagcagagtgcgggcagcctcctgttgggaatgccagagggactgaactttgggccaaggggaaggtcagaccccgtcaggagtgccacagatcctgcactaccatctcttctggctgcagaaggttggcctagagcaacacctgtttggaagaagcaaactaaaccacacaggagtgaggatttcctctcgtttaccatggtccccagagcctggagtagagtaggtccataatagatactttctgaataaaggaatactataatttcccagctgggcacggtggtatgctcctctagtcctgaccactcaagcgactgaggtgggagggtgggttgaggccagacgttcgaggctgcagtaagctctgatcgcgccactgcatttcagcctgggcgactgagtgagactctgtctctaaaaaaaaattttttttttgaaacaaacttctgaaagtaaagtttgagaaaaatccttctggccaatgagaatattccagtgaaaggctgtcttctgttcgcggtaattctcagccaaggggtcaggtgaggcctgtcacctgtcagaatgtgtgtgggatgacagttcccaaagggggttacaaagaggtcaagaaaccctgctgcaggtctcagcatgtcagggcccagccctggaggtgacagggtcctctggaggccactctgacaggttggtgatggtagtagagtgctttcctaagttttgtagcactcggggctcacctctgtcttggggctgtgattctaggataggcccttccccagagtgtcttggatgggcctgagaataacagagggtggtggtaggagcagatggccactgcagccaagttcacatcaggtcctgggtcagactcgtgtctgccccttctttgcctctcggcttgaatgagtcacttagtctctccttctctgcataatggagacagtactagtgctacctcacaggcttgtggcgaggagatcacatgtgtgaaatgctcagcccagagcctgctacttccgtcttatgctaggctcttcctgagtgacgaccgtgagaaatatccaaagctcctccgtgagcaggaacagatgctccccctcactgtgcctggagaagctggcagaggtgaattaatccatcccttgtcatctacaaaaatgtcgaggcctacgtaaggcgagtaggccaaggtcacaagccgggacttaggaacaccaagcccaaggtccacgctgagccagcactcgggcttgtggcccaggacttgagccctggtaagcagaccctgagcctcactgtgagaaagcctgggcctgccgcccccctctcaccccctggcaccttgagcaacccaggagctggcccactaggcagcggcctcctctcttcccagtcgcccgcaaatggcagggaattccaccagcttcatttctaacagcttcccagcaatcccagcgcttacacagccagcccaacgctgacccctccgggtggctgcaaacccctttagactcactttctggaagccagcttcccagcctcagcgcgttcttgtgaatcccttcggtgggctgtgtcctttccttgaaagggactcagtatgtgcaaacagcccaaactcactctaggccaggtctggagggtcaggtgggtgaccacgtgggataccaccacttctggtgaaaagcggggtgacgggttaggaggacagctgaggtgggctcataacgtctccaaaggcagttcccaaagaggagttctggaaatgccagagcatgtttgaaacaggcaggtacattcccaagtggtctgtctcgcacagcaatgctcatttgaatgcccatgctctggcttgaggtttaacggcaggcatcctctgtagtgccaccctgcatctgtggggccctgatggctctggtggccctggcatcccagggcctggcccatggatgtctcctctccagggaggagacgttgaggagggtggcccacccacagtgcagctgcttttctcatctgtggacactagaccagccaagcctcagtgccatgctctgggaatccccttgtctctgtggaacagtagcatccgccacaaaacttactcaccccctcctcaagccaagcctgtgggtcgcctggcttcaggctgagcccctacagaggggctgtggatgcatcctgtgctggacagaacacacgcctgctgtttctgtagcttttcctagatgccaggccctgaccatcacagcccccaccatgacctcttggaaacattttactcaccccttgctgagtggaaaaacacctggttccttgcaagataagggtcagcctgcaagttaggacagccccaggccccctggcctctgactcacaggtcagcccaggaaagaattcagcaggcttcttccctggaggggccagccctgtcctacatacctcacgcacatcttgcccgtttctgttcataaagacctccagagagggagaagaaccacagctgactcagtccggggtaagcatggtggacggagcaggggctctggaatcagatctgggttcaaacctcaactcagtcatttcctggttctgtggcctcaggcaagctattgaacctctttgagcctcatctggatttgtggataacaattccttctctcagggttgctgtgagggttaaatgagctaaccctcggaaggggcttagcacataataggtgctcaagaaaagtttcttccctttctgtgtctgagattgctgctcctccaacaccactgtcccgcccctcagtgaccccaggtacatagctccttgaactgtccaccagctccgccctcaggtttactgggggtagcagcatttcctccagaaagtgtgtgccaggaaccgtcggtccccactggccaggctccggctggaggaagccccacagcaggggagcttccttcttgaactggtttgggctggacccttccctcccaggccttgggcatcccctgatgcagtcatgcgttagccagcaggaagatgcctgcagacatccagaagagaaaagttcaaagcagtcctcacacacggcagtgcctttccagcctgaggtggaatcttcagtgtggcctccctcccctgtgttaaggcgaagtgtcagccaggaggggctggggctgtgcccgagctggccaccccgttctgcttgtttccacttcagggtcttaggctcacatcacttctttcaagctgggcaggagaaacggcagggtctggctctctgagggggagtccccttccttcctcctcctggtgtcttcttggaggaaagctcctcccctagatgaattgcgtgcagatggagatgctagaggggcgacagtaacagctggcatggcctgtttgacttaaccttggggccccatggctggtgcagcagccacctccctcagcccagtggccttggagacatggatgggaaaaggagccctggaaatggcaagcggaggccctggctgaccgggtgggcgtgctctgaggacacagcctgatgctggggagaggcagggcatgttttgtcctgggtgattcactcgcgatgactggggcaacactggtcccgttcaggtggatgaacgtctcttaggcactcagcctccatggatcactcttctctgtatttaaaaatattttgtttttggccggacgcggtggctcacgcctgtaatcccagcactttgggaggctgaaggcgggtggatcacctgaggtcaggagttcaagatcagcccagccaacatggtgaaaccctatctctactaaaaatacaaaaattagccggacgtggtggtgcacacctatagtctcagctacttgggaggctgaggcaggagaatcacttgaacctggaaggcagaggttgcagtgagccaagatcgcaccactgtactccagcctgggcaacagagtgaaacgctgtctcaaaaaaaaaaaaaaaaaaaaaaaaattgtttttttttagagaagcaatccgtcgtctttaaggaaaacttagaaaaagagtagaaagatagaatagaaggagatcacctgtagccccaccaggtaaatgggacaactaatatgttgatgtatttccttcaaatagccattgtattcacactgcattgacaaattaccattggcaaaatctttaaaaaccccctacccctaatctatatcatcaagaattccactttcgccaaagtaaaccttgatagtttaatttgtgtctgggacccatgactgtggacaggtttaggccccagcaggtcgtgggatccaggagagaccaccaaatcgggcccctcataatgatcacactagacctgagggaggtgagagtcaggctacgggtacccgccgtcactcccaccagctttattattttacctttcacattgaggtttgtgatctgtctgcataattttggagtatgatatgagctcattcttccgggtttattttttttccatgcagatatcaaattacttcagctacatttattaaaaacatcatccattcccccagcatgttgcagggtcacctttgtcattaatcaaatgacctcataagagtgggtctatttttggattctctcttctgttccattggtctatttgtcaattccgtactaaatttgccaatttttgcctatttgcctattgcctatttgccaattccatactaaattaattattgtagctttctaataaatcttaatatctatttagtacaatcctccaacttcgttcattaagattgtcttggctattcctggttctttatatttctgtatacattttagaatcagttcatcaatttctaccaaaggaaatatgctgggattttgtttgagatttaaattaatctgcaggttaacttgggaataattgacatctttacagtattgaaccttctcatctatgaacattctttaatatctttaataatgttttgtattttccaatataaggactttgtatttttttgttagatttattctagatattttgtatttttaatgtaaaatgatatctttttaaaaatttcattttttttttttgagacagagtctcgctctgtcgcccaggctggaatgcagtggcctgatctcagctcactgcaagctccgcctcccaggttcacgccattctcctgcctcagcctcctgagtagctgggactacaggtgcccaccaccacacccggctaatgttttgtagttttagtagagacggggtttcaccgtgttagccaggatgatctctatctcctgacctcgtgattcgcccacctcggcctcccaaagtgctgggattacaggcgtgagccaccgcgcctggccctttttaaaaatttcatgttgttactggtatgtagaaatccagttgattttttaaaatattgaccttgagcctgggcacggtggctcatgcctgtaatcccagcactttgggaggctgaggcgggtggatcatgaagtcaagagatcgagaccatcctggccaacatggtgaaaccccatctctactaaaaatacaaaaattagctgggcgtgatggcgtgcgcctgtagtcccagctactcagtaggctaaggcaggagaatcacttgaacccgggaggcagagattgcagtgagctgagatcacaccactgcactccagcccgggcaagacagcgagactccatctcaaaaaatatatatatatatattgaccttgaatcagggaccttctaaattcactcccttaatcccagttttatgtagattctcccgcattttctacttacacagttatgttgtcccacacagtgttggcctcaccacatttcagatgagtcctagctgcctccctttaggtggttgattggttgattttccagacctaagtgatggcctctggtttctaaagctctactccctagcccccaaagcctgagctcagctgattgcttctgccaactcccaccctcaccatcaccactcctggccctgggacaccctctgggctgtccttctttcttctccagcctccctgctgcctctgggaagaacttgttccggaatggctcactattagaatggactcaagagaggctcccagagtcagagaccatttgctaaagatgctctccctgtgcatccccacagcaaaagctgagcgcttgggtggggcaggggagttggggagagggctgttctggggtgggtggtggggggcggattcaccagctcttcttcagctgcagtctgtgtccctgcacctccagaagatttcacagagctagggaggagggcgaaacaggcagctcaactaatccagggatagcaggtctatccaagggactgggggaatagacctgctgaataaagactcttctgtagcaaaaggcaaaggctgtaatcccagcactttgggagaccaaggcaggtggatcatttgaagtcagaagttcgagaccagcctggccaacatggtgaaatcccgtctctactaaaaatacaaaaattagccgggtatgttggtgggtgcctgtaatctcagctattcaggaggctgaggcaagagaatcacttgaacccgggaggtggaggttgcagtgagcccagatggtgccactacactccagtctgggcgacagggcggcaagactccttctcaaaaacaacaacaacaacaacaaacaacaacaaaaaaggcaaaggccaaaaggaggaggacaaattttaccaaaccatgatgtatatatggcgaggtccccaggtcccagacccctgacatcaggcatgacccctttgactggtaagtctgagcagaaagtggtttggtgttactcccagacttgtatctgcccaagtgccagtgtctggagggcctgagcttcaagacagggattcaaagagaggtgacatcacaagagaaacaaccgtcatgtatggggactctgcttacttcacacaccctaaaccctatgagctgtctttcattaacccccctggctcagatcatttcagttatttgttcaaaatctctccaaattattagtgggagactccctacaactcatctgcaactcacacaggttgttttattccaaagggcttggtctgtaagggtcctgtacatgtggctctacctctagggggtgttcggtggatcccgaacctcaagacccagaagcatggctgacattgagatgtgacgtgggctctgattgagtcacgcatggtgaattcctagtggggaaccactggctgtccagggtccctgcctttctgccagctgcctcccagatctgcgacctccttcagaacctgccaaaatgactaggaaaatgctgtttccatagcaagagccaaaagagaacatgacggccctgcactccagatcttcgggcggatgagtaatccaagctttcagttcaagaatcatgtttcagtttcttgaagcctggaagtgaccttttcagatacataagaacccagtgagctgttctgagcctcttcagatccaaaagcattcaagaggcagccctggccctgtctgccatcaacatgtgatcccaggtccgggatcccctgaaggcgaaactagagcaaccctttggaagtgtccctccccttcccaggcccccagttccccactctcagatctacccatgctatccattgcaagcctgtgtcacttctgtgtatgcagctcagcacgaccttaggcaaagccagaatcagcaaggcacgggacacaggcttgattgcaggttaagtgttttattgtttgttttttgagacagagtctcattctgttgcccaggctggagtgcagtggggcaatctcagctcactgcagcctcagcctcctgggttcaagcgattctcctccctcaaccccatgggtatccgggactacaggcacgtgccaccaggcccggctaatttctttgtatttttagtcaagacaggttttcaccatgttggccaagctggtctcaaactcctgacctcaggtgatccacccgcctcggcctcccagagtactaggattacaggcatgaaccaccatgcccggcccaggtgatgttttacatagagctccaataccagagagaagagtgtcaaggggaggtggtgctctctgccttctctggagagctttacccctaagttagctgcccctcacccaccccaggctatcctcttggctcagggcctttctggaattgaggtaaagcacatggtaaccatgaaggccctttgggggctccctgatacataatagtcccacaccgggcagcatgtctgtgatcagctggttggctttttattaacgtatcatattaacaggttcaaccatcctgggacaaagctgagttgtaataaaaaaaaaaagccaacaaaaaaataactttaatatactgttggattcaattcgatagttttaagattttcatagttacgttcctaaatgatattgagtcaaattttccttttcttgcactctccttatctggttttaagaatcaaggtcatactcgtttcataaaacaagcttgctaactttcctccctctttccccatttttaaaattcgttgacagacagtggaatgatacttgtaatgggctttggattttataaagacacacccccagagtctgcctgctccacaggggacttggcacaggcaagaagacacctcttttccttgtttatagtctgcactggcttatttatggcacgtttgttgtttctgggactgttctgctgggagccagccatttccctgaggaagcagagatggaggtggagggaagccctaggcttctaggggagctgtgctgggggaggggagggagccctgaacctggtgccccaggccctgctgcagccacccctctttcccgggagggagctcaaccttactctgcacttacaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaaggtaagaggggccggcagggatgaggttcagcctctcccagtactcagacaaccatgcctggctaaacctcagaaaggaccctggaggaaccacctacttcacagctatcagttaatcagctgttttaactccctgcctgtcagcctgccattctctccctgggtaagccagggcgaaggaggctggggagaccctctctgcagggtggtggggttgccagattcagcacatgaaaatgtaagatgctcaattgcatttgtatttcagatgacaacgaatagtcttttaggacgtgtcccattcaatatttggacctgcagccccatagggactgagggctctcccagaccaggagaattttagttgtgagggtcacgactagtagacccaagagcctggtagaaggtggggtcaggggccctatcagggtttggaggctgcgaagccagtgtgtgtggaggagcccccggcctggtgtctcttcctcagagggctgggcacatctctcccagccacccgtggagctagagaatggagccccgccccctgagctccagctccctggcccagccgaccacacccctgggcatgctggatgcagccccatggcactcaccatctgctctgctgacgctgggccttctccccgcatccctgcatccagcacaggcgggacccacggtgggccctgataaattatggaaaaattaatgggtggatgacacagcagggaaggtccttaggtggtcctccccagggcccccagggacattctctgaccctgatctcccagccacccctccctgccacaattgggcagctcccacacactcttttctcttccccctacagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaaggtaagtcaggagcctggcctgcaggtgtccactggggagtgggtgtagggacacaggccttgcctagccttccccttggaggactggcaaagaggctccctggactgcttccgcctaaggcggcagaaatgtgcacggtaacctcttctctaaggagggtggctcgcctcctccttccctcccttcctttccttcttttctctgtggctgttgtgttgtttcccatttctgtcagtatttgttcccaagtgtgtggccataggaaaagctggatttgcctagtccaggggcagcaggaggccgacttgtggcatgtgtgactgcttcagacgcacatttttcttgtgagaaaggaaagggtgaagggagcccccgtggtgacatttcttggcaggcagagtggagcgcacctttttgcttcttccaggccctccagcatcctgttgatagtgacagtaacctcttttcccatttggcagaggaggagactgatagagagagggtgagtcacccccaggcatgatggagagtgagtcagagaaggaaggtggggagtgctctggggctgcctgtccggcccgggccctcttggctcatgactcttgcgtatgaaggctttacaagcacagcagccacttgttctttagctccttcctgggagggtcaaaggcagtcctaagaaacggctgctgacagtggcatgggtaatggagcctcccctccctcctgggagggctttaagacaagcctgggtactcccctgtcatcggtggggtgagtgtggcccagcctgcacagggtgtgggtttggggatgacccggactacaacctctctgggtcactgcctgccagctgaggtactcagagaaagttctgggcggccgcgcgtggtggctcacgtctgtagtcccagcactttgggaggccaaggtggatgggtcacgaggtcaggagatcgagaccatcctcgctaacacggtgaaaccccgtctctactaaaaatacaaaaaaaattagccgggcgcggtggcgggcgcctgtagtccaagctactcaggaggctgaggcaggagaatggcgtgaacccgggaggcagagcttgccgtgagctgagatcgcaccactgcactccagcctgggggacagacagagcgagactccgtctcaaaaaaaaaagagaaagttctgagctttgtgcactctagtcccctactaggttaaaggacagtgggttgggatccccatgggttgtggcttgatgtatctgtgagaggaacacgagcatctgtgagctgcagggtgtctggaaggctgtgcccctggggagactcagccagaaaaccaacgtaagatcaggacagtgcaccctgctgggaaggtgagattcggagcttgacctccctctgtctctcaggagtcctgctgcgaggcctcagggatttggagaaaggggttgtcaacactgggctgggcactcatttgcatctttctgggctcctgccagcaccccacagcagggggagaggcctgtccatccctgcacaatgtactgagtactcaccatgggccactgctgctgggtatgctgggatgtcccccatacttgtgggagcaggcggtagttatctcgagctcagcaacaccatacttccaaatccaggggagtggtttccttctgggcaactcagacacatctttcaagatttctactctgaagccaagcctctcaatggcaagctgagaccccccgagctgctccgggccggggcttctcagcgtcctcactgcaggcgctcaggtcagtccatcctttgtggtgggctctccttgcactgtagcagcctccctggcctctactcactagaagttggtggtaccctcggttggaataaccaaaaatgcctccagacactgccaaatgtcactcgagcacacccattaagaaccactgccttaagcaaattcaataacagatggggagcatcagccttcctcctcctcctccaccaccacctaccccaggagtccccagatcaagccagcagcccttggcactggggctgactctggacacttgcagcagcttccataacagcagttaggccacagaggccatgcagtgtgccaggcatggctgcaggagggtctgagtatagactccagggctcctgtacctagccccaggcagtgaggcctggagtcactctagctaaagagatcaggaagacagggcgtgggggcacagagaccaaagaggcaagacagttttttaggagcttgcagggattagacatgttccacttagagtcagaagggcaaacattggttaagcacctaccgtgtactccgatatatgtcaaggatacatggcaccagtgggattgcagcatgggagtcagcagccacgggcgtcctgcgggttccagtgcctacaggacaaccaaacaacccacagggttatgaggattacatgagatagtacgttgaaggcacttgtcaaagtggtaagccctcaataaatggctttattagtagtatttgagatggcgtctccctctttcgcccaggctggagtgcagtggcacaatcttggctcactgcaacctccacctcctgggttcaagtgatcctcccaccttagcctcccaagtagctgggattacaggcacgctccaccatacccaactaatttttgtatttttagaagagatggggtttcaccatgttgcccaggctggtcttgaactcctgacctcaagtgatccacctgccttggcctcccaaagtgctgggattacaggcacctgagccaccatgccaggccggctttattatttttaaaaatattatgccatggcctctcccctttaggatacttaaggtatagccccctaagcccacagctggggagccatggctcagggcgggaaatgaggcattgctgtaaatgtatgcatgactcttctagtggctttcttcccaagaggtctatcacatgagtaacttcagaattaatccagagcctgtaacaattaattaattctgttgtcgtgtccccctttccctttcttgtgtggcctcacaagtttcatctggtccttgcttgtgattacattgataaaagctccctccctgtggagacaggcagtgaagccaacgaaaggatgctagagaccagaccttgccaggctgaagaccaagccagctccccagactccccagcctatgtcccagactctgcttgtgctgggctcctggctgggccatccctcccccagcctccagacgcaggctccgccctgagcccagccagcacctgcagcagcagcagcagcacagggacctggcctgtggagacagggaagaaacccctacctcagcctgtccacgtggtacccacacatcctcagagtagagctggcccatgcagaagccctcaaggccaggaggggaatgatctcattttacagcctttcttaggagcttcaggatgagaggtcatcagagccacctcaggaggagctttaggtggtccccaagcttctgccccgacccacatggatgggtgcctggagagcatgttttctgagttaagtccacactcaggccagcaggcagcttccttagagccccgagcctttctacaggttgactgtgtgatgcagtgagccctgccccacttccctccctgtccctgcctggtgacgtctcatggaacctctgttcccaggacctggtatcacagcctcagtcatggccatgcgccctccacccccctcacagccctcccagaggctccctgaggccgtaagatcatactgcccacttatgcagagtttctcaaagtatgttccatgggcctcctaggacccagggaccttgttcaaatgcagtctctgctctaggctcccaccgaatcaggctctgaggcgggaagtctgcggtttctctagctccccagatctctgcacacgtccctgcattgtagtggagacaggctcagagaggatgacttgcctaaggctcatcacagggcagagcagcccagggctgggccccaggtcctgacagcccagtccaggggtcccactgctccactacacagtggatggtgacagtgtcacagtgtcacagtggatggtgacagtcaggtgctggcgaggacatgggagaatgtttactgtccaaatgtactcatcagggatggagtgagtccaggcagtcctgggaggattgctagcttctttcctgtgaaggtcaagcacacactcgggtgggcaggcaggtgtgggggtggcagaagtctgccccagcatggctgtcggccagcaggagtgcctattccaccctaagcaggccagggacttggctggagagtagaagccctgaagctgcggggggtcggggaaggaagggagtgagggttgccaaagacactgaaaagactctggtggggcccaaggcccagatttggggtttggggtccctgagcaagcatcccagcccaaacttactgcttgagatttcctgtaagttgtttcagctatgggatcaggaccaggacccactgggcacctaagacaatggcttacatgatgggtttggagaagttcctagaaggctttttctgcatcccctgaagcatccctctccaggtgccctttaaaaacacgtaatccctgggaggggtcatggtgcatatcaccgctccttggggagaacccaaagatgggcgggcacctttcctgtcagaaagagcagaagggcttgggctcggaaaagcaagaagcctcgcaggcttccagggctgggcctgagcagggctcactgggggcccaggctgcccctcagctccaccttcccttcctccctccctgccagagccaatgaggataggccccctaccttctcctccctcccgggggctccttagccaggagtttcatgccagggaggaagtggaaggactcctttagggggtccttaagacatctccccatccccggcctcaaggcttgggtttggctggacctaccctcctaactccagatctctctggcaccagattcccagcccaggggagacacctgagaaccccccagatggtgacacacctctgtggtcctctgtcagggacataacctcccagcacagatttgcaaactccctgctgcaggcacaagcagggctatcgggccccaggtgtggctcccctgccttggttcagggagtggagacacagttgcccactgctccccaccccactgccaggcctcttctgcccccatgggtcctggggtgggggagccttgggagtgaagaatgcctctgacccagattcttcaagcagcctctgagctcagaggaagagtctgcctcacggcagcctccctggggtctagctgtcaatcgcccaggaagaaatacccagcgcaggacccggcggggagctggccttctctgtcttcccaggtgcagcagagcgagtgtaaggagctgtcttgggcctgcccagcctggtgccctgcgggggactgctggcacaggactgtgactgggcttcagctctgtctgaaaatctttgctcagagcacctccctagtttgatctgataccccgcctgaccctgccagagtccagaggtcacggcggccagcccctgcctccgggaaggttattccaaatgctcccacagccctgacccttcctgttgctttgtccctgcagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtgggaggacagggtgggacacagacgggggcgttggggatgggcagtgagcagccagccaggctggacatctgtgagcaggggcagtgggtggccatgcgtctgggcactgtgcctggcactcaggcccccacctgcccccaggtggtgatcatgcgggactaccagcacttcaacgtggtggagatgtacaagagctacctggtgggcgaggagctgtgggtgctcatggagttcctgcagggaggagccctcacagacatcgtctcccaagtcaggtgggcagctgggagggctggaccctgagtgcaggctgccctcaccatggccctgccagggcaatgtggtcttctgcctgtggcccagaagacttgggatgcctgggctcccctgcctgctggggtaactgagacccaggggtcttgggagtggagaagagaaggatagcttctagccaaagctcaggccccagttttcaccagggctatggcctgactgtgctgccaaacagattgcctgggagctgtggggcctagcaccagggactcctactctgctcagccaccccacgacctgccagagctaacgttctctttcatcgggtggccccaccttcctgtccaggctgaatgaggagcagattgccactgtgtgtgaggctgtgctgcaggccctggcctacctgcatgctcagggtgtcatccaccgggacatcaagagtgactccatcctgctgaccctcgatggcagggtaggtcccatcctgtccctggcacagccacgctcccacttcctcctgatccaccactcactcccttttcaaccgcaggtgaagctctcggacttcggattctgtgctcagatcagcaaagacgtccctaagaggaagtccctggtgggaaccccctactggatggctcctgaagtgatctccaggtctttgtatgccactgaggtaaccgttccctccaccccccagacctcccaaaagcaacttggcaactggcagctcttctgctgtggcccctccagtgagctcaccaaaagcagccctggttttcagagtcccacctagtcaacacccttccccctttcgatggggctgctcttacccagtgactttgctgccaggaacgagtcctgcaagtgctttcctcagctcaagggcagaatggggtatggccgggcctcctatgtatgatggcctttctctgagtgactgacagctgtgtccctataggcagtggtcactcatgcaggcagtaactggccacagggcaggtgaccaggggaggaaggagacagacccaccaaggagagctggggccagctgtcccccctccaccactgctgccaccagaacgcagctaccaatgggccagggtctggccatggggtcagggacattttcctcctgcaggtggatatctggtctctgggcatcatggtgattgagatggtagatggggagccaccgtacttcagtgactccccagtgcaagccatgaagaggctccgggacagccccccacccaagctgaaaaactctcacaaggtcagttggcacacaagggtgcgacctcgcagaccccattcctcctgaggcaaggggaccagaacctgggctcccagcatctcccttccactgaagccacagggtctgggctcctggaaaaggctcctctttccccacacaaaacccgcacctgggtgtggagccgcatctacgcacaagttcgcatgtgcgctccgacaagtcgcctcccacggctgtggcaggagagttgctgcttggcagaagggttgctgcttggcaggcactggtcggaagcccagtggggcccatgagcagggaaagccaggacaccagcaatccctgctgtccagggagggatccggagaagcttcactgagcacaaacccttctaacccgtgtcgggagatccataccatgattcgatgtccctgtccatcacggcgagtcggctcatgctccatcgttgcacaccccgacacagctaagccacagcgttccccttaaagccagtataagtgcatggaagtgtatacatgtaaccctttttgccaaatcggccccaaccccgcaggccttactgtggacgccccctgctggcaggtcagcacggggctgctaagtggcaccgccatctggtggccaaaacaagaaatgtctcagagggctgaagcctctcctctaaaatagcaaaaaaacaagagttctgtggccccaacacaaagctggatgggaggaccaacaggaaacatcttccaagacaactggtccttggagcccgcaccgctaaccccaaaattagcatataaagatctccagttggctaattcctcagaggatgtagccttctgcccaagactcagcctcatcccaagatactggctcaaaatgaaccaagataagcccttgctttagactcttaaggcctagagcaacaaagaaatcttccttttcaggtctcactttattttctatttttcagagtacttcctcatccttgacttgtttgtttctgttgttgttggttttttttttttttttttttttggagatggagtctctctctgttgctcaggctggaatgcagtggtgcgatctcagctcactgcaacctccgcctcctgggttcaagcaattctcctgcctcagcctcctgagtagctgggattacaggcacgtgccaccatgctcaactaatttttgtatttttagtagagacagggtttcgccatgttggtcaggctggtctacgaactcctgacctcgtaatctgcccaacttggcctcccaaagtgctgggattacaggcttgagccactgcgcccagcgacctgtttttaaaatctcaaaagccctatgtggcagacagggcaagcatactttatcactagcccattttacagatgagaaaactgaggcctagagaaaactgtgacttgcctgagatcacggatagagccagatctggatcactgatgccaatcctctgccccttccacagagctatagcatctgaatgctgagagccttgagggggtggggagggacaagggaacaggaagttaaaaaaccagcgaattcatgactttcaaacaatgataagtccaggcaatcaggtcaccccgaagtgactgcaaattgtggcttcatcttactgccctgcctctacaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgccaagaactgtgaatggcctgctccaggccatggctgggggcagggagtgaggggacaatttctgagtgaaagagaaagaatggggtcggtggtgaaggtgctctcactttacagaatggagagaacatcgtggtgtgtgtgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagccattgggcttcctgtgtctctgggagcggagaccggccgtcttggaggggggtctcctgtggcgggtgaatctcgtgtagcctcccctcctccccacgtgagctctccagcagccacaccacagaacacccaacttccctggtggcctgtggacccgaaaggagggcagagaggaagggaaacaggaagtgaaaggcccttgggaatgaaggcgatgaaaaatagacggggctacttccccaggggagaagagcccacaaggaaagccagggccctgcgctgcgtttgcggggggtggccgaagtggctgacgaccaccctgtgtgtcagcttctcccatcctctgcgcgctcctcacccccaccccagacctccagctgtccataggaagtggtctgaaaccgcttccagtgggagagcagtccctgcctcactcctcaggactgagggagatggtgtggggttcaaaaagaacggagcagagcctggaaaccagggagcctgggctttcgttctgggggtggggaggtggatgaaattatcttgcaacttccagctcccacacggattcccgcacttccttcctgagatctcccactgcccaggattcaggagcaagccaggagcaaggaaccatgcagcctttctttcactccccagtgcattcacaccctgacaggtgccctggtgctgcggctggccccgcctgtccccccagctcagcagaagcagcacctgtgacttaccttcaggagccagcacagtgggacgggcagggcggaggctcactaaggcaggggcctccacaggaggcaaaggctcggtccatctctccaaagggagccgagggtcaggagtgcttgataaggcaaagagaggccagttctcgcaacggaataatacactggatttattaactattctttgagttctaacagtccttccaccacacagtatcactctgaaagggtgtgcatgtctcacagctcacacacacaccacttctgatcttagggtaccaag

SEQ ID NO: 16317 - DNA, 28136 bp, Human
  misc_feature (1)...(28136): n = A,T,C or G
aataaattggtaagtggagggaaaatagatctaaccaaatgacttgtcttcttaaaaacttcaatgatttcttcagtacctagagaccaaagctccttacctttttttttttttttgagacggagtcttgctctgttgcccaggctggagtgcagtggcgtgatctcgctcactgcaacctccacctcccgggttcaagcacttctctgcctcagcctcccaaagagctgggattacaggcatgcaccaccacgcccggctaatttttgtagttttagtagagatggggttttgccatcttggccaggctggtcttgaactcctgacctcgtgatccgcccaccttggcctcccaaagttctgggattacaggcttgagccaccgcgcctggcctctccttacatgttttgttgttgtcgcttgtcttttgagacaaggtctcactctgtagcccaggctggagtgcagtggcccatcatagctcactgcagccttgacgtcctgagctcaagcagtcctcccacctcagcctccgggatagctgagaccacaggcacaagccaccacgcccagcttattttattttatttttttttgagatatggggtcccactatgttgcccaggctggtctccaactcctgagctcaagcgatcctcccccaccttggcttcccaaagtgctgggattacaggtgtgagccaccgtgcaggccttatatgatcttcatatcctgaactaaatgtaaccttccagtttcggcacttgctctggcacttttcctccctcgccagataatactaatctttaatcatgtagttcgtttccatgcccatactaccctatttgcttataatgtcttccacttcgcccaagaaaccctactcagctagcttgtggtgttgttttgacacagtctcgctctgtcgcccaggctggagtacagcggcgagatctcggttggctgcaacctcctcctgagttcaagcgattctcatgcctcagcctttcgagtagctaggattacaggcatgtgccacaaaacctggctaatttttgtattttttactaaagacgaggtttcaccacgttggccaggtttatctccaacccctgacctcaggtgatccgcctgccttggcctcctaaactgctgggattactggcgtgaaccaccgcgcccggccctactcagcctttaaaaccggaatcacgggtcaaaactttctggtaaaccacgatacggtttaggttatgaaattcaatgcccccttcctctgaactcctgcaaatctccagtaaagcaccacagattgacgaatattccagccatttccctctcccgtacgctagctccatttcccacttctatccatcttctcgagcttcctcagctcctccacctccatgaggcctggaaagcaccttgctccaggaatgcgagtaggaggctcagagcgaccagaagtgccaaaagctgacattcagatactgccgaaacaaaccacaagagcgctagggcccccgctaatagtccagctgcgatggtgagaactcgcggacccgccggcgatgcatgccgggagatgtagtcccgggccgacgcattacctcttgggagtcgtggtcttcgatctggtaaacagaagacggcaactcggttaagtcttcccccaccgccccctgaaatccctcgccccacccgcgagggactggggtaggagtaggggcgttgccgtggttagcctcgaactcctaggctcagacgatactctcgcctcggcctcccgagcagctgggactacacgcgtgagccaccgcccccggcataaagtttgaattagtccttacgcaaaaagggaagagggcagtctgtaaactcgcgcaggatcaagctctcgagctcccgtcttgggttagcgcgcagggcggaagcggggagaaggcggatccgggaggcggggatacgttacgtcgacgcgggcgtgaccctgggcgagagggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgaggtgagtgtgtgaggcgcaggctgggccctccagagccgcggctcgtcctcgcccacctgcgtcctggccggtccagtgctcagcggcagttggggcctccgcgcgcagtgtgaaacccggacgtggcagggcgtgtccgcgcccgaccgaccctcagctgctggggcgaaaacacaagtggacctcagtctttagaactaggggagaaacattagagcctttataggcaacacctattttatgggttcgagcgagaagtccgagatcagagcggtgtagccacagctgtttaatatcacagccagggcttccggattcctgatctgtctttccattacaccgtgcttagaaagtaccaatctccgattgccaaaacagtgttttcatcatctaatgcggaaaaccattcacatgatgcctagagaatgatctgaagtgaggtttggttttcttaaaactttttttttgagatggagtctcgctcttccgcccaggctggagtgtagtggcgcgatctcggctcactgcaacctccgcctcccggattcaagcgattctcctacctcagcctcccgaggagctgggattacaggcccccaccaccacgccgccaggctgatttttgtatttttagtagagacggggtttcaccatgttggtcaggctggtctcgaacttctgacctcaggttatccacccgcctctgcctcccaaagtgctgggattacagccgtgagccacagcgcctggcccctgtttttttgtttgtttgtttgtttttaacttctaaagcgaaatgtaatatacatgtagaaaaattcacattcacaactgtatacaactccgtgaattattacaaaatatactggccgggcgtcgtgtctcacgtctgtagtcccagcactttgggaagtggaggcgggaggacgattgagcccaagagttcgagaacagcctggtcaagatagtgagacccgcatctctacaaataggaaaaattagctaggcatggtggcgtgcacctgtaggcccagctattcaggaggctgagaagggaggatctagcctgggaggtataagctgcagtgagctgtgatcaggccactgcactccaacctgggcgatagagcaagacaaaatgaatatacacctatgtaatcaccacttaatagaatggtcctcagaagccttcctgtgtagtatttaatattttcccctttttacagtggtaactgctatactggtttctaatgagatgaactaatgttgcttgtttttgaattttatataaaaatacatcaggagtgttgagtgtttcgttgtttcacatgcttgccaacacgatatttttcagcctttttgattttaactattctgctggttacacagtaatgtctcaatgtgattttaattttcctgattaataatgatgttggacatctgttcatatgtttttgcccattttgatatcttctgtgatgtgcttgttcaaatctcttgcctatttttctattatctttttcttactgatgtgaagttctttatatactggttatcagccctcagttatgtttgtgctaaatgttttctctactgtggtttgacttgtcactctcttagtggtgtcctttgatgaatagaagtgctgaatttatttttttattatttatttatttatttatttttccttttgagacagagtttggctcttgttgcccaggctggagtgcaatggcacaatcttggctcaccgcaacctccgcctcctgggttcaagcgattctcctgcctcagcctcccgagtagctgggattacaggcatgtgccaccacgcccagctaattttgtatttttctttaatagagacaggatttctccatgttggtcaggctggtcttgaactcctgaacttaggtgatctgcccgccttggcctcccaaagtgctgggattgcagacgtgagccacagtgcccagtagaagtgctgaatttaaatgtagttcagttttcagtcttttcctttttggctagtgcgttatgcatccagtttcaagaaatctttttctgtcccaaggttgtgaaaataataagtgttactttgtttttgacagacgattgtacatatttatgagatacaagatgatatttctttttttttttttttttttttgagacggagtctcactctgtcgcccaggctggagtgcagtggcgcgatcttggctcactgcaagctccgcctcctgggttcacgccattctcctgtctcagcctgccaccacgcccagctaattttttgtattttttagtagagacagggtttcaccatgttagccaggatggtctcgatctcctgacctcgtgatccacccgccttggcctcccaaagtgctgggattacaggcgtgagccactccacctggcccaagatgatatttcaatacatatatacattgtataatgaatgatcaaatcagggtaatcagcatatccatcagttcacttaaacacttgtcatttctctttgtgatgagaacattcaaaatactcgcttctggctattttgaagtatacattacattagtgtttactgtagtcaccctactgtgaaatagaaccctagaacttattcctcctatctaactgaaactttgtgcctgttgaccaacctctctccttcctgccgccccctgcaacagctgcattctcctcagtctctggttaccactgttctatttgttccttgtatgagatgaacttttttttttttgtttttttttttgagacacagtctcactctgtcatgaggctggagtacagtggcacgatctcggctcactgcgatctctgtcttccgggttgaagccatttacctgcctcagcctcccgagtagctgggactacaggcgtgtgccaccacaccctgctaatatttgtatttttagtagggacggggtttcgcatgttggccgggatggtcttgatctcctgacctggtgatctgcccgcctcggcctcccaaagtgctgggatcacaggcatgagccaccgcgccccgccaagatcaacttttttagattctacatatgagtgagatcatgcagtatttgtctgcaaacacatttataatgtataatggggtatataaaaataagtaaaacttggcccctacactgaaggaatataaagcaggagaacagagaggcacaataagagaatggccttggcttttcctaaagtctttttgatacgactagctagatagaagatggggagagagatgcaccttatttctctagtgtttatactgataagcatttgtatttttcagtaatggcaatgcagatgcagcttgaagcaaatgcagatacttcagtggaagaagaaagctttggcccacaacccatttcacggttagaggtatgtggttagttgctaattttggaattatatactagattcttctacctagtggaaggtattacaacctttacataaaatataggtttactaccaaggtcaagacccaaattagacttttcagaagtgttgtcaataatcctgtggaaaggctgcagatcattgctaaatatgtctggcagggcctcttcctttgtcaacaattctcttcctactttatcatttttatttctgagagttggactgtcagaaactaaggcctaggatcccatggtggaatctctgtgctgtttttgtttgtttgtttgtttgtttttgatggagtttcgctcttgttgcccaggctggagtgcaatggcgtgatctcggctcaccgcaacctctgcctcccaggttcaagcgattctcctgcctcagcctcccaagtagctggaattacaggcatgagccaccacacccagctaattttatatttttagtagagacagggtttctccatgttggtcaggctagtctcgaactcctgacctcaggtgatccaccctctttggcctcccaaagtgctgggattacaggcatgggccactgcgcccagcctgtgctgtttttttgtttgttttttaagaaatgggtcttaactgtgttgaccatgttgatcttgaactcctggcctcaagcagtccacctgccttggcgtcccaaactgctaggattacaggcatgagccaccatgcctggccaaagcatcctgtgctatttgcactaagtatgaaagtgctgttctgggaattatagcggcctggaccagttatgcaaggaagacagggaagcaccttctctccattaacctagatttgtgctgtcagctgtcattggcagagagaagggtgtggtggtgttatggtataagagacaagctccaattcaggattctgcacaagaacattaagcaccagagctgaggccttacactatttctgcccattgtatagagactgccctgtgagtgcagctgatttgggctaagtaggaggaaagcagagaaagacttgattcttctgtctctttttttcatatttcccatctctgactaatcttcaagactctagaagttaggagtgcaaaaggctaataaaaaaaaaagactctagaagttacttaaatggatttgtgataaacatttgaaagttcagagtcataacttctggtgccatgagcatccttatactcaaacatgcatattgcttaaatattaatagcagacatggcttatgttggcaaactaatctctcccctcttctaaattctcccaacccctgaatgcacccacattcacctactaactcatgttttcccagaagtcatggttttggtggctaatgaaaccaaagctgacttgaatataggaagaaagaggtgtctttgggtggtttgttttgagaagaggtataaaagtccctgacaaaaagtagttttcctcactgttaatgtcagttgttagagcagagctttctggtcattgttcaacaaaaagtattgacaggccaagatagtgctctttatattctgagcagccttatctatttaccctaccatagtgtaaaaatacagttttttatgtgtgcttgatgtggaaagtgttgagcaacactgtcttaaagtggtcttgtagggcccaaggtctcagagatcatttagggtcacaaaaaaaggttgggagttactttttaattccaattgctaataggagttctttttaatgtacatggcttagtgctagtttaaaattattgattttgataatgaaaaggttgttaatttgttattaagtacctcatatatagggctcatttttcagcttttgcatataataacagtaggctctctgtatctccggattctgtatcagcaaattcaacaaactacgtatcaaaaattcaatcaactacatatcaaaaaaaagtatacaggaggatgtacataggttatatgcaggtaatacgccattttatataagggacttgagcattgttggattttgttatctgctgggggtcctggaaccaacttcccatctccccccgcccccccaaggatttcaagggacagttgtattacaagtcttcaagcacctctgtgaagtatgtaggacacataacatctgtgttagattagagaactaaagcttaaatttatccatggttttcttcatttgcagcagtgtggcataaatgccaacgatgtgaagaaattggaagaagctggattccatactgtggaggctgttgcctatgcgccaaagaaggagctaataaatattaagggaattagtgaagccaaagctgataaaattctggtaagtactgcttacttaacctagggaggcattagtgggaatagtacaaaagggaatgtagtgaaagacttcttccttctatctcttattcttcggtcatctcattatcctttccaggggtgactgttacctgtttcttttcttcttttcttttcttttcttttttttttctttctttttttttttttttggagacgggttctcgctctgtcacacagggtggagtgcagtggtgccatctcagctcactgcaaccttcacctcccaagctcaagcgatcctctcacctcagcctcccaagtagctgggactacactacaggcacatgccaccatgccggggtagtctcgaactcctgagctcaggcgattcacctacctcagcctcccaaagtgctggattataggtgtgagctactgtgcctggcctatttatttttctagcttcatatagttctttaacatacatacttccccatggttacattttgttttatgaacctatttcttcagtgtttatatagttacacagttttattgcctttacccttgaagttttatgtagtataaagcagatttttttttttttttttttttttttgagacggagtctcgctctgttgccaggctggagtgcaatagcgtgatcttggtctactgcaccctccgcctctcaggttcaagtgattctcctgcctcagcctcccgagtagttgggactacaggtatgtgccaccacacccagctaatttttgtatttttattagagacagggtttcaccacgttggccaggatggtctcgatctcctgaccttgtgatctgcccacctcagcctcctaaagtgctgggattacaggtgtgagccaccgcgccccaccgcaaatatttatttataaaattgtattttcacgtatcgattactgttagcgttagataaatttattggattactcaaatgaatatttgctgaagtggttgcttaattggaaataagggttctgagtccctaacagtatttttgttaaaagattgtcatattgactaagccagtaggggtccctaaagtctttctgttttcgctttttgggtatcagtttttgtgaatgaacaaatgctgaccagattttttcctttttccttgcgagattttggtttcagaaatcaagtcacttctctgtttctatgaacacaacaatgcaaacctagaatacatgatttgagatgcaatatggtatagacttacgtgtctttacttttcaatattttatgttctttgtttctggccagtaaagattatgattgtattgtttgttttctgtttttttttgaggcagagtgtcgctgtgtcacccaggctggagcacaatggtgcaattttggctctgctcactgcaacctctgccttctgggttcaagtgattgtcgtgcctcagcctcccaagtagctgggaatacaggctcccaccaccacacgtggctaatttttgtattttcagttgagacggggtttcaccatgttgcccaggctggtctcaaactcctggcctcaagcaatctgcccacctcagcctcccaaagtgctgaaattacaggcactagccactgtgcccaccttttttttttttttttaaagaaaaaaaagaaaagtctcactctgttgcccaggctggagtgcagtggcatgatcaaagctcactgcagcttcagcttcaaactcctgggctcaaggaattctcagcctgctgagtagctgggactataggcacatgccactagcctgaccatttctaccagttttgtctttgctaatacattctcctgtttttcaccaaaggaagtagtctatattccttgagctcccatggcttgttagtacttctcatattacccatcacatctacttgtactatagttattttgtatagtttatctttctgattaagttataagctctgtggaggcaggaatcagctcttctttttctccatatccttcagagtccctgggactatgtttcatacgaagtaagtgtctagtacatgtttgttgcactgaaatgacagtgagtatatgaattggccaggctggtctcaaaatcctggcctcaggtaatccgcccatctcagtatcccaaagtgctgggattacaggcgtgagccactgcacctggccgtgcaatgaatttttaaatgaaatattaagtatatagaaaagtttagagaataaactttcattgatttttcagctatttgttgattttttttcttcatgggaaatttaaacattatgaaagtttaatctttttactttctatgggtctatttagattttcttcttgagtgagttttggtagtttatctttctaagaatttgcttatttcatctaagttacctaacttgttgacatagagatgctcacagggtttccttatactactttttatttacataaagtcagtagtaatgtcccctctttcattcttgattttagtaatttgagtcttttctctttttttctcgggcaatgcagctaaaagtttgtcaattttgttgatattttcaaagaaccagcttttggtttcattgatttttctctattattctgccctctacttaatagtttctaccctaacctgtattatttccatctttctgcttgctttgttttgtttgcttttctttggaaggttaggttatgatttatcttttttatttttagaggcagagtcttgttctgtcacttacgttggagtgcagtggtgtgatcatagctcactgcagcctccaactcctggctcaaacaaaccttctgcctcagcctcccaggtaactaggaccacaggcacgccccaccatgccctgctatttattttattttattttatttttgagacggagtctccctctgtgcccaggctggagtgcagtggcgtgatctctgctcactgcaacctctgcctcttgggttcaagcgattctcctgcctcagcctcctgagtggctgggattacaggcacgtgccgccatgcccagctaatttttagtagagacagggtttcaccgtgttagccaggatggtcttgatctcctgacctcatgatctgcctgcctcagcctcccaaagtgctgggattacagtcgtgagccaccgcgccaggccttttttttttttttttctgatgcagtctcactctcttgcccaggctggagtgcggtggtgtgatctcggctcactgcaacctccgccgcccgggttcaagcagttctcctgtttcagcctcctgagtagttgggactacaggcgcacgccaccacgcccagctattttttgtatttttagtagaaatggggtttcaccatattgggcaggctggtcttgaactcctgacttcgtgatctgcccacctcaccctaccaaagtgctgggattcaggcatgagccaccatgcccagccatgccctactaatttttttttttttttttgagatggaatctcgctgtgtctctcaggctggagtgcagtggtgcaaattcagctcactgcaacctccgcctcccagattcaagtgattcttccacctcagcctcccgagtagctgggactacaggcgcgtgccaccacgcccggctaatttttgtatttttagtagagaggaagtttcaccatgttggtcaggctggtcttgaactcctgaccttgtgatctgcccacctcagcctcccaaagttctgagattacagaggtgagccaccacacccagccaccctgctaattttaaaacatttttagagccagggtgctgctttgttactcaggctggtctcaaactcctggcttccagcagtcctcccacctcagcctcccaaagtgctgggattacaggtgtgattcaccacacccagccttcttttctaatatagctgtttatagctatgaatttctctctaagcactgcttttcttggagcccatacgttttggtatatcttcgttttcattcattgcaaaaacattttctgatttcccttgtcatttcttctttgacttgttgcttatttaggagtgtgttgctttatttttgcatatttgtgaatgcacttacttttcaattttagaatcaacccatagtgctattacagaacacttatctgtaattacaaaatagaatgtgaatgttctcagccagacaatatgaaagaaaaggtacagctgatagaggtggggaagtagccatggagagagaaaagattgaagggcaaatgtcctcatttttacaaagtaggaagttaagggatacagtctgcggttgatggagcaggaaatgaaggtgtactgtattgtcatttttgtcataaattgggcaaaacacatatgtacggatctctaatagttttttgttttgttttgttttgttttttgagacagagtctcgctctgtcccccaggctggagtacagtggcgcgatctcggctcactgcaagctccgcctcccgggttcacgcctttctcctgcctcagcctaccaagtagctgggacttcaggcacccgccaccacgcccgactaattttttgtatttttttagtagagatggggtttcaccatgttagccaggatggtctcgatctcctgacgttgtgatccgcctgccttggccttccaaagtgctgggattacaggcgtgagccatcgcacccggccggatctataatagtttttaaaactatattaatatattaacttgaattggcaatttaaaaattgatcttcatggaatctctgaattagattatccttttttatgactttctaaagagaaatcatcctggtaattttatttgatattttctcttcccattgcacaccttgttttactaatatttcttttttctttatatatatttttttgccatcaagatcactgtggtaaggaatattattttgttgatttaatatttcttatttttcccaggctgaggcagctaaattagttccaatgggtttcaccactgcaactgaattccaccaaaggcggtcagagatcatacagattactactggctccaaagagcttgacaaactacttcaaggtgtagtaatcctttatcctgtgttgtgaactctagttaggaaagcttccaggttataaaacaaaactgaaatatttgtgtagcatttccttgttagataatgataaagagatagaggaaggccaggtgcagtggcttatgcctgtaatctcagcactttgggaggctgaggtgggcagatcacctgaggctgggagttcgagaccagcccagccaacatggagaaacctattaaaaatacaaaattagttgggcatggtggcacatgcctgtaatccctgtaggtgcacatgcctactcgggaggcagaggcaggagaatcacttgaacccggaagacggaggttgctgtgagccaagattgtgccactgcactccagcctgggtgacgagcaaaactctgtctcaaaaaaaaagagagataaaggaagtatccacattgaagaggtaagactgctgcaaggtaggaccttatttataaaatactaaacttatctgcaaattaaataatttagtctccatttaatattgtgttaagagagtaagctccttttgcttaaggaggtaactgtaattataacctactctaccacagggttgaaaacctgatgactggttaaaacattccatgtttgaatactactcattgtgtacacactaatcttcaggacttcagggaaaactataaagcttttgaccttattatttatttttcgagacagggtctcactctgtcacccaggctggagtgcagtggcatggtctcagctcactgcaacctctgcttcctgggctcaagtgatcttctagcctcagtctccccaagctaggactatgatcatttaccacctggctaattttttttttttttttttttttttttgagtcggggcatcactcattatgttgcccaggctggtctcaaaatcctgagctcaagccatcctcctgcctcagcctcccaaagtgctgggattataggcttgagccaccttgcctggcccaatgtcaggtttctttcccttttttttgagacagagtctcactctgttacccaggctggagtgcagtggcataatctcagctcactgcaacctccgcctcctgggttcaagtgattctcctgcctcagcctcccaagtagctgggactacaggcaagtgccaccatgcccagctaatttttgtatttttagtagagatgaggtttcaccacgttggctaggttggtctcgaactcctgacctcagatgatctacccgcctcagcctcccaaagtgctgggcttacaggcgtgagccatcatgcctggcccccaatgtcagttttctaatatcagtgctatactatcattatgcaagaggttaacactgcagaaggctaggtgcatagaaatttcgtatgtttttttttgttgttgttggtttgtttgtttgttttttaaagacagagtcttgctctgttgcccaggctagaatgcagtggcacaatctcggctcattgcaaccactgactcccaggtttgagcagttctcctgcctcagtctcctgagtagctgcaatgacaggcacccgccaccgtgcctggctaatttttgtatttttagtagagacgggatttcaccgtcttggccaggctggtctcaaagtcctgacctcctgatccatccacctcggcctcccaaagtgctgggattacaggcatgagccactgtgcccagcttttttttttttttttttttttgagatggggtcttgctatgtcaccccggctggagtgcagtggcatgatcttggctcactgccacttccgcccccaggttcaagctattcttctgcctccgcctcccgagtagctgggactacaggcatgcaccaccatgcccagctaatttttgtatttttagtagagacagggtttcaccatattgtgcccagcttttttttttttttttttgaggagtctcactttgtcacccaggctggagtgcagtggcgtgatctcggcttgctgcagcctccgcctcccaggttcaagtgattctcctgcttcagcctgctagtagctgggattacaggtgcccatcaccagttccagctaagttttgtatttttagtagacatgaggtttcaccatgttggccaggctggtctcgagctcctgacctcaggtgatcagcccgcctcggccccctaaagtgctgggattacaggtgtgagccaccgcacctggccttatttgcagctatctataaatctaattatttcaaaatacttttggtttatttgtttgtttgtttgtttgttttgaaacagggtctcactgtgtcacccaggctagagtgcactggcacgattttggctcactgcaacttctgcctcccaggctcaagtgatcctctcaccttagctcctgagtagctggtactacaggcatccgccaccatgcccggctaatttttgtagagacagggcttcaccatgttgcccaggctggtctcgaactcctgaactcaagcaatccacccacctaagcttcctaaagtgctgggattacaggcatgagccaccacggctagcctcaaaatacatttgtgaaaaattatcgcttgttggaaattgaatttttaacttacataaacatctttctgatgagctccaagaacatttctatgactacagtttctacatgtttgtattatgctaagagttatttcttatcgcttttttaggtggaattgagactggatctatcacagaaatgtttggagaattccgaactgggaagacccagatctgtcatacgctagctgtcacctgccaggtgagctgttggggctatagctaatcaaataagcaagcattacttcattcctgctatttgcaagcatctgttaggatggccataaaaggtactttctctgtcctcaagaatcttatagctgttaatagttagaagatagactcctacttcaaaatccttccatgtcatagaaacttccaaatcattgatctcctatcagatacgttaatttcaaatacttttgctaccaggccttttcctggctttacttgctactttttttttttttttttttttttgagccctaatcttgctgtgttcctccagttgaagctcaggggggcgatcttagtcgtttttccccctcttttcttttcatttgcttctttttttttttcctccccactatcttaaattactgccgcccaccgtcatgcccttttggggtttcgtttttttccctttttctgtatcctcctttcccttgcggcactttaacaacccctgatctctatttccccctttaagcttccttacccccgtttattaactccccttccccttttatttccctgactctcgagagtttatttatctaccttcctgatatgttcattttacattatagctgtcccttagcccttcattaatccacccttaattatattttttcttattcttccctttttcaatatttcaaaccggtccccaatgggccgcttttctgctaaaaaaacctggttccannnnnnnnnnnnnnnnnnnnttcaagtgattctccttcatcaacctcccgagtacctgggattacaggcgcccaccagcatgcccggctaatttttgtgtttttagtagagagggggtttcaccatgttggccaggctcctcttgaactcctgatctcaagtgatccacccaccttggcctcccaagtgctggaattataggcgtaagccactgcgcccagccctccatcttcttcattagtctagattttatgattcatcattaaagtaattctcttgcagatagcctcagtttacatacccacttgaagagatgccaaccttagatgaaactcatctatcttctcagtgtctgtacccaaatagctgattatactggagaaaaatcgtatcatacagctgactgacttcactttaaattcaagatgacaggccaggcacggtggctcacgcctgtaatcccagtactttgggaggccgaggcgggtggatcacttgagatcaagagtttggctgggcgcggtgactcacgcctgtaatcccagcactttgggaggccgaggtgggcggatcacaaggtcaggagattgagaccatcctggctaacacagtgaaaccccatctctactaaaaatacaaaaaattagttgggcgtggtggcgggtgcctgtagtcccagctacttgggaggctgaggcaggagaatggcgtgaacccgggaggcacagcttgcagtgagccgagattgcgccactgcactccagcctgggcgacagagcgagactctgtctcaaaaaaaaaaaaaaaaaaaaaaaaaaaaggaagaagaaaaaaaaaagatcaggagttcaagaccagcctggccaacatggtgaaaccctgtctctactaaaaatacaaaaattagctgggcgtgttggcacgtgcctgtaatcccagttacttgggagactgaggcaggagaatcgcttgaacccggggggcagaggttgcagggagctgagatcgcaccattgcattccagcctggtcaaagaagcgagactctgtctcaaaaaaaaaaaaaaaaaaaaaaagaatgaaaaaaggaaaaaaattcaagatgacaaaactttagattaacattcaaaacttcttggcagtctactttctccatttaggtgtactttcccactgagttagacaggcatctcatatctcatacttcgtcttctgttatcagaactttatgctcctcttcaactctcattcttagccaaaaacctaacctgctctttgcatcaaatctacatttgtgcccatcttttcttatctcaggttacaattgagaaagtgtcccttttcttctcaaaggcccattctatcaatatgatttggttaccatctcctgccaccttctcaaggactctactccttccattttctcttgtacctctctatgagattatcctcatcagtatacaaatatgtctagtgtctcctccattaggaaaaaaccttccctggaccccttcagtttctttttcctttacttatgctcctattggtgggaagatttggaaatagacacagtaggttaaataattgcccaatacattgtatttaagtagcaaatactggactcaaaccagacttcagagatgatgttcttaaaacttcataagaggccagcatggtgtttcatgcctgtaatcccagtactttgggaagccaaagtgggaggattgcttgagaccaggaatttgagaccagcctgggcaacatagtgagaccctgtttctgagatgccatttctaaaaacaaacaaacaaaaacagacaattaaaaatattagcccagcatgatgatgtgtacctgtggtcctagctactcaggaggctgaggtggtagaatctcttgagcccaagaggtcgaggctccagtgactgggatcgtgccactgcatgttttctgctgtattgctagtgcctaaggcagtgtttggctctcagtaaacaataaatgcttgaatgagtggagataatagatgtccaaaaacatgcctgatatataaaatgaatgtcacagaggaaatgggttagctgtttaaggaatagaaaggggtaatttcaccctagagtgatcatggaatactttatggagaaaagattttggaccagacttctgaagaatgctaaatttgggaaggaaggaaattaaaagcatttaactgtatagaatgggatgaacagaggatgggaaggcataagttagaaggaaaagacaataaataagcaaggtcatttaactggtttagagtttgtgtagaaaagttgtaggagatgacccttaaaaagatacatcaaactgggcatgatagctcacacctgtaatcccagcactttgggaggccacggtgggtggatcgcttgagctcaggagtttgagaccagcctgggcaacatggcaagaccctatctctacaaataatataaaaattagccagacgtgggctgtgcctgtagtggcagctacttgggaggtggaggcgggagaatcgcttgagcccaggaggccaaggttgccatgagccaagattgtaccactgctctccagcctgggcaacagagcaagattttgtctccatctcaaaaaaaaaaaaaaaattaagatcctatttcagaaggttaagaagtttaaacttgattttatgaagagtaagcattagctggtcaggaaactaagatagtgacaataaagagaagtagggaaaagatgttgtaaagggcagcgcttgatgactgacaataaaaaatacacctcagcccaacaatgtattacagtaacttagtaaacctaaaaagtgtttgagaggggaagacagttttgttggaaacatgagtacaggtttagagatgacaggtttgaggtgacaaaccccgagtgaaaatttctagctgtattgagagatgtggaactaagtcacacagagaagtaaaaatggaatctggaaacgaaagatccatgagaaaggaagggagtaggatatagaagagaaagctaacaaactttcatcttttctgcaacttcaggcagtgtaatggggagccgtttttccttgtctaagtgagtcttaatgttctctggctttaaggatgtgctgcataagtggccagtccacaaagtatccttgaacgtggcccatgcccatggaccaactcttctgttataatcttttgaagctttattataattttagttattttgaaaaacatggcattattttaatctagatagattatacccacttctgccatgggcacaacttactgttggagatcaaaacaactgaaacaaaatctgccttatatcagtgttacagaagaggcttcctagtgtttttctatcctcgggactcaactctgttgagtttttttttcttttcttttctttttttttttttttttttgagaaagagtcttgctctgttgcccaggctgtagtgcagtggtgtgatcttggcttgctgcaacctctgcctcccaggttcaagccattctcctgcctcagcctcccgaatagctgggattacaggcatgacggccaccacgtccagctaatttttgtatttttagtagagacgaggtttcaccatgttggccaggctggtctcaaactcctgacctcaagttaatctgcccgccttggcctcccaaagtgctgggattacaggagtgagccaccgtgcctggcccaagtttatttaaatttaacatcaagtaacctagcttgatagcctcccatttttcttattttcctttttttttttttttttatttgagacggagtctctgtcgcctaggcaggagtgcagtggcgcaatcttggctcactgcaacctccatctcctgggttcaagcagttctccagcctcagcctcccaaactgggattacaggtgcctgccacccaacacagctaattttttgtatttttagtagagacaaggtcttgctatgttggccaggctggtcttgaactcctgacctcaggtgatccacccgcctcagcctcccaaagtgctgggattacaggtgtgagccaccatgcccggctttttgttgtcattttaattgtttattgctccactgatattttctttgcagaccaaaatgttacaatttttttttttttttttgaggcggagtctcattctgtcgcctgggctggagtgcagtggtgccatctctgctcactgcaagctccgcctcctgggttcacgccattttcctgcctcagcctcccgagtagctgggactacaggcgcccgccaccacgcctggctaattttttgtatttttagtagagacaggttttcaccgtattagccaggatggtctcgatctcctgaccttgtgatccgcccaccttggtctctcaaaatgctgggattacaggtgtgagccaccgtgcctggctggctgccatatgtcttatgagacagccaagctagcatgtcagtatcgagtagacctaatccattgttaactctcctcagaaataaattcttttttttttttttttttgagattgggtctcactatgttgcaccggctgttcttgaactcctgagcgcaagcaatcctccaacctcagcctcccacatagctgggattacaggtgaatgcctctgcacccagatcctcataatcattaggaagaaagagctgagggggaggggtggaggaggatgcttaggagaccttttatgataataagggaggaaacattgagaagaggaagagtaagttatagaagctatagctattgcgtgagctccattagaaatttgatagctaaagggaattagggctgtttaaaatgtcactcttacatccgtcatttgacatgatatgtgacctttttaaatagaaatgttttcccatgttttgacagggacttatgtagaataagtatttagactacagtacataatatctatagttgccatggcaactcagcatagcatgctgacactccaaagttgtacaaatagaatcctaatctgagaatgtttaagtagtcagataatgtctgtcaacaataaactaaagcaaaattctcaagtaaatatagcctgttaaaataacatttacagatggctgaacaactatatagatcgttgactttttttaaagaaaaagaatgctaattaattaataatagaaaagattacatttcatcagcctaagagctggaaccagggatatagagaggatgttagactattacttaaatctaaatattatctactgtcatttgttttctcaatttaatgaagtaaaaccccattatatgttaggtctctctctaatagaaaagtcataaagttgagagctacagttaggttacaaaatgaattagcccatgcttgttcaaagtactgcagtagttttaaaattctgggccgggtatggtggctcatgcttgtaattccagcactttgggaggctgaggccggaggattgcttgaacccaggagttccagacaagactggggaatatggcgagatcccatttcaattaaaaaataaaaacagttctgagaagacaatttaacataagtaccagttttaaaagcacatgcccatgcgggcatggtggctcacgcctgtaatcccagcactttgggaggctgaggtggatggatcacaaggtcaggagttcaagaacagcctggccaagatggtgcaaccctgtctctactaaaaatacaaaaattagccaggcgtgggggtgggcgcctgtaatcccagctacttgggaggctgaggcagagaattgcttgaacctgggaagtggaggttgcagtgagctgagatcgtgccactgcactccaggcctgggcaacagagtaagattctgtctcaaaaaaaaccaaaaaatcacaaaacaaaaaaatcacataccctttgacagaaaatttgtcttacagaacatttcacatatatgcaaagataaatgtacaaataatttataccaaagcataattaaaatggtaaaagttagaaacatactgcatcactataaaatgagaagtgttaaattatgctcctaagcagttattaagaagagctaacctgatggtatcccaatccagtaacagaagatggctatgatggcactgggagggcaaggtagaaagggccaaataagctggagaacagagcatgcaatccatccccatgatcttaccctgggagcttgtccactatcctgttgtcagtctacctacctattcccaatcatctgtggcctttcctttgccaaggaagtctattcaattggaaaagaatcccctgtcatgttagcacttaatattacctggaggtaggagaaaggagaacttcgttcatcttatttcctggggacttagtccccagagtgttaatatttcctcctctccaagaaactgaggcagattctgctctctgtcctcttggccactggttccaagtctttctttaggcatgaccctcttttgttgtatatgtgtcctttgctccttccatggattcccatgatgtgagagattttatctgccaaatagtaacgtaatttttcccttccaaattaacaaagccttccgtaactgtatacactaaagtcagtgccctaaaggttgggaaaatcatgtcttcagagtgtaccgtgctaaacgctttacatgaattattttatttagtttttaaaacaatcccataaggtcggttttatttacattttacagaaaaggaaacaatattctcagtcacatagtaagtggaagaaccacttatataaaagaagtatatgaaaatgcatagaaaataatctgggaaattatttctgggagatggagagtggtgaagagctttcagttttttctccgccacttcctctttttttttttagacaaagtctcactctgtcacccaaactggagtgcagtggcatgatatcgctgactgcaccctccgcctcccaggttcaagtgattcttgtgccccagcctcccgagtagctgggattacaggtgtgcaccaccacgccccactaatttttgtatttttagtagagacagggtttcaccattttggccaggctggtctcgaactcctgacctcaggtgatccactcgctgggattacaggtgtgagcccccatgcctggcctctctacttctttttttttttttttttttttgagatggaatctcgctctgtcacccaggctggagtgtagtggcacgatctcggctcactgcaagctctgcctcccaggttcacgccattctcctgcctcagcctcccaagtagttgggactacaggtggccgccaccacgcccggctaattttttgtatttttagtagagacaaggttttaccatgttagccaggatggtctcggtctcctgacctcaggtgatccacctgcttcggcctcccaaagtgctgggattacaggcgttagccactgcgcctggcctccggccctctacttttatattgtttagatttttaatataagcatatagttgttttgtaatttcaaaaaaaaattctcaaagataagaaagaaaatttgggctgggtgcagtggctcacgcctcccagcactttgggaggccaaggtgggtgaatcaccttaggtcaggagttaaagaccagcctgaccaacgtggagaaaccccatttttactaaaaaatgcaaaattagccgggcgtggtggtgcatgcctgaaatcccagctacttgggaggctgagggaggagaatcccttgaacccgggaggcagaggttgtggtgaggcaagatcatgccattgcactccagcctgggcaacaagagcgaaactccgtctcagaaaaaaaagaaagaaaaaatttggttctcctaggcctttaacataaaatgttctaaaggattttcctcataatttaaatgggaattatgactccaaagtagatttctagagtagaaattaccctttagcatcattcacttaaactttgtagaaaaattcaaaggtatctggtatggaatgggtagtctaaagcagagatttccttgagtggctcataagacagttttcatggcatttcatttacttctcttttctttcctttttgttttctctttaaaattctttctacttatttttctgttttctccaattgttcattttaaacatcttgtttatactattggagtaaatatgtttttttcttctttcttgctcacactcgaaatttgctatagacactccgagggcattgactagtccctttagtacccctaaagaatgaactgctcaataaagtgaagtataagtttgatatagacatgctaaaattaactgggctttggatcatggcccattattgattaaagctaaggtaaatggtcttccaagtttctgtacttttgaattgatcagtcttgtgttggtatgcagttctagaattttattactggccaggtgtggtggctcacgcctgtaatcccagcactttaagaggccgaggcgggcagatcacttgagtccaggagttcaagaccagcctgggcaatgtggcaaaaccctatctataaaaaaatttaatcgggtgtggtggtgcacacctatggtctcagctatttgggaggtgagatgggaggatctccagagcccggaaggcagaggttgcagtgagccaagattgcaccactgcactccagcctgggcggcggagtgagaccctgtctccaaaacaaaaaaaggccaggtgcagtggctcgtgcctataatcccaacactttgggaggccaaggcaggcagatcacctgaggtcaggagttcaagaccagcctagccaacttggtgaaaccctgtttctactaaaaatacaaaaattagctgggcgtggtggcatggacctttaatctcaacaactcaggaggctgaggcaggagagttgcttgaacccaggaggtggaggttgcagtgaaccgagataacgccactgcactccagcctgggcaacagtgagactatcgcaagaaaaaaaaaaaaaagaagaaaagaattttattacctactttgggctatatttctaagcagtccagttctgacaggactagctgtatgtactgagacacaatcagctttacatatttttctagctgtatttctattaatatcagaagggaatgcctccttcctaccactgtcatttttaaatgtttttttccctttgccttggaggaattataaagatgtcatgaggagcttggtcagctgtatcagaaatacaatgttcatttctactgttgtttttgttctctatagcttcccattgaccggggtggaggtgaaggaaaggccatgtacattgacactgagggtacctttaggccagaacggctgctggcagtggctgagaggtaggttactggtttagataagagagactatggctacacttatcaatgtagtgattgccagggttagtttggccgaagaatgtctcttctataaccccacgtcccaaagttgtatgtgtggttcaaaagaatgacttccttagtagaaaaaggcattcttttttttttttttcttcagatggagtctcgctcttgtcacccaggctagagtgcggtggcgtgatctcaggtcactgcaacctctgcctcccgggttcaagcaactctcccacctcagccttcctagtagctgggattacaggcgcacaccaccacacccagctaattttttgtatttttagtagagatggggtttcaccatattggccaggctggtctcagactcctgacctcaggtgatccacctgccttgacttcccaaagtgctgggattacaggtgtgagccaccgcacccggccagaaaaaggcattctttagagttgctgtcagactggatttaaaaaaaaaaatccaactatatgttttcttccagagaaaccctttagaaagtaaaagaatggagaaagatattgcatgcaaatagtaaccataagagacactgcgtggctatactaatatcagacaaagtacactttaagacagacacattggctgggcgctgtggctcacgcctgtaatcccaacactttgggaggctgaagcgggtggatcacgaggtcaggagatcgaaaccatcctggctaacacagtgaaacctcgtctctattaaaaatacaaaaagttagccgggtgtgttggtgggtgcctgtagtcccagctactcgggaggctgaggcaggagaatggcctgaacccgggaggcggagcttgcagtgagccgagatcgcgccactgcactccagcctgggcgacagagcaagaatccgtctcaaaaaaaaaagacaaacacattatatacaaagaggaacattttataattaaaaggtcagtttgtcaggaagatataacagttgtaaagatacacacacgcctaacaacaaaaccccaaaataacatgaaacaaaaactgaattaaaggggaaaatagacaactcatcaataatagtaagggaccagtttttcattttcattaatggatacaggcttcaatatttcactctcaataatgaatataacatgtatcagaggccctgctaaagggcatctgtgaaaaacctacaggtagcatcatactaaatggtgctctgttacccaggctggaatgcagtggtgctatttcggctcactgcaacttccacctcttgggttcaagtgactctcctgcctcagccaaaaattagcctggctaatttttgtatttttagaagagacagggtttctccatgttggccaggctggtctcaaacctgacctcaagtgatctgcctgccttggcctcccaaaagtgctgggattacaggtgtgagccactgcacccggccttaatggtgaaattctgaatgcttttccccctaaagtcagtaacaaggcaaggatgcccactttcactatttacattcagcaatgtaccaaagattatagacagtgtagtcagacaagcagatgaaataaacggcatccagattggaatggaagaaggaaaactatttgctaatgacatggtgccatatgtagaaaatcctaaggaatccatccacaagaaaaactagaactaaataactgttcagcaaagttgcagaatacaatatcaatatacgaaaatccattgtatttgtatatactagacaataacaattcaaaagtaaaacttgaaaaaaaaacttcattcacagtagcaagaaaaagaataaaatacttaggaataaatttaacaaaagaaatgtaagatttgtacagcaaaaactctgaaacattactgagaaaaattgaagatttacataaagagaagcattccacatcatggatgggaaaactcaagattactaaaatggcattcttggccaggtactgt

SEQ ID NO: 16318 - DNA, 80004 bp, Human
  misc_feature (1)...(80004): n = A,T,C or G
tccaaatttttattatcatttaaggaaataatttgcacaatgggcaaaatcaaattttattgcatacataataatattaatagttatcatttaagactactaggactgcactaagaaaggccatctaggctgggcgcggtgggtcatgcctgtaatcccagaactttgagaggctgagacgggtggatcacttgaggccaggagtttgagaccagcctggccaaaatggtgaaaccccgtctctacttagatgggcgtggtggtgtgtatctgtagtcccagctactcgagaggttgaggcaagagaattgcttgaacccgggaggcagaggttgcagtaagccgagatcgtgccattgcactccagcctgggcgaccgagcgagactccgtctcaaaattaaataaatgccatttttgatttttttaaaaattaacgactttaaaatgacagtttatagctcctcctccccattcaggatccaatcaaggtcatatactgcatttcattgtcatgctttttttttaatagcttgaggtaaaattcacataccaaatgattgacccatttaaagtgtgcaatttaatggcttttggtatatgcacagagttgtgcaaccatcaccagaaactagttttagaacaattttgtcaccccataacctttagctgtcactccccaggttcctcatttccccaaccctatgcaaaccaccaatctactttctgtctccatagccttgcctactctgagcatttcacatatgtggaagaatacaatgtgtggtctgtcttctttcccttcacgttttgaaaggttatccatgtagcatgcatcagtatcagtacttcattcctttttatggctgaataatgttctcttgtatgggatactttatactatttatcaagggagggttttcaacagaggagtggcctgatccgagtggcatttaacaaggttcactttcctgttgttctaaggagcagagaatgatcaactgcgtcaaacgctgcttttagggaaaataagatgaggcccacgaattgaccagtaagtgctcaaataggttaagggaaaaaggaatttaattagaagacatattctgatatacattgctgggagtgatttttttttttttttttttgcttcatgtgaaatttattcctcaaaaaaaaatcattttttctaaacgtaactcaacattatagtaattatgcaagattttatgcagcttcaagagttagccaagagaaaagttgactcttgcaagaagatattttcaatgtctatgcagatcaggtaggtaagagttaagtgcgggggagttggcatcatctaaaagactgtagaaattggaccaaaaatgtggagttctaaagcagtatctccttatggcatgccattatttggagcaacaaggttacctactcgaatcactggatcctgagttgacacaaaacgcatctgttgactcagggtttgtataaccacgtgcagtatttactaggctatccaattctgggtacgtacaacttctggggcctgcaaattattggagagtgagtgaggggcaacgaaagatagacataaaagggcgcgtctcgaaaggtaactgtcaacatgcactccacgtttatagaacgattcagtgggcgcggtggaagcgttaatgaacatttcagaaaataaacatatggaacatcgaaattcacttgcagataatggactaagtccgctccaccgggactaaaaaggcagggttaggaaagcctgaacgccgccacactgttttttctccaggaagaaacggggcgtggggctgccggtagaagggggtggctccggccgctcccccgcgccgtcctccggccccggccgcgctgcgctcacgccggccgggccgggaatttggagaggatccctggtcgcgcggcagcggcggcggcgcgcgggtgagcgggtgagcgtgtgagcgggcgggcaggcaggcgagtgcgccgggtattggcagctgaggagtggaggctgggcagctccgactccctgacgccagcgcgaccagatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccacacggacgggcgcgccgccaacccggtaaaacgaaacagacccgaaccgaactttcccttcatgccgcgtcccagccctcccctcggcgccccgggctttccagcgccgccgccgccgtctctgcacgcgtggggccgccgcggtcgtgctgggctgggggcgcgggcagcggcgggaagggggctctttctgcgcggggcgggccgcgaccccccccccccatgatggcgcctcccgtctgctcggaggagcgaacctgctaccacgtcttctcgcgcccagcccgccgggctcccctggtgtctttgttgggtcttctgctgtgggaagcccagttcccgggcccccgagcctcggctcccgggcctgaccgcgctgggatctccccggccgcgctccccttccgcgcgctcctcacatctctcccgtgctgccgccgggccgaggcccgttcgcgtggcccgcggacccattgtgtcccccgcgccggcggggcgacccctgcgggagctggaggacgaccgctggcgctgctctccaaggcgcctggtggagcgggtctcgcgggcgggggaccccggcgccccgggcccctccacatcccgcacgggttttcttctcggccccagcaagcctctttggggtcgaggtcaaggaaagttcgcaccgagatcccctctaatttattcaaaggtttggcggcggcgcgtaattttttccccctcttccgcctacacccgctgcgtctcctggtgtctcgttcctttccctttaccggagtcgattgcctcactgcatgtgtattcgtgagttcgcggttgaacaactgttcctttactctgctccctgtctttgttagtgtttctcggggttgtttctgtaggaaggtgggggtggtgggcgtgagagacagatgtgggcttgtttttctagttgctgaaactgtatgaaggctttaaagggagaacgttttcttgatgtgctttaggaggggaggaggaacaaatgcctgccagatctcacagctacagtagctgagcttttgtttattttgaagagcatgcaatttttaaatacacggtgcaagataaccagtaaaggcgcgttccttctgaaaattgaggccggtctcagaaccatctcctgagaaagcatccttttcgtgagtgctgagacaactgtcctttttctctgccctcccccctcttttctttccattgtatctgaagtttcaaagtacgtggaatgatacagaagttgcatgatttctgttatttcttcctgttgctgaaactctcagccgctaaatctcagaatgcctctatttcagaacatctctgggtctaattgcctgttgtggataacttgcccacacctcagtaacacaatgagaaaactgttccctgcccatgttgatttttcaaattgtttgtaattactttaaattgtattgaaggtaggtggaccgtgttaaaaaagaatcggaacagaagtgttcactgccccagcattttcaattggtataaatattgttgcatcagtgttattctgatgtaggtgccagatctaaatatgctgtactgattaaagtgtttgttctgccctctcccactctctttcccatttgcaattatttgctatttctgtgcaggtggtgtatcattggtgtaatactgcagttcttaggaaggtgtagctagggtcgtgagagatgatttttctggaggtgggtgatgccagagcctctagaggatccaggcaggatcgagtttcttctgagggtagggatttgtccttgatttagttttgacccctacaaccataggtatgtaaccaaatacattttacctcttgcagtatcctttggtttcgtatccttgaagagctgatgacctttgtgttttagagaaatgacaatttttaggcaattaaagacattggcctcttacacttcttggaattttatgttatttttactaagttcattaaggcattaagaggaagttgtcacattttctcaactacgtttattacatttattagttaaaaactaaatttcactttgtaattttgatttctagcaattctgggttaaatattaaatctaataacctagtagattggaaaaagaagtagcttgggtatagtaattagactagcatgtttaagctgcagtagcctacataatcaaggccaagtgtgtgtgtataaaagatctcatttgtgtagtcttacaaggctaatggaggcatcactgaggctttataaataatgtaagttgggtataatgtagagtctccagagacggcagagaaagcatcattaccagccttttcaacctgcttgagatcttaaattgatttacagcactgaactggtgcaaaatgatacatcaggatgacatggggtcagcctgtaaaagtctatgatgtcagcctattagttcagtcatcataattaaaccatattacaggggtagctaagcaggagtctggcgttatacttcagatatgggtggtacatgggttttgtttatagtggaaaggctgagatggccagggataccagtgtgtgtgaaagagggaaaaggcttacagaactatgaatttctgtagaaaaatttaagataaatgcagagatattcaatctgaattgtataagtagcttttcatttggtagaggagaaacagatgctttagggatgctgataaggacctttgcagctctgatatgtgtactgaatgcttcatgtgagtttgaatttaacttggccttagggaccttataaaatatcagtggaccacatacttaactttgatccttttattacccctgaattttcactgtattgatatctactgacatgttatttctttaactagtcaaacttaccaggcctataccagaaacaaagatatttgaattgaacatataaacagttcaggaaaagaagatccttattttgcttaagtttctgacaatccttatttagcttatggattatctagggctctgctatcctagccatagtcacacgtagctttttttgaaattttattattctatttttttgagacagggtctctctgtgttacccaggctggagtgcagtggcacgatcatggctcactgcagcctcgacctcccaggcccaggcagtcctcccacttcagcctcccaagttgctgggactacaggcactgccaccatgtctgcctgactaatttgtttttgtatttcttgtagagacagggtttcgtcatgttgcccaggctggtcttgaactcctgggctcaagctgttctcccgcctcggcctcccaaagtgttggggttacaggtgtgagccactgcactcggctacttatagctatttaagtttaaattaaaattaaataaaaattcgttttctcagcagtagccgcatttcaagtgcttagtagctgcttgtggttagtggctgccatactggacagcgtgtatatagaatagttccatcatcacaggaggttctgctagccattgctgccccaggacctttacctcttctcacttgttaactctactaatgatttgtggagtcaaagatggaaagacatatataaactaattttatcactaactagctgttctttttaaaataaaacacaatttggaagggacagttgaagctactggataaaaggagtttgacttttctgtagatcttatttattattagtgtcatcgattctaatttggtttagagccttagagagaagaaataattgtagctaacccttttttctgaatttttactgtatgtatgccaggcattgtttataatacccatatctcatttaagcctcaaaacttccataagtactattgttgtcacattttacaggtaaagaaactgaggacagaatgattcagtatcttgcttcaggaggtacagtgaatgattatgatttctaatcttacctgggatatgatcgaggcagtccaactctagaaactccatcttaactatgttttttggtctttcgttcagaagacccaaatcatcattgttctgctgtgctttactatgccagtatagacatgacttggcttgtgtattttgtaggtctttaaataaatttaccttctattgtgcctttctgggctatcttctgtcgttcttttgtaagtgtttaagaaaggaaaaataatgctcatctaagcagcacataatttgaagaataaatctggcatgaaaataatgcatttcaaagccaaattagttttatctctgcttttctgcataattcttgtcactttcctcttgcattttcttacataatcacaaactgatattaagttaggaggaaagttgtagtaattcagtttgtctgtcttaccaaaattagtctatcttccctgagctgttaaacactgtaagaatagtaattgcaaattcattggggatttttaaaaaaacattcaacatctatttttgtaaatgttttacaaggtcagggctgtttaagaatcgatgaaactatggatcttgtatcttcttattcccaccttcctatcccaaaatgcttatatgtcatggtgagttaatgtgtacacttaactatccaaatctcatggtctttcgggtgaaatatgtccatgggactgccaagtgctttcataaacattaagatttgtaatttcctttacagagaatagagatacttagtattaaaagttgctttaaagattttctaatctggttggttcatatcaaggtgaacagtctgaagtccagagaaggtaactgacatccaaagttacctgtctagtgattggaaaagggaaagccaagatctggactcctcttggcattaagtgcccttttgttttcaggttttttttctccctaccacgctcacgatatttctgaggctttggtgtaagcatatccagtgtaatttagggaagggaggaaagaattttttggcctgttagcaactttttatacctaacattgtttgagctaagtaggaatcaaatctgacaaccagagagaaatgcttattttctacatattaaaattgattctttttcattctggagatggaaaagaaaagccctatatctaatttaatcaatgagaccttattagaaaatgggagatccaagattgcacaaagttcaaattaaagcaggcaactctgacatctagcaaaatatacgaatctcctcttgactctcgaaaacaaatcacattcctaaccaaaagctaaagtttggggtatttagggagctagggagtcctagggagagaattggacaggtctgaggagaaaaaggataatttaaatataaaaaagtggaaaaaatcggttttaagtcatagcatgtctttgaggttgatgaaatgttctgctacttctatatgtggttttactctttggtaccaagattttaggacatactttgataacaaataggggcatgtcctctttgccccaatctgaaacctcttgaccctttattttcctttcctgctgttatctggtagtacaaatattcagtctaatctgttgatctggcatctgatttgcagcaaaaatacctgaagtattttcatcactctgctgtagccacctttaaaaagaaaaggaaagagaagaaaaaggcagagccaaatagtattaatgtaattgcttaaaatctaaattaaaatactcatcttgctctgcgttattaagatggtgtcagttttagaggtgcagggctagtcctatatgcaaaacagtaatgtctgtagctattgcgggctgacttgcagaaatgagcggcttctctagaacattcatttgcataaaggaaactatctttcagaaaagaaaagccaaaagtttcataagcagtttcactccagtgactacatcagagttttagtaaggtactgggaactacagtatttgaacagttcagcatctttataatttttgttataagctaaaatctgaactttagagaagactctctcttgaaaataaagcattaaattctctaaggtgtgaggaagtccttacctggtgattttcccaaatctcttttatgttcttagtgtttgaaaaaggaacttttttttttttaataagaacctaggtttgcagtatagattggtttcttaacaaatattttttttgagacaataagcctggatctgaagaaagaacatacaattgttaattatgcatgtatatgcttttgagttcaggatgtaaatgaatattcactaggtcctgtttgggaagaggaggagagaggggtctctctgttgattcagaatatatttttatacataagttttaatgctttatttgtagtttccccttaattgtagggctgctgtactgtggatattttgctctacaatctgagattgttagggtatagttactccaactattcatgtattatcctctccctgtctttttgtgtgtgtgtgtgtgtgtgtgtgtgtggtttctttgtggtgtgcttatgcaaagtagaagtattccagacctttatagcttttttttcttttagtttcaaacacttcaagaaaaaaggtgggggggagactctctcaacggttataattaggcattaattaagccattattcagttaactaaatgcaagatcttttgtttgtttagatggaaaagaaacgtatctttttaatgaaggagggatattaaatgggcccttatttgatcattttgctgcagtattgtaataagtatatgcttcatttattccctgaatatttattagttctgaggcttaataattagagtatacacaaacatgaaaaattaaatgcagcaacattataagagccgttacaaggtagtataggagtaaattgtacagacaactcacatcaggaccactgtggcctggaaggacatgtgagtttgcataggcagaaggaagagggacattatagacagagtaatggcatgaaaaactgggagataagcatgagtgttgagtatctgtagagcagcactgtccaatagaatttctgcagtgatggaaatgttccacatctgtgctaatacagtagctgtagccacacatggaacagcattttttaaaaaattaatttatgtttcagtagccacatgtggttatcatatcaaatagcacagatccagaggcagtgagcagccctgcctgacctcagtgggtgttcctcatggagcctagtatggtggtgtggaggagatgctcagaaaggttgacttccagtgagaattttagggccttagagtgccagaataaggaaacattgggaagtcactgaaagtgtttgaacatgcagtttgcactggagggatagagcccagtgccaggagatcagtaagaaagctattgagttatgtgtgagatgataaatctctggtaaaggtagacatggaaagagaaggatttaaaaataaataaataaataaaataaaacaaaaaaccatgaaggcttggtgattatgtggctataaagtaatgagaaagagatgtcggagatatatccttaagtttctaaacttggtggctggaaaactaataaagatgttacttaagaatagggaagagctggttgtagaagaaataaaaattgtgcaaatgataaattagacttgatgtgttaaatttaaggtgcgatatctaagtcaaagtatgctacaggcaggttggagataaggtttgggaggacttgaaagctttacgttagactctctgcagtcatctgctgggtattctgagacaaccacaaagagagaaagaactggtggattgaatcttccattggagcccacggttaggaattaatagaaggaagaggctaatttgaagtagactgcctgagaggctgtttgacatagaccaaagaagaaactggaagaaaggcatggggtcagaggagtgggaaaaccaggaagccactggaagagagattctagaagtaggtttggaggggaaaatgtacagttcagggtgaaggagaagtcgtcagataatcatgtgaatgcaatttcagagaaggctgaatacattaagaagtgagagagtcttatattgccttaagtgacttgaattttaagatagatgagacctcttcatatttgaaggttgaggggaagaagtcagtggacagagagcaattggaggtgatggagttagccatctggagcacaagtgacaaatgttgaccgtggtaaggagggagagttgtctgagaaagaaacagaatggggtccgagtgagaagaaagcatgtggcagagctcctgtgcacttttgctgattttcctgtattgttggaggtaagtcctttcactgggatggtgaggaggaagatcagcacatggtaagggaagaagaaccaccgtaggtagtgtgccaggcaatctatagagaagtcaaattctaaacaattggggggaaacctggggtgaagtgtggtgaggctgctgtataggagactaggttaattgttactttttggtatcactttgtggcctggtaggcttagggatagcaaatgggttcagagataagactctagagtcagattgcctgggtgtaagaccaagccccaacacttacttgttttataagaagcctgatgaactaaatgaattgagaagcagtaagcaatgagaatcttggtaatgaagtagtgaaatatcaagtttgggaatttgtagatagagcatttccctaacaattctagataaaggtttctaagaaaagtatagaaattgaactaacagaagaatccctgtaatgattttaaaggttaagttaattagaacttaaaaaaataagtattgtattctgaatttttctgtggcttttattacagcattcattacggttaaaaacatttctttttcattaaaccaatatgtgcttaatgcagaaagattctgcagtggattcttgtcatagtgttagaaggaaaggggagtttgatttatgccactggggggagggttattaatagccagccacagagcccttcaaaatgtggctccaaaggcagaaacaataaaggaaactttttatagatttgatagcatttattatgtgaccaaacatactcaaaaacaaaacctgaaagacagataaagagatttgcaacaagatattgttctttacaagaaagacttatatcaataggaagcaccaccccaatagaaaaattggtagtggacgtgaacaagcatttcacaaacaaatgaaatgccaactgctgacgggaagattctgcgcctgtaatcccagctactctggaggctgaggcaaaaggatcacttaaacccagcagttcaaggctgcagtgagctatgattgtgtcactgcactccagtctgggcaacagagtgagactgtctcaagaaaaaggaaaaaagaagtacaaactactaatgaacacacaatgttttggttatgtcctggatcagacttgattgaaatggggatgatgtcttcctttttcctgtattttgttattctttgtatactaggaagtatcagtctgggaagactgggcttttctcatttaaggaaaggaagcccgaatttcccagcctcctaggagaatctggagtgtcaaggaggtacaagatatatacaaagtagagttataagaggcaggcaccctgcttccctccataacatggttttcgtccaggagtttccttattgcagtgtgaggggctatcagttatacacagtttctcagtcacctggcgtagatgatgaaccttgaagacaccagtgcttcctagagcatattgaaataggcccctttctctcctacctgaattgcagtattagattttatagtggcatttgctcattgatgtgagacgcagtgatggtcttggagtatagttttgattattgagatggacgagtttatgaggtattaaataaagtgagaaaagttccccttgtagtaaaaccttataatgtttaaaaaaaatgtaaaagttaggcatcagtgtttaattttacaaatttttttaaaggataataggggtcatgggttttctgtcagtagaaaactcaaactgtttttccctctgctctcacactacaacagtcaacacaaaatacttttgtgactaaatgtgtgtgggtttttcgctacacaccaaacactggctgggctgggtgtcttccaattcaattttgactctacctggagatagcctcagatcccacagattgaaggttcagtcccacccacctccaacataagtccaggcttctggaacttctggctgaccagcttcaagttggggctcctatgactccgctctttggattcaattaatttgctagaatggcttacagagttcggggaaacttacatttactgatttattataaaggatattaaaaaggatacagatgaagagatacatagggcaaggtgtggaggaaggggcatggagcttccatgcctaacttgggcgtgccacgcttcaggaacctctgcatgttcagctgtccagaagctctctgaaccttgtcctcttggttttttatagggcttcattttataggcatgattgattataccattggccactggtgatcaacttaaccttcagccccttgccccctcccttgaggttggagggtggggctgaaagtctcaatcctctaatcttgccaccatcctaaagctagttaggggctgccagccaacagtcaatcattagcatacaaaaagacatcactttggagtctccaaggattttaggagctgtatgccagaaacaaggttgaagcccaaatatatattttacagtaccgcaggtttaaaagtctattcatatgctgcccataaggggatgagtctgctggttattggtaggatccttacctaactgaattacattcagccttaagtgagttcttaccttgccactagacagaatcagaatttgtctgcgtcttctgtcttaccatctcctttcttttaaatgacctgcaaacattttaaagttggataaaaaaggcttttaaatctcaccttcaggctcacaacttggcccactagcatcccctgcccatccttaagtcctttctgagtgggttgtgactgggagtacgggccctgaagtgatatgcattggtgagacttgtcactcaaactctttgagctaagtggtagagggaagagaaatgccaggaaaatcggtcttaattttatcagagacagtagtttttcatgaaagagagtaatgatacagtggatattgctgtagaaattatacagctggttgcgtatagcttgccatctcatctattacagcttcctgttttgctttttgcacattgctggctttgcagtccaacatatttaataacaacctctttatttttcatgtgtttatgtttgtgtgctcagggcttctatttagtttattcaagcttgagggaatatttgattagttttaaatgtttttctgttaactgtgaacaaaattaatttgattatcatttaaatgttggcacaaaaactgtatttatagcatttattcgcattcatttatagcatatatttgctgaagagttttgtcaatttgtgtgggctgagatgttctgtattctagaaaaggctcctttaaaaggggtgtgtcctcactgtggagttctccttttttgttaagctgatattaatcaattcagcaagtatttcatgcattcctgctgtgcatccagcactggactatgttttggatgggatagagaaaactgtaagtcattttctgccctgaagaagcaatctaattggtaagaggagattatgcatttgaaactttcacttcaaaatcaagggattggggaaaaaagtctgatgcatttgatagagctttttgcctctggcccacttctaccttactttattctgtatttattaattttttttgagacagagtctcaccctgtcgcccaggctggagtgcagtggcgtgatcttggctcactgcaacctccgcctcccaggctctagtgattctcctgcctcagcatcctgagtagctgggattgcaggtgcccgccaccatgcccagctagtttttgtatttttagtagagatggggtttcaccatgttggccaggctggtctcgaactcctgaccttgggacccacctgcctctccctcccaaagtgctgggattacaggcgtgagccaccgcgcccggccccagttcattctttcagcaaggttttgagtgtctgtatttctatttatgcttatgttcatagtgtatctcttagacagcttgataaagttgggggtaaggaattgtaagtacaggacctgcactgaggatcttctaactttaaggaacaatacaaacctgcttgtctagtctagcatctgttgtaatgccttttattacaattaccttattaactctttagactgagttcctcgagggtatggccagtgtctttatgatctttgtgctcgcacagtgcctagtgcagtggttctcccttgtctactcatcaaaatcgtgtgaacagctaccaccacaaagatgcctgggcccatcctattgaagggttatggtaaggaagcttttaaaaatactgttaatatccagcaacattaagaacggttgggctggcacacagtaggtacttggtgaatgaattttttcattttgttgtttttagaattacatcaggaaatatggtatgttgtgagttcattgtagttatgaaccatgtcttttatactctgtagcacccagcactgtgtgatgtcagttgtgggtgctcagacacaccagttaagttctgaggattgactgctttgcttcccctttttttcattgaggagagcagagacagaaaggatatgtgtgtttgacatctctcccttttccctttgtggaagaatcagcagttctgtgaatcccggagtctgcaaatgagttatagaaagctgttgaggcctgaggtgcttagattgcaaagagaaaaggagaggaaaagtggcagaatagagctgtggcttatctggctatgtcagaaaaatttttggttgtcacgaattggagggagacgctggagggttgcaaatagcttctagtgggtagaggccagggatgcagccaaacatcctgtaatgctaaagttgaggaaccctgaaatagaggataaaaaaggggatcaggagacagatgggataactgaagtggtagtgtcatgaccgtttctgccacaccagcacacagtttgtgtgctttatcttcccactttccttaccccttaccacaaatccttcagagtccagagtactatttttgccattatctataagtagcattgtgacttacaactgtgtattaggtgttgaaattaatatcttagcatcttatctatgttaaaatatacctgaaagattcctttaaattttctttatctctacatctacttgattggaaaactattaacctcaagataaaaagagctagcaatttttgttttctttatgttttcaataaaggatcttaaaataatcagtgggaatgtaaagaaaattaatttcctttttttttttttttttttaactagacagggtcttgctatgttgcctaggctgaaggctggtgatcacagctgattgtaacttcgaactcttgggcctaagtgatcctcctgcctcagcctcccaagcagctgggactacaggcatgcaccacagtgcttggctttttttttttttttttttaaataaaggctatgttgcccaggctgatctcaaactcacagcctcaagcaatctttccaccttggccttccaaagtgctgggattacaggtgtgagccattgcacctgggtcaagaaaatgaatttcttaaaaggagtttaattttagtgttctacagattcatcatgagaaaaggattattaagatttgaacacatacaagagctaatggtgccaattttctgatgtcttgttgaatgatagcttataatgtcttattctaagctctttagattaaagtgaatttaattttgtcactgctgccttgataaaactcttgttttttttttcatgttctgggtaagtgggaaggtatcaagaaggaaagcaatagcaaaaacaagaataaattagaaagggatggaaggagatggagggaattttttaaaactataagcaaatccttgcctgttactctgccttatgcatcaaaccaagggggggactactgtggagaagcagtagagaggttaccttggcaggttccttaactttttttgtgcctcagttttgtcatctataaaatagttcttgttctataggactcgtgtaaggattaagagacctatttaattaaatttaaagtgctcaaaacagtgcgtggtgattcataatggttgtggttgtggtgatgaggatgatataaggatgacttttgattgtttttgaatatagttgacccttgaccaatagaggttcgaaccgcaggagtccacttatactcagatttttttctcaaccaaaagtggatagaaaatacagtatttgcagaaggtgaaacctgaatatgcagaggggcagctttttgtttatgcacgagttccacagggcccactgagacctgtatgcaaggattttggtattgggtggtggggtctgggaaccagtgccccaggtataccaagggatgactatacttctgttgaaatttgatggagaccatggatgcacttttatacagtgtttcccataaaaccacctaccactttctccctttgaagttggtggtgatagtgataaaagtttcttgagttttcaaactagtatgtttcaggtgttctgtaaaagtctgtttttttgcctatactctgaattccaagagaaagagtgatttatatgacataaaatgtttgtctttatgtttttataatatactaaaacactatagttaaccgtcatccatttacagattttccacagcaatttttgaatcttaaataggcatttctctagaatttactatgttctcagggcatattgtagttttattaatagtgtaagcaaaatataaatgattaaaagctttgatgaatcataatacattgtagaagcaatagttaattactagtaaggctgctttggattatctgtcccatttttcatacccactgaaacagctggttgatatttggactatttggatttccactgtagggtaagtaacaccgagctcaggatgcgtggaagatgtcgttgtagcacagactgtaggtcgctctgtctgcacgtatgtttctccttagatgaagagcctgaacaggcggtcctgtgactcttatcatagtgtaccatatgatatggttctcccatctctcccatacacacttcataaccataagcttgatggtaatgggaactgtgttatactcattttctttctactgcacctttatgttggtgataagggcttaaaaatttgttcagttaaatactggattaatggaaacgaaagccttcttagtagctgagcgtgtaaaggaggagaacttgggttctgaagtcttctgagaatattgtcttgggtttttccattgtaattggtaaataaattactttagggaagttagcagataagactgtactgaacaagtgatcagaggtagaaaggactagattcatgggcacagggctcacctaattctataggtgatgcttgcttatatctaaagcattatttctctaaaaccagtgaaaaactttgcatttgcttcttttagctcttaggtggagggagctctcacattctggaagagggggttgctgctatttgttcagtttctcctccaaggtggccaaatgaatgtttgcaattccagtccagtttttggcagattgaaaaagtctgtcattgattgtcatatgagagtggaatctggccgatgtcaatgtttgtttcagtggttagataaactttgatttttagaagttattctttcaaataacagatttctgtaatggaaaaaggacaggaccaaattgcttgtgaagatatttgaataacatagaacatttttattttaataagaaattcatgcattgaaaaatttgatggatatttgaacagttaataaaaaggggagtaagggtctaaaatgggagggaaacttacttttttgctataatatgccattttttgaaatggaattttttgattatgtgcctgaatccttaataaaagagtacattccattcctatccatatcatattaacccagaatagggtcatgtattttaccagaatacatttctctgaaaatcctatgcagatacactttcaattattttttttcctttatacaaagatatatcttgccacctgttggtcataatgctgtcttctagagccatgtagaaataactctcttacctactgtcagtttttatttatttttgttattgtggttttaaatttgaaaacagcaattggttaaaactaaaagtagttggctctcctgcactcccttgtacccagctcactcctaaaggtaactacttgttcagtttcatttatttttttctaggcctttaaaaatgcacatgtatatacatagacagtttttgtttctatttgtgtttttagaaagagaccatactatagatactttttaccacttcttactgaacagttgtggtatggttttcttttcatggtagtattgtacatgaaagtccatctgttttttcttattttattaacagttacatcatagtcgaatgtatcataatttatttaatcattccattattgttaggcacctgggttatttagaacacgaatatacttgaacatagatctttgtgtgtgttcatctgagggagctgtttcccctgtggctctctcaagccgtggctggtttttcccataaaccttttacctcttattgccaccttcagaccattcttctaccatcctctataaaaaacacccaacttcgactatcatgtaaaattataccactcattactcttccttgttagtcattttctgccccattgcccatatcgttcactctaattcctacaagatttaactcctggttgttattccctttatactataggttgagcgaccctaatctgaaaattcaaaatgctccaagatccaaaactttttgaggactgatatggcaccacaagtggaaaattctgcacctaactttatctgacaggtcacagtcaaaacttttttgtgcacaaaattattaaaattattttataagattggccaggcatggtggttcatgccagtaatcccaaccctttgggaggctgaagcggtggatcacttagcccagaagtttgagaccagcttgggcaatgtggcaaaaccctgtcactaataaaaatccaaaaattagccaggcgagatggcacttgcccgtagtcccagctattcaggaggctgaggtaggaggatcacttgaacctgggaggtctaggctgcagtgagccatgccactgcactccagcgtgggcaacagagcaagaccatgtctcaagaaaaaaagaaaaatttcagcctatgtgcataaggtgtagatgaaacatacattaattttatgtttagacttgggtcccatccccaagatatctcattttatatattcagaatattccaacatccaaaaatacctggaatctgaaacaccatctggtcccaagcatttcagataagggatactcaacctgtattcctgtacaggaattatggacatttagtccataattcttggactacttctcctccagtggccttgtctttggtcctacctcagatattcaatctctgggtagaaagattccataaaaaaagaagaaaaaaatctcgctcagtcttacagttcccataatacgggttttcatacttctaaaaattaaacaattctccaaccttacagttaattattttctttatataagcagtaaagtattatttgttcatgtctgtactttgagaatatatccagaatctgacgacttctgccacgctggttgaaatctttatcatcttgtaccttaacaattgccatagcttcctaactggtctccctacccaccactccctacttcgatccctgcgtccttcagtatgttctcaacccagcaagccacagtaattctattaaactctaagttggatgatggctctcctctgctcagatctcccagtgtttccatctcaatttgggtcaaaagctctgaagtctctgtgggtcccgcacataccttcccctgtgacctctctggcctcatctctcatttctctcccctcactccattccagcctcagtgaggactccttgccattccttgaacatctcaggatcattcttgccaaatggctcaaatggcttttgcaattgcccttctctctgcttggaatgcccttccccagataattcctttcagggggctgttcagataccacattcacgacgaggctttccctgaccaccagaatgtaggccccaccaaggcacagaaacagactttgaaaaactttttgtgtctctttcagtgctgcgtttctagtgcttagaatagtgcctggcatgtgatagctgtttgttgagtgaattgaataactgtagtggttactagtttttctctttttgtatgaagttagaacttcattaaacagacaaaaactagactgtaaacctcatttttttggatatgcaaaatattaaaattagccttatttgtgaacctgctttgttaatcactttgtttttcagcatgttataattttgaagtaagcctttcatgtttatatttaatctgcctaacccagtggattgggtgatggtatcacaattttgtggaaaagcaaattgaggctcagagttgttttcttcaaagtacagctactaagtggacagctgcagttcaaacctattcaagttaaggacacttgttttctaatttagaaaccatcttaaaatgacaaaaaagtaggtagaggttttatttgaaagcatggagaatgtgccccaatttctcattctgggttttgtctgccttttgtttccattttcaaaatatgtaaaataaatggttaactttaaaattcctgacaatgacagatcaacaagttttatttctctcacctgtggaggaagtggcctccacccagttttactgaattaggagggaagtgattttttcaagtgataaaaagaaataaaattccatgctcttcccagaggaggagttcaacaattgggaaagtggcgtgagaccatatgttggtttgtaaaaggatataacttgtaaagatgtttcctttgatgcctgtgatgaatatggatgtgtttcccttctagagggtcctgattaaattatgcaattaagagctgagctgaaggatctaaatataggaagagagttcaggccgtcctgctttgtgtctgtcagttcacccctacagatgtgcatgtttgttgtcataaacagcacctgtgagatcagtggagcgagagaaatatgttccaaaacatgaaatacagcaggatttttgtttctttttttttttttaaagggatagttttttcctcctgtagttgattccattttcatctgtgaatttgatatttggattacctttttttttttaaacttgactgagggacttcagtattagtcagtactggtttaaaatatagatatactacttaccagaatatggtctggagaaagttactttaacctctgagcctcaagtttattactaaaattgagataatgatttctaccttgaaggattggtgtgaggagtcaatgtaataatgtttgtaaaaacaaccagtataatgcttgtataagttggtaactcaaacaatttcgtttattagctactgacgaatcattcataactagccacttacggaaatctaccacatttagcattctttgtagtctaaaattgctattttaggataactgactcaaagagaatagttttttctgagacaactaccatagactttctcctgggatagtcaataaaattaaatcttaaaatgtctgtggtcttcaatctttcctgtgtttgaggagtgagcatttgtaggccaggagtctttacagtgtttgagttgacatgaatgtgaatggcctttatcaggatgagcttatggggagctggacatcttgaaaggctaccgtgtcctgaaggacagtatgccattacaagcatgaatttgggaatgggggttcaatgggattaaggaatgttgtacaacttttagaggaaatggcaagaagatatagaaaagccaactttgtttgttgaagttggggacaataagaaaactttcaattgccttaactattcaagtaatcatctaatcagacaaaacagatgtgacagctgctattttatagggaatctctgtgattaagaaaaattaaccaggtactctattagcagcctagatttgtcaggatggaaggatttgtgtatgcagaacagaaccagaaagaactctttttaaagaattttctgatataatgaagatacgttaatagcacacttggcacacctaaaataaataaactacagttatatccttagagactcttgtcattctgacatccataagttccttgcttccttttcatcaaggagatgctacttttgaaattgtttggctgaaatttcacagcttcagtgaacttacaagtggtaagtagtaagctggaattcagtctacatggtattccttttctttttgattcctaagatttctactcacttaacactgttgagggaccaaattgcatctcttgctggcatgtcacttaagttatactggagagactggaagacttgctgtcagtgtctgcgctttaaacgcacagtgtctgcgctttaaaggcaatagtacctgcattattgcatcactataaatagaatttcacgaactgaacctctctcctatctccaacccccaatttctccagatttagaaaatcagtctccggcaaaaataaattttcagtgggaaaaatgtcaaactagctattctgcatcatcagtcccatgtttggaagtagccagatcaaggctgaatagtaagaggctcagtaagatggaactttacttgtggtgtttgtgatggtaggactctcctgctgctgtgaactgagagcagcagagttctgtgttctctgtgggtctccgtatggctttcttgtgtaggaatttggtttaaatacatttttcccctaaggactaaagcgaaatagagttcattatagcctttttagcaatgaagttaagcgctgtactttatgaagtacgttagcatcagtaaagagcaaggttttatccattttcatttttctttctgttctagaggttttttcctcccttattttgcttagtggtgagttttatttagctaaatttgactcatttgagattgagacaaatgttgaaagttgagggctaactgctgttttaaaacaggaaaaaggaatgcaggcacttcacctgtttcctcctccaatacaaatacagcaggtcctcagacaacctcatttcattcaatgccatttccttataacgttgatgagaaaaaacattcccagcctaggccactgtctgtgtggagtttgcacattctccccatgtctgcttgggttttctctggctactctagtttcctcccatatcccaaaggtgtgcacgttaggtgaattagtatgtctacattgtccccattgcagtgcatgtaggtgtgtgtgtgagtgcgccctgccatgaaatggtgtcctgtccaggggtggttcccaccttgtgccctaagctgctgggatcggctcgggccactgcgaccctgaattggaataattgggtaaataattatcttgtttctgttcatctttcttaaatgtatatatggctcacatttatttcagtgttaattttagaagtgttttgggtctcagaagtttggtaatgtttttgtgaccagaaatgtcctgaaggaacttaactcttgtttatataaattagctgatgctaaaattaattttgttttacatcgtttcacttagagccacagtttccaagaacccgtaaggactttactgtatctgaaaacctggttagctcctaactggagtaactgggttaaagaagcatttgaacattatttgttgaaccagatcaaagaacattgctactttagggtattttctggaactgaaataactagatccatttctgtttttatattcattgtaatggcattggacttgtatagcaaattttaacttgtcttttgcctgtctgccttaaccttaagggtagatatttatcattttccttaaggagctgtacaataatctttcatgctttttgttaggaaccatttacaattcctactgtctgctacttatcgttgtgttctacttgttctagagttctgtctccacctgtcttcatttttaggggtactgttttttaggggtactatttctctgtttggaaatgtgagcggatggcagtttctgcctcagccctcttgctgggccattgtctcatgtgggttgtctgctgttccacatttaagtaatagttatttcagctttatcaaaagtttgtaagttcccagttcttctggacttctgattaattcagcctgattttatttagggcaaatgattatgatcccctttccattttgtgaatttttcatattttaccaataaatctcattgcaattctttgcttacaagatggcttgaaagatgcaagcaatgatggattgctctttattgttttaaaatatttattggccttaaattgctgaaataatatggtttttccaacctttgtgtttttatgcatttttaaccctacgtctttagtgtataatcttctgtgagtctgtggtttctataagtgtcaggaatttttcaggtgtctttattatcctttgaaatcatgatctatttggacaattccatctttgtttggactatacagttgacttgagtacctaagtgaaatggagcaggttagaaaaaagtagcttgttttatagtaatgagaattacattacaagtcccctggcatgttcccctttgaccttttttgatgttttaatttaagcatctcaaacaaggcaagagttgatctcaccaggccttgaatcctatccaaaattggatgttaggatagatgacacatacatttctgtaatactaattaatattgccagttaatattgatcactttctacaacatgtctctgagatatcttgcatctccatggcatctaatgaggtgtattgtgaaatagtttcatatattaaaaatactggaaaataatataaaaaattagctgggcgtggtggtgggcacctgtagtcctagctgctccggaggctgaggcaggagaatggtgtgaacccaggaggtggaggctgcagtgagccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtagctgggtctaaaggtgtacaccactatgcccggcttatttttgtatttttagtagatacagggtttcaccatgttggccaggctgatcttgaactcttgactggtgatcccccctcctcggtctcccaaagtgctgggattacaggtgtgagccaccaagcctggccgatcaaacagaatttttataaagttgtctttaaaaaaaagaaaaaaaaagtatccagctgttaaacattttcaaagtgaagttaatcaataccctgtacttttagttccttaattcttttgatctttgtgccatgattttttactattagttaagaaagtgtaatgaaccaaagaacaagaagtagggggagaaaagagttgcctgcttcatttgacaatagaccatttatcttctgttatttgcctttcttaaagtacggagagtttttggatttttttcccccagtcactttttgtagcctgtattttttgtttattttattgaataatacaattattccctcaatatttaatgggagcatttattttgtctgctgaattccatactggtgcaagaattataaaacagcctctagtctgaagctgatacagagagtggttgaacattatttgtctcctaatctttttattaaagggggttgtaacatttggtggttactccttcctttaaaaaacaattatatcttcatatacaaattagggtaattaaaaaaaaactttctgtgggaatttgggatctgtaacatattaaatggaagagagtgtattttgttgatattcacaggagttggataatttacttgttgctttactagatgaggccaaggtgaagaaaatgcccatttgttctgcaattggctgattaggcttcctttaaatataaagcaagttacatagcagttaagagtattttaacatttttttcttttaatattaaggaataacacataagttggaaaattaattagccgtgtcgagtagtataagagtatttttctaatttcacttctggcagttctgatagaaatccttcccatgggtgagactccttaggaaaacgttctgagttcagaacactgctttaaactacattatattttttttgcttctcaaaccagatcacactataaatccaacctgatttctaagtagagtatagatgtggcttgagataatgaattgatttttgtgggttttttttttttgtaattagcaaatatttgcttcgaaaacctttttataaaaaatcggaagttacattttttcattaaagaacgtttgaaaagtttagaaaaggaggagagagacacattactaatcttccaaacccagtcatggttaatattttcatatatttacatagttgttcatggtacatataaccaaccattttatgttctgcgtacagttttccccaaattattacgtagtctttatgaacataatttttaaggtctgtataatattccattgagtggatgtatgcagtttacttaggtatttttcaattattagatgtttctctttttttccctattataaataatgctctgatgaaaatctttgtgcaaaaacaattttccctttctggttcagaatatttccttagagtaaatttctgaagataaagttgctggaataaagatctcaatatttttaaggctgctgggtttttttttttttactagatgaatacttttttgttagtgtgaaatgtttatatttggacaagagggaaggaaatctctgtttgctgactcatgtttttattttgcactttaaactgataaggccacttagcttttgacataaactaaggcaggaagtacaaaaaggggcagaaaaaaagtagttgtcttgccaaggccatagtatcatggactcatttgagttccttatatgaggtaggttacctgtttgacttgtatattaaaaaatgcttaactcaggtaaaaattagtcatcagcctgcattttgttttgtctgggcatgtttatatgcaaagtgctgtgatctttcactttaattttcgtgagtggcctcaagacatttaccacctaactggcttctataatgtttggatgcccttggtttagatttttttttttttttttgctcccagtatgaagaaatctttctgtattgaagatattaccttagttgtctttctaaaatgtagatctaataatgctaattctcagatttaaaaccttccacttgtccatatgataagattcttcagtcttgccccttccttcatatcagcttgtatcatcatctccagcggattaaaccctagcatttctatcatgtgtctgttggaacaagccatttggaaaagtggtttaaaaattctggctctagagccaggcaaaatgggttcagatccaggttctgccacttatagctgtctacataactttggacaagatactcaactattctatattttattttccttacatgtaaaataaagaaaatgatagtatttacttcacagtaaatactaaggtattgttgctaagattaaactggttaatagataaacagcagtgaacagtgtttgtcaagtaatgaacacacaaaatgtttgctctattgttttgcaaaattctacttatcctttaagtctgatgttttctcttggaaaaaaatgttctgaaatctctggaattgttctttccttttccgtttttatatattattgtcttagtttgtaggccgctataacaaaataccatatagactgagtggcttataaacaacagaaatttatttctcaaagttacagtaactgggaaatccaagatcaaggtacctggatggcctcttctctctgtaacctcatatggtggaagggaggagagatctctctgggatctcttttatgagggcactaattccatttatgggagctccgtcctcatgacctaatcacctcccaaaggactcaccttctaattctgtcacctttggggttaggatttcaacatgtgaatttagggaggggatacaaatattcagaccagagtgttgttgatacttgttttatagcctttatcacatgatattagagtaagttaatagtaggtaaatgcacagcacatgggcctcttcttcggttattcttgtgcccatgggcaatggtataatcgtattatttcttctgactgagtccctggaaggtcacctaataaaacatctcagcaaagtcctttagaattagcatgcaggttagcaatttgctttatgggagttagttgtttacacactggctttcccaatggattgtgagctcctccagtatgttagacatgtttgcttctgtgtctcctgtgtctagcactgtgctaggcatacttagcaggtgcttaatacagctttgttgaatgaatgtcgatttgaatagttaaaacaaaaatctgaaatggtggttcttatataatacgttgcccaacacttgccttaaataaatacccccaagtgattttgggggtatttgtttaaatgtatttgttatatattttaaaatagccccaagttattttgatgcaaacttagccattctgtttaaaaattattgcttaaaatgttaaaaagctgtttttgaagaagagatggacatatagaatatgaagaaatacactccctctataaattattcccagaagcctagaaaaaagttcttgttcttttgcaaaactaaccttttagtaaaaggaaattatcatatcaataggtacactctgaccaagtgtgacttttgataatagcatagttttgttttctctttcctttaatgttaaatgaaaataataccaacttcaaaaaaactagtaaatttgggtgaactctttaaaaaggaaaacagcggacaccctgtggcctcccaaatagagttgacgctccgtatttggctttctaagttcttcaaggagctaaattattcatcaggcatttagtgagaatcagctatgtgccaggtactatgccaagttccaaaggtaagaaaataataagttggagtcctacattgtttcctgtagtgaagatgacagatgtgtagattatcacaatgtagctatagacatgcaccgtttgccatgacagctatttataataattataatttttaatttctgaggctaacgatttccccattctgatccatttattggtaatttgtgccttctcttttttatttatcagttttgctagggatttatccaattttattagtattttcaaagaatcaactttgattttataggttttctttagtatgctttaaatttctgctttcattttcttctactttctttgggtttatttttccttttaaaaaatctttggcgggtattagagtgttagttttcagcttttttccttttctaatatatgcatttaagactataaatttccctctgtgccttgagccacatcctgcatttttgatgtgatatttttacaatcattcagttaaaaatattttctatttcctctataatttcttctttgacctttgggttattttaaagtttggttcttttcaataacaatgtttttattgatttagttatactaaaatcaaagaatatgttctatatgattttagtattttgatacagattgagatttgctttgttattcattatatggtcaatttcagtaagtattccttgcgtatttgaaagtgttatgaattgtacagttgttgagtgctgtgataatatgtatatgaattggatcaagtttttaaacaatttttttctgtatctattgatttttgtttgcttgttttatcatttattatgttaatctcccactaggattgtgggtttgcctgtcattgtaattgttagtcttttgctttatgaatttgagactgttattatttacataaaatttggaatttaaaaactacatggtggctcaactcatcactataaaatgtcctttttttcttttttgtctttaaaaatctctggtgatacctcttacttttgaagtctgttttatctgaatggatagctatgccagctttttgggtggaatatgcatagtatatatttttccactctcttgctttcaatactgtgttcttatatttaatgtgtgtctcttttaagtacaatatggttaaataatgttccccacaactctcttagttgtcatattttagtcatttatatttaagtaattgcttatactttgggattatatctaaatcttactattttctgtttgtctcatctgttgtctccttttcatatgttttgcattaatcatttttaaaatttttatttgatttttagagacgctctcactctgtcactcaggttggagtgcagtggcacaatcataacacctatcataactcctaggctcaagcagtcctcctgcctctgccccctgagtggctgagactgcaggcacatgccaccttgctggactacttttttactttttgtagagatagggtcttcctgtgctgcccaggctactctggaactcctcaagctatccttctaccttggcttcccagagtgctgggattactgggctaatcatatatatttttttaattccatatttttaacccatctattagcttgttataatttttaacttattctctcagttgttgctttattatgacatgaattcataacttactgtactaatagtaaattatactttaccatggcctggataacacaaggaccttagaatgctaacttcatatatctctttttgctgttgccatgcattttaattgtacatatattttaaacatcacaagacattcctattgttgttttgtgaagtcagtattcatttaaacttacccttatttccccttcaggagctcttcctcatttcctgcagttctttgcttatttctagagtctttttccttctgcctgaagaattcctgttagtatttcttttagtgacaatctgctgtaaaccagttctctcagattttgattgttggaaagcatctttatttcacaatcattttttgaatgtgtttttcctctaaatgtagaattttaagttaccagctatttacgtttggcactaatgatgtcatttcattgtcttctggtttccattgtttatgctgaaatgtcagctgtcaacctgattgtacttacttgaaggtaatgtgcctttttaaagagtttcatcttaggttttcaagaattttactgttatatgacacattgaaatttgtggatttctctgtatgtatccttggaaggtgtagggcttcgtgaatgtatggttagatgtctgttgacagttttggaaaaatccttggctagtatctaaaaatattgctctgttacagtctttcttcttttcctttaagactctacttatgcagtgctagacctttcactagagccattatgtctccttagttctttatttttcattttttccctctctttgcattagtatgagcattttttaccagtcttcctgctcactaatcttttattctactgtatttaacctgttgttaagttcatcctatttaaagtctcattagttatatttttcagttctagaatttttatttcattcttctttatggattccagttctctgttaaaatcttcaaccttgtcttctctttccttgacatagtaaatagtaatcattaatactttaaagtctgtttctggtaactccattacctgggtcacccgttaggtctgtttctattctgttttgttttgatcatttggtcctgtttcttggtatgcttgataacttttggttcattgcatacactgtgaatttaaaattgtagtggctaaggttgatgttgtcttcctctacagagaatttgtttttcttctggcaagctgttagagagcaatacccatcacctagaccaaggctaggattaagatgattctagattggttgtaaagactgatccgtttcatttttgcccttagactggggcatattcctccaggagcttccattgaaagcctagactatttaccagggtttctcctcagcaggccctcaactccatttgttgctgtgttgttattttggggttcctcagcgctatgaggctactagaagctctgcttagtttttagcctcttagttacctctttctgctcggctcctagaccttttgctgctcatagcatagctattggcaaatccctggaaagagtggtgacgaatattcagctcacttcattgcatttcccctctctccaggatcttggccccctcaagtcctgagtgccttggttcctctttgatgcctttaaaaagctgggcttttgtttgtttgttttctggcttgtttgtttggaaggaggttggtctgatacgtgctactccagtttagccagggtttgtacaaagttaacctccttaacctttttcacattttatgttttcatgtgctaaagagtaaacagtttaaatgaggcaacttggctaaagaatttggtacagtatgtgtccatgtgctttattccttttatgtcaataaatagcaacatttttaaagcaggagatgtatttcctatcctatttgtcctgtagcccatagacacaggcttgttcactgaagaaataccctaaaatattactacatttatataagaggaattttcttttagcctaagaaatatttgtagaacaaaccaaaaaaacagagatattagactatttttttctccctgttgctttcagtttttgttgattgaggtgttttgaaatatatttttagaggttataaatgaatctaaatctaaaatattacaatatcttttgagaacttgggctttttaactttgttgcttttatcccagagcttttgctaacagtggcttactttttaaactgcttctcagtttactcatctgtaaagtggcagcaattgtattacctaactcaaaggattgtgaaaagcattaaatgctatatattagtctgctttggttgccataataaaatatcatagactgggtggcttaaataacagaaatagattttctctttgttctggagtctggaaagtccaagatcaaggttctggacaatacaggctctggtgagggctctcttcctggcttgcagatgatcaccttcttgcagtaccctcagtgtgtgtgcatagaggctggaggagggagatagcaatcttaagaccaccagtcctatcaggttagggccccaccctgatgaccttacttaactttaattactttcttagaggctccatctccaaatatagtcatactgagagttagggcttccgcatatgaattttaggggtcacaattcagtccacagcatactgtattacataaaagcacttaaaatagtacctagcacatggtgattacttaataaatgtggttgtatggtaaagatgattctaaccattctttttttgttttgtaggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctggtaagtgagttattttatgttgatgtgctttgtgtgcccagtaccagatttgtgttgtttagaacatgaaaataatccctttgcttgtttttagttgtaatttaaaaatatttggggaaactgtgtgtgtgtgtgtgtgtgtgtgtgtgtgtgtgtgtgtgtgtctgtgtgaatgcaagagagaaagcccctgagtgtttcatacattttaacagcttagtcatctctagttaacattatgtcttgggagcaggctatgacaattgtcattgcagtactaatacctctaatttttaataaattgttttctttctaaatttattttttatgtctcacatggttctctgcatttctctagataaaattagctatgaattgtattctaagggaagaaaattaggaaagaaatgcattattgctgtctatatgcttaagggaagtacatcatgagggtagttgccagtgacttaaaccattctgaacttaagaacagcactttttatcatctctggcggaattttgctgtggcatatttcctatggtgaatatgaaggaattatatccttctatggaatcatttgatgctattactttataaaatatacccagtttttacatgtatagtcttttgggagggtatggtaaaggatatattttaaaatttatacggttttgccctcaagttagaatctacattctagagagttggatcattggaaagtgattagatattcaagcacttaaatgtctcattgtcgattgggaccaattttgttgatggattggctgttaatagttcctgggttactaaggctgtatattagaatcacatggctctcctcccagaaatcctgatcctgggatagcctggtaatctttgtttctaacaagtacttcaggtgttactgatgtagctattggattggtgtttaggaattactaaactagatcatgtaataacatggttttcaaataaaaggcattctgtatttttgtggaatatttaagacatattttaaaaaaagattttaaagaccagtagtataacaaacatctctgtatcccctactcattttaagaaataaaagattacgtgtaaactggaacccctgtttttgctcctctgattctgctccctttggtaaccactgttctgaatctgacgcttatcattctcatgcatgtttttatactgttattacatatgtatgagtccatgacaatatgtaatattttatatatttaaaaatgttacataatattggagtttctttgtacaacttatgttcatccaacattacgtttttgtgatttctagattatatactttaggattaccttgttaagtcctatgaaaaacactttgggaatttattggaatttcgttgatttcatttggggaagattggcctactgtgctcttgagcataatattatttagtgcacttttaagtttctccatacagctcctgcacttactagatttatttctagataactggtttttattgtatccttttaaaagttacattttgttacagttgctcttggttaagagagcattgccttttttctaacaactgtgctgaattctccttaccagtttggatatagacgttctttactgcttgttatatcagctgtgatgcagtgttcttttttctaaactcagcacagaggtacatgtccctcttctagccagaaatggaaatggagctaagagttttggagagtaaaatgtagtagataagtaatatgtaccagcaatattatttaggcacatgatttttttgatcctcgtagtaaccttaaaatgtattaatacataggtaagattttaattctactccatatgcgatgaaactgaggcccctacaagttaagtgccttgtgttagaactagaaaatagaggcatttgacatgaaaggcaaaattcactatttaaaagacactatgaatatgtcttctccatccatactccccctcaccctgcgctaaccttccagcatttcatcttgcaatgcagcaactgcctcctgactggtcacccccttcagtccattgtctacagaaagggatcttttaagatgcagacatgatcctcttgttgtcctacttttccctactcttgagaagtcctctagagaggtctgcacattctggtcctttcctccctttccaacttcctttgtactcttgcatgctttgtgtgcttgagttctctggaaacattccatgcacgtttcctctatctgtacctgtttctcctccctctttgtctagcccactcttatttatcgtttgtgtctagcacatggtcattacttaataaactaagtaattgtgtgatggaggtcagtttcattgggaaacctttcttgatacctcctacttcacacatatctccctactctgcttggggaggttaggtctcatttcccatagcaacctgaatttctttagaatgttcttcacacttataatgattgttctgttggtcttctctgcaagatagtaaataaagctccatgagggcagggactatgtgtataattaacatctctatttttagcaacaagcataatttgataaatttttgctgttaaatggtgatgctgatttttaatttaatatcgtcatttggccatttttttagtgctgaattttcagtttatctataccttttgaccatcttcttcccttctttggtcattttatggctattacacctctgatacaaggtgaaaagttaaaaccaatactgagatgaatttgttactcttaataacatatgtgctaataaaataatggggaagaggtggaaaactggcttacataggcattttgagactccacaaatgccatttcagcctctcctttacccaggaatcttgtgagtcatggatagaatagaacagttctggaaaacatggaggctgaggctaagatctatttaatttgaacatatcaagattttatgtatatttttcacattatgaagtgactgatgtgggaattggaacaaaggactttttccagagaccactatgaagcagtccctgtaccttctgaagagaaactctactaaatcaaagtgcaagaggcagccagatgtggtggtacatgcctgtagtctcagctactcaggaggctgaggtgggaggatcacttgagccccagagttgaaggctgcagcacactatgatcatgcctgtaaatagccattacgttctagcctgggcagtgtagtgagactctgtctcagaaaaataaagttaaaaaaatgcagcatagtaaaaccccatctctactaaaaatacaaaaataagcctggcgaggtggggggcgcctgtaatcccagctactcgggaggctgaggcagaaaaatcacttgaacctgagaggcgcaggttgtagtgagccaagatcatgccattgcactccagcctgggggacaagagtgaaactccatctcaaaaaaaaaaaataaaaatgtgcaaggtgacttagcccctcacactgccagaattgaagccctctataaagccgtacagagtacacctgggtattgtttttgtgaaatcagaaaaagggggtctggaattctaagctgcacatatacacagctcaacactgaattattttgaactttgtcactattttacttctgatgaagtatctcaaagaacagtttagcagtttaacatatttaagtctcccaaacttggtgacttctgctgaggtctcaatgactcttgaaaaaaactcaaaaattgagaatatttaggtttagagtagtggttttcaaagtgtcgtccacagagtagtagcatcagtaccaccttggaacttgttagaaaagctaattattatttttaaattgacaaataattgtatatatttgtggaatacagtgttatgttttggtacatgtatacattgtggaatgatcaaatgaggctaattaacatatctgtcacctcccatgtgtatttgcttatttctttctttttctttttttctcttttttttactgcctattctctgaaccatttttttgtttgtttggttggctttttttttttttttttttttttttgaggtagagtctcgctctgttgaccaggctggagtgcagtggcatgatctcggctcactgcaacctctgcctcccaggatcaagagattctcctgcctcagcctcccgagtagctaggattacagacgtgcatcaccacgcccagctaatttttgtatttttagtaaagatggggttttaccatgttggccacgctggtctcgaagtcctgacctcagttgatccacctgccttggcctcccaaagtgctgggattataggcgtgagccactgagcccagctgaacctttttttttttcaccatactaatttctttttggtgagtacatttaaaatccacccctagcctaagcaacatagcaagaccccgtcttaattttttttttttttaattagcgaggcatggtggcatgtgcctatagtcctacctattcagaagctaaatcaggaggatcacttgagcctaggaggtcaaacctgtagtgagctatcatcatgtcgctgcactccagcctgggtaagagagagactctgtatcaaaaaaaaaaaaaaacccacttttttagcaattttgaaatatacaatgtattattaactatagtcaccatgctgtgcaatagatcaccaaaacttactacttctagcttaaggtttgtaccctttgaccagcatttcctctgtccatgttcacccctccctgcagcccctgataaccaccattctaattctacactctacttttatgagtctattttagattccacatgtagtgagattgtgcagtattcgtctttctgtgcctggcttatttcacttaacaataatgtccgccaggtgtcacaagtgacaatttccttttttaaggctgaatagtatttaatttgaaaaaaatgttcaacataagtaatcatcagggaaatgcaaaaactgcagtaagatatacctttcacctgttagaatggctgttatcaaaaagatgaaagatatcaagtgttggcaaggatgtagagataggggacagccattttggaagacagtatggaggttcctcaaaaaattaaaaatagaactaccatatgatccagcagtctcacaactgggtatatgtccaaaggaggtcaaatcagtgtgtcaaggagatgtctgcactactaagttcactgtggcattatttacaatagccaaggtatgaagttaacctgagtgctcttcagtggatgaatgtgtagaaatgcaaattcttaaacccttccacagacctacaatactgaatcagactctggagatggggacagacatctgtgttgtaacaagttctccaagtgaaactgatactgcaaaagtttgagaaccactggtttaaggtatccaggcaagtcatcaagtccgattgtctggatgaagttgtcttgaattcagaagagatgctaatgagctagtcttttaaatcctccagcatttttaattttgcatgtttggatacagatagaaaattgctctttccagagttttccttctgatattcattaagatgagccctctaacaagatgggataagttgtctttaagtgggcggggaagttggggagaagtctatgcttttgttattcggctcagtgcaagttttggaattgttctttagagtgtactatctctatctctttgacaaaagtaatattacggacgggaataattgttgcttttccttaacctatgccatttattttcttataaataaaacagtgtaaaaaaatggtagtggggaaaaacaaatttatgaaaacactttgctacaacttgtgtttattatagttaacaatgacaaatgtgcaaggagaaaaaccttccttttgttgaaatttgccactttgaccattgctgaaaaatagatctttgggaaagtagaaaatgttaggaatttctttttctgcaaatgtgtgaatacttacaggaaagagaaagttcgtggagcttctgaagactatgtccctgctgatgatttaacaggtggactgtttacttggacttttactagccttcagaatcagggctacttattagtggttgaattaaatgtagggtttattctttcttaccagagtaaatgctgacagtggttaagcaagcaatctaactgtggtattgagaagaccattcagttgctatcttctgctattaaaaatgccttaatggagattacctgccattggccattttttttttaatgtttttcacatggttcttgaaaattatcttctgcactttgaacttaatcagcttgaaagggcatattaaatctgagcttgaaattctgagatttcagttttgatctttaaggcattagcttccaggtgctttcattttcagcatgatggctgccagctgtttaaaattcacgtaaaatcctcttcacctgttgactgaatgcatgttttcactctttggctgcctcagtcactgtgtaattcgtgtcttggtaaattttaccttgaagagaaagtcttaaaattatagaaatagaggacagattagttctcaccaggggccaagaagaggaaagaggggaaggggagtgggtgtagccataaaagggcaaagtgagagatccttggggtgacggaaattttctgtatcttgactgtatcaatgtcaatattttgattgtgataattttgtaatattctgtgatagtctgtaatattctgattctgtaagtaggatttctctgttatccttaaaactgcatgtgaatctacaattaccttgatttaacaaatggttttctgtaaaaaaaaaaaaaaaaaagcagctagttcagctcacactggtgctctttgtgcacttttcattttgtcacacagaatattaaaaagacgagaggaaatgtaataaaattaatattttataaaacaggctgggcgtggtggctcatgcctgtaatcccaacactttgggaggccaaggcgggcggatcacgaggtgaccatcctggctaacacggtgaaaccccgtctctgctaaaaatacaaaaaaaaaattagccgggcgaggtggcgggcgcctgtagtcccagctactcgggaggctgaggcaggagaacgggtgaacccaggaggtggagcttgcagtgagccgggatcgcgccactgcactccagccagggcgacagagcaagactctgtctcaaaaaaacaaacaaaaaaatggtctgggtgcagtggctcacgcctgtaatcccagcactgtgggaggccaaggcgggtggatcaccttaggtcgggagttcgagaccagcctgaccaacatggagaaacccnnnnnnnnnnnnnnnnnnnncgggttcaaacaattctcctgcctcagcctcctcagtagctggggattacagtacacccgccaccatgcccaactaatttttgtatttttagtagagacggggtttctccatatggccaggctggtctcgaactcctgaccttgtgatctgcccgcctcagcctcccaaagtgctgggattacaggcgtgagccaccgtgcctggctgtgaatgtgtttttatatgacatgtgtgtggtaacaaaaaacttcagtctagttcaagttttttttaagtttttaaatatttgggattaattagcaataatattaactataaaaattaaaataaggcattatgccgtgtgttcctgcgtgtctaaatttctttttattcagacatttaaagcacatgataaactaactcctcaggaactgtgcctgccccagaaggttagcatgtaattacagcactgtattctaaattgaatagaggtgtggacagagactgcgactaactcttacacactggatagaggctgcagctaactcttacacacccaggagtcaccacagaaaagcttgctcactctgacacatataacacatggtgttgcaatctgtgtggtgatgggatatatgtgtatgtttcagtgcagaaaggacttaaatcagtttacaggttttggacatacaataaaatagaaaagaattactaataaaatagaccagggaaaatacaatgaaagatcaagactgagaaaaactagcacaaaggtgttccataggagttactataatacaaatatactatgtatatttgtataactataaacaaaaataactatcgttattatatgtttgtaatcctagtttgcatgtttctcgtaatagttttggtgtaggggagaggtgtatgtattaatagcttggagatgaaggaagaaagttttaagagttaggagatacaaatcagcttttgcgcttgaaggttgggttccgggcagagccactgaggcggttgcagaggcttctggcaggaggggtgccttagggtggggtgggtgccctctggcttttgcagttgctcttccacagtcctctcagggcttcattcttcagtctacatggaagttcttttttggctttttgttttggtttgtttttttgagacgagatctggccctgttgctcaggctggagtgcagtggcgcagtcatagctcactgcagcctcaaactcctgacttcaaggcatcctcccacctcagcttctcaaagttctgggattacaggcatgagctaccatgctcagtctggaagttcttttttgaaaaagcacaaggtcactacttagatttctatccacacagcctagtggacatggagataagacagtgaacgctttccaggattttatcattggcattggcttatggttgataattttattattttcatctataatattactagaaacatgaaataatatagtcatgagtaggattttatacccagatcttttagtggattccagtgttaaatcctaggcaaatgtgaagcttgttattttaattttttttttcttttctgagcaactgttcttaaatgcatttgtggcatttgttttgggttattaattgatgaatagatactgtttcagccattactgtatgttacttttacataaactgtaaaagtacataagttgttatacatcgatggaagcagacatctagacaactacaatgtgatttgtttctgggcagaatttttctatcgccaaatctactttaatttgaaattttaagacagtagtctatagatcatacaaagtacctttctcatacttttgctttcctgacgtttgtcttctgctttattatttttcttcttattctatttctgcagtattaggtgggcaagagaagatattttcagatctttcagattcatttaaagtgcagctgtcttccaccctccattgctggttcatagagcagaaagaacaccagccagccagcagctgttaaaaagaaaacgaaaaaaaaaaaagtgactgaagaaaaacagcagttttgaaaaccatagaaaaacatttgtcataatattttaaattaaaagaaaaaaaccaggccaatgtttccaagactagcttagggtgaaataataattaagaccttctgaattgtgctttttggcttattattcccacatgtggatcatcctgaaacaatgatttcttggaggtttgagtaagttttatatgtggttgagtttaggaggagtcacaggtgatttgccccatgtgggagtgcccggtggccttgctggatacttggaaaaaggagagaaatagaagaggatggtcggcttatgtaatgatctcaggctgattaatttggttttactttcagcctctttggtgctagatatcaaaaggccagagaacagaccagagattgctttctctcaaatatatgttctatccccttgccattttccccttaaaatgaaaatgttctccggaaagactaagcatcatgactaataagcatgaattagccagatcatcaaacctctgccctgatatttggaaaaatgagatttgtttggggaggagatggggaagcaacaagggtttatttgtttttgaagaagcagagctggaggatttggagcagctgtagggtggataccatgagcactgtggtaaaaatctaagagggcttgcagaatagtagagctaaaacccccacattttgttaatttgccagtttggctggggattggtgtagttgtttgatactggtgctgaatctagtttgaatgtctgcatgcagactcgtttcctctgggtttgggctggggtgggttgggctgagctgggctgagctgggccaggcctcctggtgtatgggagatggagagataatcacttgctgcttacccactccacttttctaattatcattgccctcagtcctcaacaggatttctctagcactgaagcctgaccataatactcaattgcaggtctgctccacataaaactatgtaactagaggtaagtgtaatttccttgataaaagatctagggtgttggaaacacattctgtggcttaaatcaagatttaggtcaacaaaggagtgtttggcaattttcctccagttctctaaattgtaatgttcatgctctggaatcttagcaggttttaaaaatggaagatcaggtttatattctgctatatcactaccctggttctaaaacagctctccaagagatgctgcttttcttagttctttattctttcgcatgagaaaagacatttttttatctaaattgtggcctggcgtggtctggcttatgtggtcgcacatcaccttcacttgactaattgcccagtggcctgtctgggatgttcagtgagaataaagtaaaagaagagtgattttataaggagcatttggacagcttattgtaaactaaaaataaacatataaataacagagtgaaattgccttatatgtttttgcctttgtttccctgtagtttccctatcagttctagctagctagctttgtagcagattttgcagtattttttgtgtgtgacaatacctttctttgagcacctgaaaagtttacccagggtatggtggtgtgcttgacagatatttaagtaagatgatcaacttgggagaaaagttgtggataaatgtctattcacatataacttacagcttttaaataggaaaaataatagctaatcttaaaatgttatttaagagaaaactgatgggagcatgtcacaaggacccagaggccagcttgtgacaaatctgagacaatttgatcaacggaataattaaggacagaagtgaattataaaccactgggagaaaaacaggaatccatgctgaagatgaatgggggagaaggaaaaggctcttgctcacagtagaatgccattgccaaccagtaaatgtggagttctttaggatattctggacaataaggccatttaaaggagatatttatttctctttagtagttaaaatatgatgggaagaatctagggttagaagggctggattgaattttggcacttgataactttgaccttgggttagtcatttgtcctctttgagcttgtgtttgctaacccataaaatgggggagtggttacatctacttttcaggttgaggataaagttaatgcatgtgaaaaggctttatgtactaatgcattcttgaaacaatatgactgaaatagtgatacaaggaacatcacttctgtgtatctttcttagaatagaaacaaaatttgtaatgtaagcaacttttcattaaacagatattcagaaaaggaatgatattattagaataaaatattaataaagttaaaatagtgactttttatgctttctgtgtgctggacactgtgcttatcacttaccatctattctcatttaattcttttttttttttttgagacggagtcttgctctgtcgcccaggctggagtgcagtggcgggatctcggctcactgcgagctccgcctcccgggttcacgccattctcctgcctcagcctcccaagtagctgggactacaggcgcccgccactacgcccagccaattttttgtatttttagtagagacggggtttcaccgttttagccgggatggtctcgatctcctgacctcgtgatccgcccgcctcggcctcccaaagtgctgggattacaggcgtgagccaccgcgcccggccctattctcatttaattctaacaacgactgccggaagatggtaccaatgtggctactgatatgtagaatttgagtaaatttttcacacaacttgtatctggaaagccaggattcaaattaaagcctaactgcaaaatccatgctgctaaccactgtgctatactgcttcccaaaagaagtctttaatcagttttctctcaacaaaaaggaggggcatccagagtttttggtagtagagaatgtgatcatatgtgcaccagctgcatgagttttggattgcgagtccacatctgcccttgaagtgtttatggaggcttctgtttatttcccattgatcagtaattttttttttttttcgagacagaatcccaccctgtcaccctggctgtagtgcagtggcgcaaccttggctcactgcaacttccaccgctccccgccccggccccggccctgggttcaagttattctcctgcctcagcctcccgagtgtctgggactacaggcatgcactaccactctcggctaatttttttgtttgtacacacacacacacacacacacacacacacacatacacacacatatattttttttttttttgaaattgagtctcactctgtcaccagggctggagtgcagtggcacgatcttggcccactgcaacctccacctcctgggtttaagtgattctcctgcctcagcctcttgagtagctgggattacaggcgcccgccactacacccagctaaatttttgtatttttaatagagtcagggattcactatgttggccaggctggtctcgaactcctaatcttgtgatttgccctcctcagcctcccaaagtgctgggattacaggcgtaagccactgcacccggcctaacttttgtattttttagtagagacggggggtttcactatgttgcccaggctggtctcgaactcctgacctcaagtgattcacccaccttggcctcccggagtgccaggattacaggcgtgagctaccgcgcctgaccataatgttctttattagataccaagtatctcattttcgtggaatatatttaattgcatcaaatataaactcagaatgagctgaatataattaattcagctgcagttacaaattaaagatgcctgggtgacacctaggttaatcatttacatatcaatcgtgcaatagatgaatagacaccataggctaactgctctttgtgtaatgactacctcttactgtgtgcttatggaactttgttaaaactaacttgtgcaacgttgagagacaccatagcacggtggctaagaacttggactgcagtgccaggctgcctaggtttgaatcctgtcttccctggttattggtgatacattctctatctcattctctatatctcattttccacttttataaagtagaggtaatgtagtacctaggatcagagttgttcagaggattcaatgagttaatatctggtacagcttggtatgtggcacttggtacacacatgtataagcaccatattaaaagaaaatctgagaagtactattattcctattttattattaaaagtgaggtttaaatagtaaattgccctagttaatcggctagtaaataagcagaatttccaattttggaactgagaaactaaaacctgcttctgactgttactatacttcatgtgtggcttttgaaggtatttttttttctcctgatgtttttaggttataccctgaagtttttttctacctctaacaactctcgaagtctctaataacagagcaccttccttctgtggaagtaaagcagataaatacttggcaaaagaaaggaaactaccagggtgaaagtaggaagagaaaagacagagagggaactaggtttgacaaactgctgtgtgccaccattcttgattctcagagtgctgttaagggcttgctatccctttggggaaactgaggtgggaatttatgccacctaaattcatacagctaagaccgtgggctatcttgatcccaagccagtgctttttccatgacaacatgcctcttgaccaaaaaaactgggccctgtaaattttctgtaagcttactataaggccatgccagccttttccatgtcatttggatttatatctgtatactgtcaaagaatcaggaccaatactgtgtagagttttttgtaagtgaaagggatgatctctagaaatttgacttaagatgagaaaaattgaagttcaagttccacagctacttagagacatagatagggccagacacctagctctcttgccaatgcatgtagtaaccatttgtcttcctgtacctaggctgtattcacccagaattgctgaaggttttgacttgttatatctgggatgaggtataagaatctgcctttttaaataagtatctaattcaggtgcaaagagtctgagggctgaactttgagaaagactggtttatatgaacccacttatagtagacaggtcaggaatagcaatacaatttacaaacatattgaaaaaacattcattctggacctattaggtgccagacactggcacctatttcctttcaaaagaaagaaaatcagttctacccacaaaggcattacagtccaggtgaagtaaagtcaacttagcaataaaatgttgcagatgctacaatgaaagtctgtgtagggcacactgaggcatagggaggaattcttttctaccaggggtggatagaaagaccgggaaaggcaccatgggagtgctgttagaactgagacttggaaatatggccaagtgagcaaaggtgcagaagtatgaaactagcagatgaaaactgcaaaaagccacaaagataggttgaagcaggaatctgaactaggttatggagtcatagcagacgttctgtgggtgcccagagaaggtatttttcaagaaaataatctgtggtatacaaaaagaatcattggcctggcattatctaggaagttggattctcagaagttgagttagatttaggtgatttttaggtaaatttagtggcttttgtttaatgctttatgatattgttgaatgaaattcatttatctatgtcaaattatgttcacatctttgtcttttaatatatttgtacttgagtaactatactcccagaaagtaaatactaccgtgttgctacctttaggcaaaactatcataccttttaaaaagatcttgcccccaaaaaaacaaacagaaggatggaaaaagaatttaaaaaacaacttccacagtctctttccagttttatagtactgagtgattgtctagtggttatgagcagaccttgattcacatcctggccctcaattagcagctgtgtgaccttgcatgggttacttagctaggctgagcctgatccttcacctgtaaaacagagataactgctgtgaggatttagtgatagacacttttcccaatgggcaaggacagtgtctgtcctgttgactcatacctgcagtgccctgcatgatggaggcatatatggtacccagtgaaccttatattatagaccctccgtactatcacctcatcaccaataagcagacaaaaaagtgccaccactcaggggtttaggctgttatatattttcattaaaatttaacctctattgaggttccaagaatcatttcttcagcgtaaagtttccctgacatatgctgaggtaaggaattttatttcataaatgtgtatactattaattttaagtgttcttactcttaccctttccggcacttcctacttgaagtgtctctgtttagaaggtcactgaacacactctactggggacatctgtctcgtgtaggcatcatattgggcacagctgctctggcagcttgccctccctttctcacaagaattgctgcagctgactggctctggggccattctgtccctagccctgggcctcctttctgcttgtaggtggcctcactgaaatgtcctgagattcaacttagatgccatctggggctgagctttggacattacaaaactccaggtgtacatgagcagcattctcatccatcagaagacttgcagaatttagagcaggaagaccctgtggagagcaagtttcttgctcttttgtgtgaggaaactgagtccctgagacattaagtgattggctcaaagtcacaaaggtggttacgggagtcaggactagaactaaggtgtcttgactctaacctaaatgcctttaccaccttctcagaactagaaagcatttctgtactgccaggtaacaggtagcttgtgtccgttacttcttttttttttttctgttacttctatatgggcaaacatatatcagaactctcttgcgtgtttaaaaaagaaaaaagctgctttctcacgaacatttggtgggtcacagcccacgtggggatttgtcagactttgtctcattactagactactttaccactgacaacttggtgatagaatttcaagcagtacttcaaaatcttaaaaaagctctcacatctagagtttacaggaatcctttccagagctcagcccctctctacaattttaactgttctttttcatgcttttccgtgtaccttagcaacgctgaaaagctgagtataatagcagaatcacaaatatctctgaaacttttgcttcctgaaacattcttagttgggtttccctgttgactggaaaagggattttatttttaacagagatgcacagtttgaaaagcagagttaacgtcactgagaaaaggcagaaatctgaagatttttttctcctgagagaaaaggaaaagagatcaggaaaagaagatagcttcagccttttaaagacataacacaattagacattttcaaatgggtggagaggattggtgaaatcacctaggggcgttttttcagaatatatttgaggggttagggtgggagaaaagatttgggtttttaccagagttagagctcctaggatacaagaaggacatacatggtctgatttttaaataactcggaagaaattcatgtgtacaaagaaagatgttttaacattgggctcttctttgaaagcagattcttattcaaattaaccaataggagcagcccttaaagagggaagtcccacactttagccatattttgaagttaccaaacaagggtcaccttagtgcactaagaaagtggttccccagaaaagtctacgttcccatatttgttttccataaaataggaacagcccgagacatagaacaagtcagagggaaacactgctcaccctctctcccttcctattggtgatctgagttgggcctgcagtttgcaaatcctcattctttaggctggtaaatctctcacccaagaaatgagaattgcacaaagaaagtgtgcttaaacatgaataattatctgaatgtttcttctttcctttttgcctaatagaaaacatattttaattattctttactgaaatcttgctgaaatgaaaggagcatgaagtgggggtagagcgagagacatctgggagagaaccacgcattgtccttcaggattccacacagggagagaggcctgggccttgttattttagagcagcacgtgtgtgtaggcttaacccagcctgactaacttctatgtgtctcctctctgccacattaatacttctttctagggctggcagctgttccagacctgtctctttactttcctgaatttaattagtcatcgcttatagttagtgtgaacatttattgtccaagccaggaggcttgaaattgacaagagtcacctattactaattacattggacaacaggtacaaattgggactatcccaggcaagctagaacttacagacaccctacttatacagtctccagggtgggtgtggtggctcatgcctgtaatcccagtgctttgagaggctgaggcaggaggatagcttgagactaggagtttgagaccagcctgggcaacatagcgagaccctgtctctacaaaaaataaaaactaactgcgcatggtggcaggcatctgtagtcctagctgctcaggaggctgaggcaggaggatcgcttaagcccaggagtttgaggctgaattgctctgtgatcatgcctgtgaatagccacagcactccagcctgggcaacatagcaagaccccagctctaaaaataataataaaatttgtttttaaaaaagcaaataaggaagtttttgtaagtgctgctgtggaccatgtggtagtaattaccagttagaagatacattggagaagaagcctcatttaatctcattgaaaatagcaacaacttgataaatttaacaagaaatgtgcaaatcctatatgtggtgttaggaactgagttgcatgccccaaaattgatatattgaagccctaaccccaagcaccatagaatatgactgtttttggagatagggcctttaaaagaggtaattaaattaaatgagaccatgagcatgggccctaatgcagtctgactggggtctttataagaagagggatgaaacatgcagagacctcaggagaaaaggccatgtgagtacaccctgaggaggcagctgcctgcaagccaagaagagaagcctcagggaaaccaacctgccaacactttgactttggatttccagccttcacagcaacagtgagaaaataaatttctgttgtttaagccgccagtctatggtattgtgttacagcagtgctagcaactaatgcagacaatacttgtagaacacaaaagtaggcttgaacagaccttcctacatcttcagaagggcatttcagcatcatcaagatattaatctttacttaatttatgtatataatgtgacctcaataaaagtattaataactttttttaccggaggtaaacaaggtgataactgaagtcatatggaaagcttaagcatgcaaacaaaacactgaaaaggaagaactgtgagaggggctggcccctatcggatattaaaatctctataaagcctttataattaaaacagagtggtactggggcacagactagaacaggatgaaatgtagtggaattaaatgtctaaaagactcgaacatttatggaacttttttaaagcggcaactccaatcactgggtcaaagatgggcttttaatgaatggtgttggggttaactggctaaccatttagagaaagataaaattagatccattcctcataccacaaataaaactaaactccaaagggatcacagagctaaataaattatgaaactttatatgcactagaagtatgcatggatgaattcctccttataatctgggtataggagaaggctttctaggactcaaaaataaatatgcaataaaataatatgttgataaatgtgcctaccaaaaaatatacataagtgaaaagacaaatgatagtcatggtaaaatatccacaacatatatcacaggctagtatctctagtatgttgttttttttaatgaaggatgaaaataccaaaaatgggcaaaaggcataagccaacagttcaaagaaaaagatagaaaagcgctgtctgaaatacatgaaaagatgatcaactttcactataagagaaatgtaaattaaaattgcaccaaaatgtcatttgtcacccatcaggttgtcaggattcagaagcttgacagactctattctggaaggtatgggaaaaaggcactcctatgtgacagtgcaaaatggtgcaaccattggaaaggggtacttgacaataacaaagttatatatacatttacccattcacccagcatttccacatctaggaatttgccctgaagatacacctttgacagtgctaccatatatatgcacagtcattgcagtattacattttctggtaaaatattgtgaaatacctgaatggccagatatgggagattgttaaatcacctttggtgttgttatctgtcaaaccacatgaggaagacctctgtgcactaatatgaagtttttctcatatataggtgaaaaaagcaaagtgcaaaagagcctatatagtaggctatctttctttttagcagtaaagacgaaataagaaagcatccatttatctgcttgcttttttcaagaagaaacacaggataagccagaaaaaaatgaaattggtgaccctaggaggatgttaaaattggaggactaagttagaagggatgtggtagggagtatattgttttgactttaaaatcatgttaatgttgatttaattttgctttttaaatacacacaataagaatgagagaggggaactcctaaaactaagcgcaaatagcaacagatatattcaaataaactaactgtgaaagggagaaattgaataaaatttcaaagtaataaaataacactgaagagaagagagggatgaatccaagtagattttgaatgaatttgaatgaatccaagttcttagtataccaaaaaaaaaaaaaaaattaaagagaataaacccaaaacttgtcttagtaggtttattttataatttctgaaattttttcagtgtatcgtagaattaagcacattcataaatattttgatgttggtagccaaggttctcactgttgaaataaggagatacagataggaaatagagaaaggcaaatgaaaaccctgtggagttggcttaacacttggatgtaacagcataacccaatttccagtacacacacgcacacacacagggcttagaatcaatgtggctccagtagacatacagaagacagccaaatcccagattttggtttctaaatactattcctcactaaagggaaccagagattgctggagtggtggaaagggaaggtaagagataagcctggaatgtcttgttccagaaattaagaaatactcaaataattggaacatgttacaaaggcacagggactagcttgaacaggcacccaatggccaaatctaagacaatatgaccatcaaaatagataaagatatttatagattatagctcattgattaagaatccatgaagccatactgatgactgttatatataggcatatagacacaagagatggaaaagcacgtcttcatattagaattctgactaataatgaaggaataatggagttaaagaaaattcagttcacaaccattatagcaaaaatttattcaagcaaaatggatgctaaatataggggataaagcttgataaggaacaggatatttacacagtctcgtggtatctctcactacttattaattacaaaaggaaagatagagactgtctacggtggaagaaatgcacaataccttaaccaagtgatcaggattaaacctcaaacaggcagacacatcgtgtgcttctgtgcatgtgaactgagaagggaatgataccacttatctagtagtccaaccaaaaatctcagagtttaatcacggggaagcattagagggacccaaattgataaacagtctgtaaaataactgcctgtattcaaaaatgtcagtagcatgaaagcaagaaggaaaaaagacgctgaagaactattccagattacaggacactaaagaaatatgacaacgaagtacaatatgtgattctaccttaggtcctgtatcaggaaattgctacataggacatggttgagacagttgacagagttggaatatgattttatattagataaaatcatcaatgttaaatttcccaagtttgataacaaatgtgtatatgtaagttaatgttccttttgggagttactctgaaatgctatagggtaaagggacatgtatgttacctgctctcagataattcagaagaagtgtatttgtgttctagggctggggaatggaggagagagaatgagtaagttaatgtggcaagatgttaaaaattggtgaatctgggtaaagggtatttgagtgttctttgtagtattgcagtttttctgtaagtttgaaattatttcaaaataagttaaattttttaaagttcatagaagtttttataactgcctcaaactggaaataacccaagcattgagttggttttttttcccccaacccaagtatttagcagcagaagataaaattgtatcatcagataaattgtagtttatatatataacaagatgctacacacacacagcattggatgagtctcacattttgaggaatacatatgcagattttcaacttgggaagcagaaatacattgccctttgctgtggctattgcaaaggctagttcttcctccctcactgcccccatctgcaagtagtaggaacaagtaagtccccagttctaaaactgttaggaaacaagagctgctaaaacagatgctccactaagtgttaggctggtgcaaagttgctgcagtttttgccattaaatgcaaaaactgaaattatttttgcaccaaccttaatggactctgtgcgtgtgtgttgtgagagggaggggtcctctgaaggatagaggacatgaaggattgctgtctggtgctgcatttgtggggagtggtttaggggccaatgtttcccccttttaagggtaaaaatcataattgagaccatagctagatgcctgtaaaaggcaagttgggaaatggtaattcaagtcacagcagctaaaagaaaagggaatgtttgtcattgcaaaggtaattgaaaggtattggactgttttggaatataaatttttattggcattggggatcccttatcaggaatgtttcttcaacaaaacaaaagcattttatagttcagatgactattgaaaggtagaagaagaatttatgcttttaatggtttggtttgggaagattccatcactgtactaaaaagaaaatacatttattatatactcaaaagatttgttcctgaaggatcaaatagggaaataacaaatctgatgctatgggattatgtaggagtataaaatatagcacatgagaaattttaatacttttttaaaaacctgtttttatctaaaaagcaattttcagctcataaaaaagtgataatccaagtgttaagagcactttttactgtagaaatgatataaattatgcatagattccctggaaagccctcaaaagtctgctaaattcctgttgccaccaaatattgtttctttggggaaatatattctgattcctaacaaccaacaataatcataagttttaaatctctcctctctcctctcatgcagtttatgaaacgggctgcttttctgtttgtagctgaggccacaggagctggagggattgcaaagacctttattagagcatccatctggtgaccctggcagggaaacttaggatctaaccctaggatctggctagggctctgtaactgactgttagccagccctgcctctccaggataattatatttatagtggctttgcctcaggaggtttctggaggttgatgaccatgccaattattaactccttagcttcctaatgtagaacatttaggagtgacaggagttgttttctttgcttctcaacaggtgcctacctattgggccgcctttgtaccttgagttttcagttagcaaaatgtgaattgtatgaactaattcttccttgacctcacaggtggtggtaaggattcttgaaaagtgggtaagatccttagaaaaaagatgttcataaagtgtgactcctaggacaggatacaagataaattctgtcccacaaagcacctcatattttgtataattaactatcttcatggcatttgcattttctacagttcactgattttacctcttcagctttatttactatgctgcttttttgtgttaaagtgaattagtgtgtcagcttaaaacacttgtggtgaataattcatatcattcaataagcattaactcttaaatgtgaagtcttatcagccagggctgtgaaatataattgtcaatggtgataaacaattatgctttggtttttagtgaatgaaaaaattaagaatgagggaaccttaacatttttaacctaaaagattgtattttgccaactttccttgggcaatttgtgaatactgcaaatctcaggcatatgtcatcagtgattctaaagggattgtatttgttcctgcatttgttcttgagggtaaaatagcttttcatttgaatgatgcttttgagttggcagcaggacagggatcagataatttgttgttgtttacagattatgttttactttattgtgatgtaattatagatcataattctcatgtttgtccttctcttttttcccttcctttttctagtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccaggtaggttggaatgttcagtgatgttctgtagtcatatcagacagtgttatcacagtgtcacggaaaagctgggtcaacctgcagtggagggaggttttcagccctggtatatgacatagtgctctcgcacttttaggatacaacttttggtgaaaggagacctcatagtcaagtaagcaaatgtcttattttatttgtcaggcacagatgcttgaataagctatattttccccttgtttttaaaaggttttgaaacagctgcatccttctgggagtggcataattgttacagtctttactcttgataaaaagaaaaataccgtgttacacacatttgctcttatgagaacacaacctcaatcagcatcgttttcatacatggaaaaaactcctgttgcaagtgcaacctcagaaaaaatatttcctgagggatcccaccccctacttaattaaattcattcaaatgatgatgtaatcccaagaaacgtatactttaacaacaaaggaattacaacagaagtactggaaaccatctgcttgttcaacttagcaaagacaaaaaacaattatcctctttttctagacataactgttggtgtaatggttatcaaaataaatgattaataaggacattatatatttttaagttacaggttaatgagcaagcatctccaaaaaaaaaaaaaaaaagagtgccaaatttcttgccagtagactttaagaaagataccctaaacaaaaatatacttaacatctattaatgttttcggaagggaaaatgactgggcaagtgtgtttattgggctgcttgaaatgtttttaagtaaatttgaattcaacatcagtgctaggccttcaaaaattgaaaagtggtccacatttatattgctttcttttatttatgtatttattaccttcttttatttaaatcttgtttatttcacattgttttgtccggttttcagtccaaagctgtttgggatgagggttgggagacagactagtttaaaaatcaaagtaactggtgacttcctgtctacctctctcccttcctcctcaccactaacctgtatgatgggcaggttagtggtgaggagatacatttcagaagacttttgagcagtggcagcccagagtggccccaagattgaattaaaggttattgcttgaatttacactttgtccctaaatgtcagggattaaggcaaaggccaagtaatggaaatatggaaaacagttgcaagggatgggaggaggtgcctgtaggaatagtagaatagtatcaagaattatcgggttcctcttggttgtgctgatgccataggttgccaatgaaattttcaccagcttcttggcagaaattcattgacttgggctcagaggaggctctttgtctttgttcctggcttgagataaagccgagtcagccttacagctgcagagaagaggctgaattaaaagaagctgaaaaggggcaaaagaggcatccagagaaggtcccagtagtcccatctcagtactatgagttgttgcttgttagcagctggatgtgaagttaccaggttgtgattcagctggagagtgagtcttggaaatcactggggctctctgaaggaacaacatgagttgtttgtatttgacagttgctctgagtggtctcgattacttatccaaacattcacgattccctcaggtaaaattttgtctccaaggctctgacacatatgctagatgggctcatgatagctagtgaggagcttgcttttggatggaaaaggattatttgtgagaaacctataccctttgttttatattaagaaaatgcaagacttgtgttagtgttctttgtttaaaaaatcatgtttgcctcttatttgccagaagaaacatatatgtaaattctgaaataggagatagctgtgataaactgattcattttctgttattctgttactagagattttaaagctagtgattatttaaatgagtagggagagtgtggtcctaacagattccctaaagtcatggaaaattaacagttcaaatcagtaggctataatgaaacttggtgaattttctaaaagcccatagatttaatgcaaaagaccctgaagctccttttcttaagaagtccagtgaagctttcagaggttttccatctatcagtgaaactgaaatgcagaggtcctctcaaagcagattatattaaagtgtgcttaaaatactcttctgattgcttttaaacagcatgatcctgcataggcaaacagcttctggaactggcatatagtataattcttttcctcccactgaattttcacaaaaatgtatatgattgtggcatggttaatacttttcagaaattgtacatcaaggcagtgcctgtagcctttagtcttttaatggggagattgaaatgacaacttgatctcttgagaatttcagtacagaagaggatacgtgttttgagcatgtatgtttactaagggttaagaaataacttctttaaaaactttgtagctgatacgcccccacctgcttacctgcctcctgaagaccccatgacccaggatggctctcagccgatggacacaaacatgatggcgcctcccctgccctcagaaatcaacagaggaggtaaaactaattgctgcctgttcccttttttagagtctaaagtttgtccagatgttactttctctcacaaatttttattagtctttaaaaagagagctacttgagaaaaatagagcccaatgttaagagaagctcactacaattgctggataacaagtaagtctttaatttaaagaacaaatacactgacttaactaatgaagatctgagaataattttgcagttatctgtttagatctttaatacttaataatttttaactgatgatgaaaattttttttttgtttttttttgagacggagttttgctctggtcacccaggctggagcacgatcttggttcactgcaacctccacctcccaggttcaagtgattctcctgcctcagcctcctgagtagctgggattacaggtgcacaccatcacgcccgactaatttttgtatttttagtagagacagggtttcaccatgttggccaggctggtcacgaattcctgacctcaggtgatccgcccaccttggcctcccaaagtgctgggattacaggcgtgagccactgtacccagccaaaaagagtatttttaaatgaacaaaatggtatttagaaacaataagtataacagtactgaagtagagttttcactggtgatttccaaagttggaagttggtataactgggctgtccaaaggctttcttctgtaattaggatagatacacataaaccccgtctgtttttcagctcttatgtatgtgcaactacaactggaacaaactaatagaatttcttgctatttgtttctaactttgttactaaaaggaattgaggcacaagtttttccccttctcagcctgaagaacttgcaagcagaaatgaaaaatttctttccccctttagtaaagggtgggtctttgattccagcgttgtatatatccttagcagtgaccgagtggaggatgccatcattcttccagctctacataggcaagtaggatagacttaagtgagcagagaactcaggtaaataagttcggtagactctctgagaaatctgttagaatccacagccaccctggcaaataaaactgctcctaaataacctctcatgaaagaaagtgctttgctgctgcactcaacacatggcatgggtcatgcaatttatataatgtttatgcaaattgaagttaaagtacagtttggttactaggtatgtcttgtttcattttagtgcttttttattaaaataggagatacttattaaaataggagttgcttatatttttaagtacttaaaattgattttgtctctatgacacattatacagtggtaactgcatgtcattatacatttatccaaacccataggatgtacaccataagtgaaccctgacgcaaaccgtagactttggttgtaggtctgtaggatgaatgtcggttcatcagttaaaacaaatgtgccactctggtgggggatattaataatgagggaggctaggaaggtgtgggggtggggggcatatggaaaatcactctgtcttatactcagttttgctgtgaacctaaaactgctttaaacatcgatttaaaaactggtgatgaaggctgggcgcggtggctcacgcctgtaatccctagcactttgggaggccgaggcaggtggatcacctgaggtcaggagttcaagaccagcctgcctaacatggtgaaaccctgtctctactgcagatgcaaaaattagctgggtgtggtggcgggcccctgttgtccgagctacttgggaggctgaggcaggagaatcacttgaacccaggaggcagaggttgcagtgaactgagatcacaccattgcactccagcctgggcaacaagagcaaaactcagtctcaaaaaaaaaaaagaaaaaaaaaattggtgataaactcaaaggacctttcttggatgtgcagtgtcataaattggaatgtacaccactttaatcattatgattttttaaatcttttttattgcctctgtattttatggttcctgattatctcttgaacatcttatcaaacataattctgagtcaatgaacactctggttgggggaaataacccctatctcacacatctgtggaatttatatttggggaccaggataccaggagagaataggcacagtaccacactattaggagcatgtggacccagtaactattattactaaacccaaaatgtctgatttcaggaaacagatctttaaattgctttaagatttttttcatttaaatagctttaatttttttttcctttatagtttatagtcagttaatattttcacgaggaaggaatgttggccattttttttcttccccccgctttttttttaacttgtttttaacctttggtgattttcctagagcaggggtgaacaaactacagcccacaggccaattcagcctgctatctgtttttgtaaataaagcattattggaccacagctgtattcattcattacatattgtctatgactgcttctgtgttacaagggcagaattggatagttgtgataaagattatacagcccataaaatcttgctggcctttcacagaaaaaattcatcaacctctgacctagatgaatagtattttgaagtatcctgatagctgataaaagccttctgctaataatgttgcagtctgctttaagatttggcacttgtaaatcactaaagttttgctctttgaattatagcaaattgatgtggtagagttgcttagcaagcagggaagatagtgtatgtttttagctaactacttacatatgtaaagcgactaacttatgtgtgggttttttcatgagtattttccttgttttttttgtgtgtgtgtgtgtgtgtgtgtgtttgttattgttgttttgttttttaccaaattctaaagtaaagtgcattttagtatttgtggaatttgatgttaagaacacagaggtgcttctcccttagcagttgtagtctgggcttctgatgtggactttctttcttttcctccttttattattgtacacccaagacttcataaacctcagatcattatatattggtatgctggaaatatatggtttgtattcctggaatctctaaaggagtggtacaagaggttttactacagaaggaattcatctttaaaaccttttagttgcaaatgtttagaaccatgttctgtttggagatttgttagtcttaagagatttgacttaacaagctgcatcctgtcagtaaagttgggtaatttccattgttggcccattctgggaatggagagacaaaacacacctgctctgcatgacttaaagcaaatataaggaagttagcatgaaatctggatgagaaagatatgattcattctgtaagaatggccagctggcaagatttcttcctgagtttgagaactggagcaacactgtagctgtgatagttattggcaacttaatatgaggtaaagtaacttcttatcaataattagaaactgattttcatggctttgaataagcataggcatacttagtctttgccaaaagtaattcatttttatgccagtacctttggcatattttcagtcttctattgttctcttcccacttattttttcacttgtcacttgtgtttctttagatggtgagccaaagtctgtggtaggggtgatttccatttctgcatattacagagcaattagcatattgttaatattcagcaaaagtttttgctgtgcttccttagctggtgttttggttatctgatagtaattggagaaaattgttctccaattttctccaattaggagaataaggagagtgtcatattaagaagtacctgctttaaacatcatagaaaaactgtatacattataatagcaattgcttttccagtgtcttcattccatgatcctgagccaattcaacaacacggtttcagtttttgagagcctgaggcactaaccttggttgatataacattttctttcctctagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggtgagtttttgctttaacctctttcagatgtttatctgttgtgtccctgttcctccagagctgacttaaaatcattcctgtaacaaactgttgtagcaaagaccaggtaatgttcacttgctgcagtttgtaaatatttttccagtttctgctatctggaagctcttgcagtcagtgatttttgtggtcgatcaactcataatattgaaattaattagttgaaattatgatttgccattttaagacactattctgtatgatattttgctgcagaataaattggctgttataaaatgaatcacaacctaaaattaaaagcaaattacagttaattgcttaattgtatttcaaatgaataccataactcagtaaatagaaaagaaagaactagattttagcacaaacatcgtgcaaggtggcacgatagaaccctgcagtgattgtacccccacagggacaccaaattgaacaactgtccatataagacagcaccttcaaaagaacaaaaaatcaggcatggatatatttataataagaaaaaataaagaccaaaaaacaagcctagtaagttatgaatatagtaagtgactatatatcctcagcctaggctgagtggagtagatagagtaggggtaggatttcaaataaatcccgaactctttttagtaaacttgattatttcatagcagtatgagtgaaaccattctgaaactttcatatgtaaagatgaagcaaatgactaaatgtgtggatattgttgggagcttgggtttccactgtggaaaacagacatataaatgcggaggggagcaaaaagtaaaccctgtgaaggagaatagaagtatcagtgcaaaattctgattttagtaatacatatgtgtatgtatgtatgcatgtttatgttctcatgtattacgtatgtgtgtatgcatgggtatgtatatgcgtttttacttgcgtatagtttctgatctgccttgctgaaagggcccagaagcatacatacccagtagcaataagcacatctagtgttcagatcatcatcgctaataccatgtcccactaaaaggaactagggctccttgaagaaatggcttacccctaggctgggataggtaggcataggaggaccctggagcatcttgttgtggcagaaagtaaagaagtgcttatggaactcatggggcatgcctcaggagccaacttagagggccttccactggccaactctcagacaatttgagctccaaaataattacagtgatgaattttacttcattttatttatttatttatttatttatttatattttatttttttttgagacggagtctccctgtgtcacccaggctggagtccagtggtgtaatcttggctcactgcaacctccacctcccaggttcaagtgattcttgtgcctcagcctcctcagtagctgggaggttacaggtgtgcaccaccacactcggctaatttttgtatatttagtacagtctgagttttaccttgttggctaggctggtctcgaactaacctcaaacgatcagcctgccttggcctcccaaaattctggaattacaggtgtgtgagccactgtgcctggcctcagtacggtattgaattttacaccattgaaaaacaatacaaatttataagtccatactcataataaatagatagataagtgaatggggaaggctggttgataaatgtagagtcagtgctaaagtttgaatatcattttgcaaccatcatagtaaggatcaggcaagaatcatcaatggatgctaaatataaagaaaatgtttatgagaatcagtttatttgcatggtcttaagagtgtttaccctcaaactgcctattagtacaagggagaataaaaagcattaactaaacagtggagaaaccgtatcatttgtattttaattgtaattgtataattgatgccctgttttgactgggagatcaaaattatcatcaccaatgagagacagatgggtatcatatacctccagatgtcataccctgagaaggccataacatcacctacgcaggattccagctgagaatgcaaatccgaatctaatcctgaggaaatatcagacagactcaaagcaagaaacattctattaaaaagggtgaagaagggggagtaattctttcaaaatatcaatgtgaaaagacaaaggtatggaaatgttccagattaaaagcagttaaagagatatgacacctgcatgcaatatctgaccctggacatgatcctgtgctgaacaggagaaaaaatattaatactgtaagggacattattgagatcagcaggcaaaactggaatatgaatggtagattagaccaatgttaaatgtattagcattgccaactatactatggctatataagagactatccctattcttaggaaatacttaagtatttaaggaagtggttcaggaagaaattagtgtataaagatacctgtctactcaccatctgtctatccaaaacctgtgttacaatacatacatacagacagacacacacatgcacggtgcgtgtgcagcagcagtggggaaggagagcccaagtgatcaagcaaatggagtaaattgtcacaatagatgcatctggataatggttatatgggtgttctttgttctgtttttctttgttccctttcaaacttttctacaaatttgaaattatttccagagtaaaagtatgaaacagtgacctactatgaaatttagaacagtggaccagattaaaaggttatttattagatgctttaaaagcactcaagataaagtgtaacatttaatcctgaggggaagaaaactccaactcttaaattaggaattgatagatattctcttatataattaaaggaaaaaactcttgactgtaaatttaataatgaaatgctagaacctaggttcataacatacatagatatctttctgtggtctgtaaacctctgaaattgtatgtaaacacaattttgcatacatttgggagggaaagacatacttttcgttaaactctaaagatgactcttatcccaaagtagcaaagaaaaattgtgctatgggacatttcctcctaaaacattattaagaaaataaagaatcttggaatgctgttatttaaaattgttccagatgcccttagtagtgtactcaaatatacaattatagataatggaaataaggcaagatgatcattatgtgtagatgatatgtttgattgacagtattctcgggatagattcttgaagtgaaattagtatatcaaaatccattgatatatttcaccaaattactttccaaaaagtaattccagtgctttgggaggctaaggcaggtggatcagttgaggtcaggagttcgagaccagcctgggcaacatggtggaacccgggtctctactaaaaattagaaattagccaggtgtggtggcacacgcctgtaatcccagctactcgggagacagaggcaaagttatcacttgaatttgagaggcggaggttgcaatgagctgagatcaagccactgctctccagcctgggtgacagagagagactctgtcttgaaataaattaattaattaattaaaacaaaagagataaataaatacagacatacataaaatgaatttgcactcctaccagaaatatatgagtgcctttctcccttcatccatgccagtattatagttgggcattgtgcctattcaaatgatatgattatttatctagaaacctccaaagaatctatcttttaaaaattatgtaagtcagtttcctttaatctggtaataaccagttagaaatataatgaaaggggaaatatccccttcccaatagccacagaaaacatcagtttcttggaaataatctgaacctgcaatatgtgagaattacatgaagaaaccaaattttactgagagaaagaaaatttgaataaataggcagtctgtgttccttaaagggaaggcttaatattgtgagaacattttaagcatattaattccatctaatttaatttataatttaaaacaactcttttcagaatcacaatgtgatttttttgaaaattggaaaatgtattctgaatattctgaatattacctggaaggataaacaagtgaggctagctaactttgtaaatggaaaagtaaagaaaaaattatcggcattagggttaataaaacattgtaaaactacaagtaaaccagtgtgtagacaaaacagaatgagttaaactcagactatactgttataaaaatataatgtatgttaaatgaagcatagcaaatcagtagagtcttctaatggttctacaataaccaagttagcgtttgggtgaggctgggaaagagaaaccctgacctcataccatatatgcaaacagattaatgagttgaatgtttttcaagagtcaaacaattaaaaagctagaagaaaatatgcttgatcagagaggtggaaattttttaagcataaaaagcaacaaaagaccataagaggtttaactaagagattgcaaacttctgtaggttaaaaatatgtcacaaataaaattaaaagacaaaggactaacagggaagcaaataagaaagtatatccttcttacatgaacagttcattaaaaaataaaacaaataggaccccagtgagataaataggtaagaaatgtgaacagtgaattcacaagagaaacgcagatggctaataaactacgagagcatatccagcctcacaggcaaattaaacaattatttgtcaactataaattagggacgttttgtttttgctctacactcaaattcagtactggcatgggtgaaatgagaaaagcattcctacactgctggtgacagtgtaaattgatgcattctggaaagtcatttggcagagttaatcagcagccttcgatccagtaatttaacttccaggaatctctcctaaggatattatcaaaaattgtccagagacatttatcatggcattaactataaaagcagaacattgctgtcatcccagtggtccactaatgggaaaatcatttaaaaaacattcatacaatcatggagatattttaaatgtttgcaaagacattttaatgatacccaaaactgaatacagtgtatcaaactattaataattattgcctctgagtcactaaaagagtgataatattttctgcttctttatattttgatttactttctgatttttcaggatgaaaatttgtcatttttatcatcaggaaaaattagtagcacacacactcttaaattgttttctctatatcaggccaaaaaaatggccttctgctctagcagctatttaattattacagaaatcctaaccgctgtgtatacatataaacaaaacttgtaatgttttctgtgagacacaatatagccttgactaagccataccagagttacctacaaggtggatcatttaaacccacatgggatctaacgctgctgggtgacctgtataaagtcatcttccataatggtgtggggctttgtgagaatgggtttttttacccctactttcctttttttaaaggcagggtaggcccaatttcctacactttaagcactctgggtctcacaggaagaagtttggagcaggtgatagttcagtgagatctaattttacacacacagtatgacttttctagtttcattttcatgtttttttactggatcttatatcttacagctttcggcaatacttcttccacctgtggctttccagttcctctcttctctttctcctttcttccctttctaaaattttccaaacatcttagctgtacaataaatgcaagagcgctttatagtaaatacatagcatccaggttttattatgctatctttttagagtgaaaatatactttcaatgtgtggccaaataggacattaatcacttaccaaaatgaaattgctgcatgttgttgttgttgttgttgttgttgttatttgagatggtctcactctgtcacccagtctggagtgcagtggctcaatcacagctcactgcagcctcaacctccttgcctcaagcaatcctgccacctcagcctctgtgtaactgggactacaggtgtgcacccctatgcctggctaattttttgtattttttttttttttttgtggagatggggtttcaccgtgctgcccaggctggtcttgaactgagctcaagcaacctgtccaccatggcttcccaaagtgctgagattacaggcgtgaacaactgtgcctggcctattactatttttaaaacattttgttatgttattttctagaaacctcctagatactgtattaagtaatgcggttaactaagatttttatcagtcatacatcagccatccccagtctttttggcaccagggaccagtttcatggaagacaatttttccacaggggatgggaaagggatagtttcaggatgaaactgttccacttcagatcatcaggcattagattctcataaggagcacgcaaccttgatccctcccatgcacagttcaccatagggttcatgcttctatgagaatctaatgctgccgctgatctaacaggaggtggagctcaggctgtaatgcttgctcactcacctcctgctatgtggcctggtttctaacaggccacggactgatactggtccatggccccgggggttgggaactcctgttgtacaggacctagagaatagctagctaactagccaaagtttaaatccatgtatatttaagtttctgtgttgaagctgcacaggtgcctttgagctgtaaaaattaataataactaaatggtatgctttgtcttcctataggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaaggtaagtgagctccgactcctccatttagggcctaacatacttttgctgtgctttttttttttttttttggcgatatatgaatctatatcctcttgataacatattatcatattagctgacttattatctaggcatttttaaactttaacaaaaatttcaattattaggaaaatatcattggaacataggagtacttgtattaaatatcaatagcagtaggttttactagccttttccttattcagatagcaccgctttagctattgtattaccagtagaatatgttatgttatatatttaacatataatttaaatacatggttgttttacgagatcagttgagtaagcatatcttccttccttttcattctttgttttttgtacttttatgatggtaatgcttgtttttgtttcaacagtaagcaagtgatctttttgtaaaaattaaagttcatcacattggaaattgtgtttggtcaggttttttttagtggtttcagtaagcttcatgattttcttacaattcagaagttaataaggcccttgcccaagataaatagatgccttagctcaaagattgcattgtaaggtttgatgagggaagaggttaaagacattgctcataataattgatctttttgctgtctcatgttctgcctctgagaaataaaaatttttaagatgccattgaaatcttaaaaaccttaaatgtctgattagatttctgagtcagtgacttttctagtaactgacctgtctctgaattctcaaaaataaatttcattctctcgtactttgagaaacagaactaattatatgtttgagtgaggcaattatcttttatgtcttctcttcagaagctcaccaaacttgttgttaaacctgttttgtaatgtatttattactgaggataattttggagccttacttgttaatcatcccttagatcaaagatatcttttcctgaatatagttacttttcctacttatttaaagcatcttagattttcagtgtgttcccttagtgtttgtttttgtgtgtttgtttgtttgtttgcttgtttgctttttgcagtatacttcaacagttatttgtagttgagtctggtaccttgttagtattaagaaaatttttttaccctttaaagaggttaacctatatgttatgtacatatgggactacaaagaactatcttattcattgttaacatgtgctgtttaatttttgacttagcatttggctcaaatgatttttaaaataagaacagtgacctgccagaagtgtttttgtttattgttttaattggtatggaggaaagaacagctcttgagagtcgagatgcggtttccagttttttctgccattttaactgtgtgattaaggcacagatttcttctctggttctcaggtttatcgtctttgaaatgggggtggatggagttgagaactgtggtaattattactgaggtccctcagtgagtctgttattgaaggaccactctaagagaatttattactttaatgttccaattagctttctgctcaaactcatttcttattgtttacccaatcaattttaattattttacttttgtagagttttaataatttacttttacacaagtaaaaacaacctttacactaataaaaggtatttataatgcaaagttatgcattcaaaatttattagatttcattcattcagcagatattttagcactatttcagagaagtaatacaaagatgaaaaagcacctaaagtctcttatcatcaagatccttatgccctagtatatctttaattataatctgataagcactagaatggagagttatacaagatataatgaacttagcctggaagttggatttggagagctgaaggtaaatattatttaaaaatcctgctgaatgttaaagaaaagttgtttatcatatgttagcaacaaaaaatttgcacactgtttttacaaaactgttctttattataaggactgcatactttgtcctctcccattcaacattttaaagaaattagaacattttactaacaatagccaatcttgtgctgtttttaaaatgatcatttttggatattaacataaaacacattttataaattatttgtactttaaattctatgtctgaaaattccaagtcagctcagctgaacacatatttatagagcttctgctttctgtcattatgctgtatattggaggtaaagataaattcctgccttcaaagatcttgctatctgatggaggaaacctgcacataagcctgtaaattaattttaggagtttgtttatatttacaaatgcatgagtgtacatacatctatgtagatatatatatatctacatagatgtagttcatacaagttctgatgttcagatatattttcttttttcttcttttttttcttttttcttaagacagtctcgctctgtcgcccaggctggagtgcaatggtgtgatctcggctcactgcaacctctgcctcccagcttcaagcaattctcctgcctcagcctcccgagcatgctgggattacaggcgtgtggccaccgcacccagctaatttctatatttttagtagagacagagttttgccatgttgtccaggctgatctcaaactcctgaccccaagtgatcacctgcctgagacagagtctctctctgtcaccgacgccagagtgcagtggcgtgatcttgactcacagcaacttccgcctcctggattcaagtgattctcatgcctgagcctcccaagtagcagggattacagggatacaccaccacacctcgttttagtagagacggggtttcaccattttggccaggctggtttcgaactcccgacctcaggtgatctgtccatctcggcctcccaaagtgctgggattacaggtgtgagccaccgcgcctggccccagatgtatttcttaaaactacgggagtagatagatagcagaaataaatagaacccaaccttctctgatattcctcatgaaacagtgattaaaggattaatcagaacttcacattcattgtccaccctcaccaatgagtttttgatctttgcagtagcagttacttttctctttttcatagtgactttattctatggaactgtattgtcttaatgcactaattctgccaagctaccttcttgtacaaatgaatgatagaatgtattgattcatggcaatggctaggtgtcaataatagctttttggatacttgaatgtactcctgcccgttttgctcagagattgaaagatcaagagctgtgtgttgatagggggaccttcagtggctgaatagggaagaaattgaatgtcattctgtctagcatagcttttttgttttattttcttgatgataaaatgagaatttaataatagctattacattactatcagtaatgggcaattaaaagttttaaagtgtctttattaagataactttataatgtattttaaaaccttcattcctcaagaccagcaattcttattggaatccatggatggaccctggggagctaacatccatcccttgaaattgcctgcgaaattatgcgtgcgtttgtgcatgtgtgtttttttctccccaggggcgggggggtcagggaggaaagatgcatagctttaatcagagtctttggttatgtgaactcttcttacttaataagtttaaccactgagttaaacaagttaaatgacctccagtatgtttttcctagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaaaaacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcttggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaatttgtcatttcctttattcacctactagattttaggatcagtaaagtttgctactcttctgagaatttttttctcaaatatcctccaccaaacatgaatgaaattactaatacagagaccggaacacagcagcatgaagagaccggagccaatttaaatcaaaacaaaggacatgtacaccttgaaaaattgagaaaaactaccaaaatctaagtgtataaactttttaattttagaaattacagcagcagcactttttggttagtaccatgcagtcaaccaaagcagcaatttctaaacttcagatgaagatacaagcgtgactgtgggaggaggtaataaagggggagggatgagaactcacactgcagcaggagaagatgactacctttgcagtctacttaaggctgggatgatcccaacactacccattcccccacaaaaaagtttaccaatgagggacacagattgaaggacacttagattatttcttggcccaatagatgctattctttctcctttacatttttatgtgtctttcctggagtgtgtttatgagacctgaaatttaaggaccatccctttttaaacctagttttaaagaaaagaatgccttgctttttcacccccaaaatacatttattccctaaactatgaccaaggaaaaatttctactgctgctttttgtgtccaaaaaacatcatgatataattagagaacgccccagacagaggtcctacattataacacaaattcatgcacatctttgctgggtcacttaacttctgtgaatctctgtttcttcatttgtcaagtggaaataatatagttgtgccttgtcacaaaattgaggtgaagatgccttaaaaatgcatctgccatgcaagtatggggatcacttgaactctcccatacgc

SEQ ID NO: 16319 - DNA, 119931 bp, Human
ccaggaagctgtcatcacctctcttcattatactaattgctctgaagatgaaataaggtttgtttctcccttcttatcctactcacagacctagctctgctacttcagaatagcatctgctatgggtcaagggaggcattttcccccctcattatacagagactaaaacaggaccatagcacgtgaataactcaccctggtccacagccagtgagaggtagcccaatgtcccagcaactgtcctcattcgtcagggtgccccagtggctgcctttatttcagccaggcatgcctcactctctcccatacaagcagttctcactccaacctttgtataattttttttttcacaatttcttcccatcctagaacagcctcttcctcccaatacccaccatactatctgagcatagttaggcctctatgcccactccagcctagtctctctcccctttactctcactgccctggacctcaccagagattagcatcagtgtcctgttttatgacctaattatgtcatgtgcattgccttgcctgctgcaatacatgccagcctgctcgggcaggccaaatcttctatcataatactacggggatattcccatagcaatgtagttctgaggccataggagagatggatacatagtttgtggctgaagtctgtgtaatctactaggcttaaagcatctcttttctgcatgttttcaagcaaggatgctgaattctacatgtaatgatatgttataaactctacacacattggaacctctcacatcctctcaacccacctcttattccagccccctctgcagcctgtttcccccggctgtcccccaccccccaaccctctgagaaacaacctgacagcgcctcaccttttgccatgctatgcacccagggcttctaagagacaaggtatgggaccatgactgaaactcaccactgctgtagaacagtgcagaggagttaataaccctaggatctcccttaccaacagggaaggataaagtccatggataaacgcttgccccttttgtcctcgacagacagttctgaggctctctgaggttcctgcaggactgagcaccttttgttaaggccatggccaaggcaaccactttcccttcttccccatttggctctgaccttcaatcttgctccctgctaggcatttccttccaggctctgctttctgcccctcccctccccctctcttatgttttaatgactaatgtcaaggtcccgctgaggaaaggtcttatatgagcctgttctcagaatattaaacgcttccagtgttctgctggttatttgaaggaggacagttagaacgactacattctagccagggctgtcctacttgctagagagtaacttttgctggattaggaagtaacctagagcaaagcacttcgactttctgggcagggtttctcagctgtaaaaatgggataatagggaccccggctactttgcggggcttgggggatcaaaggagttggaaagaggaggttatttcaaaaccgaaggagctgaatagaagaatctccgggttactctggggcaaggaaggtggagaccacggcgtggcccctcaggtgtctccagtgctccacaagtcaaaggagtccaggaccctcccaaagcgcctgcgtcgcggagcagctgggttcactctaggctgcccgctgcaaatccgcggtgtttaccagaatccaggtggtttgcaaacccggatgtcaggctccttgtcccggagattctcaaatcgctcacccacaactcctcttcggcctcccccagaaaggagagagcagggctgcaagctagaggagcggagagtgtgacccgagcagcctcactccgcctgtccccaccccaaaggcaggaatttctgggatgggcagatggcccacccctcctcctcctccttccccaagccgcagtgggtggggcgaggaaaacctccgcgactttcccgcatcccagcccagagccccgagtgtcggttcactgtggagacagcggtggcggagtgggtctccagggctctgggctggcaaggcccccggaggggtggggcgcggaggaggctacggatccgcttccgcgcggcggggccgggtgcttgggacgcggctctgggctcccgggataaggggctcccgggacaaggggctcccggagagcccagtggttagcgatgctgctgtcgccgtcgctgctgctgctgctgctgctgggggcgccgcggggctgcgccgagggtgtggcggcggcgcttacccccgagcggctcctggagtggcagggtgagtctcccagggtcggggactggatcggtacgttggggaggggggtcggggtggtcgaaggagaggaagaaggggcgaagctaggggccaagctggcgggcaagggcggccgcgtttgtaggggttcgtgtgtcagcagtcctgagcatggggggagcgggtggtgtcctgcagcctcttgtctaggcccagcaccccacttgcgcggcccggcaccctcctggctcctgcgggggtcgggcggcgggggcgggggggcttggtctcgcaggtaactcctctcggctctggcgcccggagccagcccgggataggagtgtcggagaagtttcaaaacggaaactttctgagagctgcttatttgggacggataaatgatagcaaaaagatggctcagttcgtccccttgcaaagcaagcgctcagggtctgcgtcgccacctaggagtgacccccaagccaggcctccccagtccatcccttccttaaggaaaactttttttgtttgtttgttttttgagacagggtcttgctctgtcgcccaggctgtagtgtaatggcgggatctcggctcactgcagcctccgcctcccggggtcaagcgatcctcccacctcagcctcccgagtagctgggaccacaggtgtgcgcccgcacgcccagcaaaatttttgtatttttggtggagacggagtttcaccatgttgcccaggctggtctccaactcctgggcccaagtgatccgcccacctcgtcctcccaaagttctgggattacaggcctgacccaccgcaccccgcctgaaaacatcaggccaggtgagggagagaagccccagtggctccatgaactgcgtgatctgaagcctttatgccttagtctctctcagtggaaaaacggggttcaattcagcaaacacttattgagcacctactacacatgagactcagaaggttgtgtaaagagagggaggagagatttctggcctgcaggggcccgcatttgagaatgggccacctcaggcagagaagcctgcgcctaagtgcagaagtccatatatgcaagtaggagggggacaggagggagttaaatatgccaggaggagcctccagacagcctccatcctctctgcctttggagataagtttggagagaaggggtaacacaagatgtgatcaatatctgcgttcacattttttcctccacagtagaatatgtctacatttttgaggtagtcttttctagactgtgtttcctaagctccctggaggcttaatcaggggcaggtagaacaagaccattcttattctaaagtgaccaaagtcagagatgctcttaccttcttggtcaattcagaaaattgctcctgtggatgcacatctgatcctgtagtatgtatgattccttcccactaagtttaccatgcagtggttattcctttgcattttaaaatgtgggttttgcctgggcactaggtggtagaacagggcagcagcccacaggacagaagttggactgggccacacagagagtatgtgctggtgatcctccgagtgaagggctaatcccttctatatgtagcagaaccaaatactggcctgagacaaattctcatcagtgccttctttttagtagtcaagggcactctgaaattagagccatctgctagcccttgtacctactaggtgcaatttgcacatctgaaaaggttgacatagttggcatagagattcttcagatatgaaaatgctgctgctgattttccaaggagcacggaggttatgtaccattcctcgcacaggcacaggctctctccctgactccagtcacctgcatgagtagaatttcaagtgtaagctggacaggtttgaagtcaagtttttactgtcaatacaaaatggaaaaacaaaatcttaacattgaaaagaacctgagacattgtctactctagccctctattcttcagatgtggaagttgaggtatggctaccatgtagttagccatgctttggggtgcctcagtttaccgctgtgttcactgtaccacattgactcactttagccacgattgacatccacagagcaactgagagaaaaatgcacactcattttcatttccaatccactaataatggctatgtaataatgcacagcagattatacatacagcattttttatctgaattgtttgatatgtattatttgtagatctgatatgtattacaagcatgccagccttgggaggcagatgatggattgtactgtgatgattttccaatgatttatcaataattcttgatatggtttggctatgcccccacccaaatctcaacttgaattgtatctcccagaattcccacgtgttgtgggagggacccagggggaggtaattgaattatgggagccaatctttcccatgctattctcgtgatagtgaataagtctcacaacctctgatgggtttattaggggtttctgcttttgcttcttccttatctttctcttgccgctgccacgtaagaagtgcctttcgcctcccaccatgattctgaggactccccagccatgttgaactgtgagtccaactaaacctctttttcttcccagtcttgggtatgtctttttcagcagtgtgaaaatggagtaatacaattctgtattcaaaagtcagtagatacagtattatatagtagttaagttctcgggcttcagagctagacgatctgagttcaaatcctgactatgccatttaccatccgtgtgaccctggacaggtattttgccagtcagtagctcagtttcctcatctgtaaaatggagctagtaatagtacacatctaagtgttgtccttttgctgctctctcaccatggcaccctcttcctctggccaatccagacattttgacaggttgacagccccataacaattacttactacggtgcacagcactgtacttggcaggtctgaaactcatctcctcctacctctagctcaggcatccccaacctccaggccacctaccagtttgtggcctgttaggaactgggccacacaacagaaggtgagcaacagtgaacaaaagaggcttcatctgtatttacagctgctccccttccctcacattactgtctgagctccacctcctgtcagaccagtggtggcattagattctcaaaggagcataaaccctattgtgaactgtgcatgtgagagatctaggttgcgagctccttatgataatctaatgcctgatgatctgtcactgtctcccgtcaccccagatgggaccgtctagttgcaggaaaacagactcagggctcccactgattctacattatggtgagctgtataattacttcattatatattacaatgtaataataatagaagtaaagtgcacaataaatgtaatgcacttgagtcatcccaaaaccatcccccaccccaccaccccattggcctgtggaaaatttgtcttctgtgaaaccagtgcctggggcagaaaaggtgggggacctttgctctagctggttattccaaggagcctgattttagtttgttttccctgatcagaatctgagcccttcttctagcaagtgctaagacacactaacttcactcactcaagtactccagatacaaagtggacagcggggagaaagaagaaggggatggagcatcctggtgaaaactgggcatagtcattgctaaaggaaatgatcagggggcaagtaaaagggttttgaagctttgttgagggttgaaaaatgataaatgtgaaatggtcccccactaatatatcgtaggagagtttccttctgtagtgctcagcttcccagagcaggagtggaaagaacctaagtctgtgtcagtgcctggggacactcaggggaggctcttctaaatgaccagtgatcaaaggaggtgagggtgcagatgagtgtgtggtcagtgtgcttgccatcaggtcctatctggggagaagaaagtgaaacagggttgggtgtacggggtgtctctcgacatgctgcgccgacggaaagaggggtaggggctgatggcctcagttgttcattatctgtcaggcaatatgtgctttatctacctgttttagttgggttcatccaaaagcaattcctgagacatgttttccttagggtgcaagtagtttttttttttggaggtgattctagaaagcatggtaagggagtgaggacatgagaccagagagggaagaaagccaccacagaccactggggctcagtttcacaaaggaccctttgaggaactgtatagaactcagtggacccaccaacgggcaggaagctgaagtatttatccaccaactcccgcctcttattgactaaggtcactcctggggcattcaccccctggtgctcctggtctctcccaggcagagagccacagaaagtcagtgggagtgcacgaggactgtctgcaggtgagtgagctccaggttagagggtgtgagaaggaaaccaacagaatctgctacccacctccagattggggaggtaaaaacatgagtaggatatgacactggccccaagaggctgagagtccagggacagatacagaaacataaacaattacaaaacagtgagagaggtcttatgataaccagggatgagcaaagtgctgaaggcatgcagaggaggcactggcctggggagctggaggctcataaaaagacatttgttttcctaaaggataagtaggcagttaccatataggaaaaaggagactgagcattcctgggaacatgtatttcatgtgcaaaggcccaggatcacgtgtcaggcaacagtaaaagttcagtgagctgaaagttcccttctgagctcttttggattcaaggaaagaggcccactgaaggtcactcaggcaaacgtggagttggttgtaatggtcccaggatctcaagggggacccaggacaggttcttcagggcagccaggcctcctgggaaacaggcactggccactgacatgaagcattactttatctgtttctctctgtctctggggctctatggtggttcctgcttggttgttctttctgttgactgtttctttggctttgactagcaggactttcctctgtagctcccttagcttcctgggaagagtcccttaatttcctaggagaggggtctggttacattcttcacagcatgctagccagttcctgtgctctgccctcaagtcgaaggccttcccctggctaattggccatggtagaggcaggaggtggacacagggatggatgctgcttcatccagggctgtggatggtatagaccaccagagtagggtcccaggcaaaacaagaagcagtgacatgtctatagttggaagcatgagagagatgaggaagagtttggttggaggcaccctgcttctggaaaaagtctggctgagtgaattgggtactgctgagaagggccctgtgggtttgcacaaaggggaaccagattgcatgtttaagtttagaagtgccatgttcagtctgggacttgaagagggtctcctatcaccttgaagagggtaattctggaaggcagcaaagaaaccgtctggatagttaaagctgagctaagtcagtcccaataggaagattgaggagcagaaagtttgggttcaagaaacagggtttaaaaagaggaaaatatatatttaaaaacaacaacaaaagaaaacagttagtgaaagttagatgagggaagattgcagaataggagaggtagtggttatagagtgcaaaatccaagttttggagatggacctattcttggtagtgaccagatccaagctgtgtttgtgggagtggtcaccaaagtgaagaagaggcaaaagaaggtcctcacagcagaggaggtcagggagcccaatgtccagagcaaagctaaagtcgagtagagtttgggactcttttgtcagcaaaccacaataagaaatacattttacatcacaacccacagcatataggtctacatatgtataactgaaacaatgtttcattttttaaaaaatacccttacctaatatgacatgctgctacatttccccctgttccattctgtttcgttttgtctcgctggtcataacacattcagttgatttcaagaccataaatgggccacaacctgcagtggggaaagcatcgagtcagagtgttgggtcatctgtatggaagctaaagtggctttggggtgtggagaatagcggggagtctgctggtatcaaagccatggtgaatggggggaagaatggttcagggcagagggccccagtggcgaggaaggggggtagctgccaccttctgaaagagggcgatgagagccactacctggaggcggcagtggggagaagctgtagccctgagatttcctgcatagcttctgtttctaatacaaaggtaaaaatgcccctctactgcttctagtattttctaacagctggggagtcgttactctttgttgttttatttacatcgacacattgtctcctcaccaaaacaggtaggcaacattaatacatacccttcttttacagatgaagaagggttaagtaacttgtgcccacaggagcttgcagcatggggattcgaaccaagcactctgcactaatgcaaaggatccctgaatagccttgtgaccccatggtgtggttcattctgtatcctgctgcatgacagaagcatgcgatttggtttcacagcaggaagaataggaggccagcctcttgttctctgcaactcctccttttccaaacccctccttccacatgtgggagtgatattttcctaaagcagaaatgtgcaaagctactgatttatgtattgttctaggcaattctgatgtccctaggcaatgagccattctactaatctggaaacggaatttcagtaaaagcgtgatcggatagtggtttagctgcccttcctggccctgaatcatgccagccttcttgactccgtttctcccatttctgtttgtcatccctcgcatttcttccccttcatacttttctcatcctaccttctctgcctggctcctttcctggcaagcctttgtgagtcagcatagatgtccagtttttctggtcctatttactctttcttgttaagcctctaactcttttcctattgttggttgtcacagtaactgatgccacacaatgcaggttccaagcccatcacaggaaagatggggccacacagatagcttagttgtccctgcagctccccttctttgacctaacaatctgcttatttatatcaagttttctgaagaaacggtccccttgtgttgcctcttctgaactcaatcctaatgctgcaaatcctcatgtaatctatcaaagtaattgatttaagacatttataaacccttccctccatttttttttagaaattatccttgagagccttttggagatgttccaacacatagctaggagcataaattatattttgaattgatcaaagcaaaaagaaatattattgttcataaaataaacaaaagaacaccatataaacactatattaagtcatttagggaaaaacattttataaagccactcaagaaaattagaaaattatgattagaatatctgtaacttgggttctgtgacacagagctaaacaagacagaaaagtcatagccacttggctttttaatttatgatactttttagacaactacagttccaaagaaatatggaaataaaatagtgttaccacttctagcttttggtattctgctcttgagaacttttcaatcatgaaaatataaacaggaaactcaaagtaattatttaactatacacattttttcattttgctgctctttggcaccattcatattcaaagttaagattggcttttatttttattaatatttataaagtgatcatcatgactgagataatccctatcaaggccttgtgaggccagcactattatttttttctttttattataaaatttaaactttttgtaaagaaggggtcttgctatgttgctcaggctggtctcaaactcctggtctcaagctgtcctccagccccggcctcccaaagtgctgggattacaggtgtgaactacacacccagccccagcattactattaaacccattgtgcagatgggaaaaccaaggcagatactcttctggttttaagcagttctgccctgaaagaagtgctcggtagtttgccaaggtcttttttacataatgttaatcttgttcaaatgcaaacaaggagagcttcatggggatgtaaccagtgcagttgcacagggccctatactcagaagggccttccttccacttagggtttaaagctccatggtttggggtcttgggattcataatcatttctatctttgaatttgtgtgctgcgcatgatgtccaatggaacaatggaacttgagccagaggtttggagcctctgttcaattctgcctggtgtcccctgtctacctcccgggacgggttctcagctgcctcctcccaactcctgccctacaattgatgctgcctgctgcacacagtggcaaccaggttgcattgaagttgggggactggaggcctgggccctgggagtggatgccttgtagcatttcggggcagtgcaaggcagtatttgtcaccactgtactgatatcacttctgtgggttctgcgagggctgagtgggaacctctcacatatcctcaatccaggtactgtattctaagcacgttatagctcagaggttgcaatctcctgtgggcctgagggaaagggacattgacttgacttccccatgtccagccaaaaccacgtattttcattgcaccctggaccctgcaaatgatgtagacagcctgaataagaatgatagggatggttatgatctgaattgttcccccccccccaccaaattcgtataaaaatgagactttacttggagatagggtcttcacagaggtaaacaagttaaaatgaggcagttagggtagccctagtctattatgactggtatactcataagaaggggaaacttggacacagaaatatgcatagagagatgatgtgaagagacacagggagaagatggtcctctaggggccaaggagagaatccaggaatccatccttccctcatagcccttggaaggaaccatccctgccacactgtaatctcacgcttccagcctccagaattatgagaaaagaaatttctgtcattgaagccactcagtttgtggtattttgttatggcaaccctagtagcaaaccgatacagggactaacactctatctaccactaaaagttgtttgtttgtttgtttttttgtttgttttttaacatttctaccttgcactttagtaaatgatttttcttttaatgggcatactcccaaggcggctaagatggatagctcattgtaagcacttttgttttcagtaatgccatatcatttccggagttgttttggttgatgatggagttgttttctggttttgttggtttttgtgacccagtctttgaatcatttccccctgggctttaatatgcaggcatttgtgagggcatcttaacagtgttctgtctttttgtccttgccctaacttgcactttgtaatgaggcacccttttgactgagatggtatattttcaacagagtcaataagataatcacagagctgttgtgaataatgatttttataccagcaatgtttgttaagtactttccagttaaataaaggcaaaacaatgggagaatagactaaaagctaaaaggaagaaaaatgttttcaactcagtttaaaaattcattggtaagatacagaggtctagcaaagaatcacggaagagagattttctgccagggtcagcaactgctaaatgaggacagagcaggaggacagaggagggaacgggaatggccagggagtggcaaggacagtctgaaagggttaacccctcctggcacaggggttggtaacagacaatttgaagcctcacagaactgcagtccggtggcactgattatgctgggtttcatttttccctcatgtgagaaagactattgtgtgcctcatgaaacttggagaggcaattaggtgagattagagagaaaatggaagagaacatgtaaaaagatttagcaagagcggtccacggccctgtggagatggtgattatctaggttcagaagctgtaggagaataaagaaggctaagagttaaggacaatgctaggacagggaaagagaagaaagttctgagacaggacaaagaggttttttaaaaaatgtacttgggtaactttttagttgattaatagaaggcaactgacaggaactcaaaagtttcagaataagagacacatgaaaactcagatgatttcagataaaatgcacatttccatgcagagagagaggtaggaagggctggcccacttttcactttcttccgtggatctcttctttgaagaaccatgcacatgctgcttgctgcaagcatgagaaattcctcacttattggtttgaaaggtcatattaagaatacagattttctgcatcactcggccatgaataggacttgattcagcagcttacagtattccttcctgctacagagtaatcttaggaacgtaatcagctctgaatccattgttcactagatggaacagataaagacaaacccaaatttgtgaagctggaaaaggtcagtacatctcaagagagaagctgctcacctccagattggttacagaggagagatgccctccccatttccttctggactgcatccctgctgaaacctaataatgtcagaacagcaaggaaatggacagagtcaagacaggctgccgggcaggaagggcttgagcccagcactagctctgtgggtagatggagtagaagcaatttcaaacctatggactggggtaggagattgaaattgggttgcagcctgcatgctgtggctttctaatagcttgtcttaagcattgcacttgatgtgaaccatgcactggaacttttccttccagttcccttaatggagcagcacagagactgactttatgtgtatagttggattaggtgaacaccttcatggtgtaatttattgaataccagaaagtcctttgtttgcctaaaatgccaccattaaaattgttgttttattgtttctttaaagtgttttttgttaaaaatgcggaaacttcacaaaggcttaacagtacaaatcttatcttactcactttaacacttcaaaccttcactcagctagttctaagagaagagctgtctaaagctaaagggaacactaaaggcaagtagaggtgatcagaaggggtgcagatggtcaagtgcagaggcctcaggagaaacttcctctaggtacctccagtctgctgttcacacagacagatcaaactgtaataatggccccaggctttagactccaacctcatggcacccccttttgcttatatctcctatgtcaaaatatattttggcattagggtataatttctttctgtgcatttcagggattcccagggagaatgtgacttccttgcaggcaaacactatgacatatatatccttctgtctgcagggttcctaaaccatgccacatcaagcagttgatagatctttgttgtctgaaatttcaagtcacctacttcaaaatgtttggcaacaatctatagcagtttattttcttctaagttataaatgaatgcatgtaaataaagctacacctggactgaatatagtagatagatataaaacttctaagacaaaaatggatttggaaaaaaaaaagtgaaagagtggttcagttaaataatctttacagttccatccagctctgaagttcacggttcagggtttatgggtgaagtgagtctcctctgccacacccgtcttccttccagcactgccctgctttgtcctccctagaaagtgggcaagtacatgtgtgtgcacactccccgctcagagtctggtgacactgaggggtcttgtccacctcacatgtgacatcagttgaagagccagttcagggtcttaaatttgggtttattttctttctcttatttgttatcacttggttttttaaatcttttaaaataattgtttattttattttgttttaagttctgggatgcacgtgcaggatgtgcaggtttgttgcatagggaaatgtgtgccatggtggtttcctgcacctgtcatcccatcatctaggtattaagcccacatgcattagctctttatcctgatgctttcccttcccctgcccctgccacaggcctcagtgtgtgttgtttccctccctgtgtccatgtgctctcattgttcatctcccacttgtaagtgttatcacttgtttttaagaacttattttatttatttgttgttttttgtttgtttgttttgagacacaatctcgctctgtcccccaggctggagtgcagtggcatgatcttggctcactgcagcctccacctcctgggttcaagtgattcttgtgcctcagcttcccgagtagctgggaatacaggcacgcaccaccacgcccagctaatttttgtatccttagtagagacctcaagtgattcgcctgccttagcctcccaaagtgctgggattacaggtgtgagccaccacgccccaccattaagggcttattttaaatgcaattataatgttttctttggaactgatggaactcccttcttttcattagctaggcaaattcccatgattccagaacaaatatatacagtttcaaagaacagatatttaggcaaataatttctctctatctctagcatcttacccagtgtctatgaagtagctggcatccaatgaaagctagttgaatgaatgaatgttccatatgcagtcataaaggtaataacctaaacttcggtttaaaagttgatcaatgaaacattctcctcccgctccttagaagagtacacgttatcttatggggccaaagagtggatctgaaatggtctcctcctaaaggaactcagaagtagaaagtagaaccactgtcttccatggattttatttaaaaaaaaaaggatagaaattagcttataagtttcttctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactctgtctcaaaaaaaaaaaaaaaaaaaatgtttcttctaataaatgaatcctttttctcctcctaaacttataattatgaagggaagtataataacattttcctgcaaagagatttagtaattctggcagtacttcattaatcacttaatcagtgttcaagcagaactgatgtccttgacatgtataatcaatcttgattcctcccacatttgattttcatcttttaaaaaatccaacaactatgcacactaaggattggtggcttattttcacattatagttttgttagagacattatgtgcatataataacaatcagaatattgatacctatattaagtctcctcacagtctatttgaaagtaattcttttcagtgaatttatggagattaacagtgctaggatcatattctattataacttaatggaaaaatgggctcaagtcattttttaacttagtatatttggaggcagcatgttgattattattggtgaaccagagctacttgcctatggcacattctgaagaacttttctaaagctatttcctaaaggcagctggtgtggaaatataagtagcaccccaaaattaagcagcaatggattaggtgtgtctaatatgttctgctttggaaaggtatttttatgattgctggtgtgactacagaagttccaatttctgccactctttttctcttaacatttattaatttggaagtttaaaagcattattggccaggcatggtggctcacacctgtagtcccagcactttgggaggccaaggtgggaggattgcttgagcccaggagtttgagaccatcctgggcaatatattgagatcctgtctctaccaaaaacaaacaaacaaacaattagccaggcatggtggtacacacctgtaatcccagctactcaggaggctgagatgggaggatcagttgagcctgggaggccgaggcctcagtgagccatgacagtgccactgcactccagcctgggtgacagagcaagaccttgtttcaaactcaccgccccacagaatatttattcaccccaaatgttaggtttgtaattttcatgtctatttattcacagaccagccattcccgcatctacacactgcttgtcaacaccatgtatttttctctttcgtattaaaaaacctacagtgtagactttacaggtgggtaatgcagaaaatcaacagatgaaggctcttaattcatcattgcacacatatttgaacaaaggaggcaaatattttgttatctggttgtttggagagtatttttcctccataaaagatgatagcgtggtgtctcaggattgtttaaaactaaaatgtctgcacccactgtgtgctgcagaaactgcagtaaaaataagcttttgtgctaacagtgtaagaagagaagcctttgagggatgatgagattagcactctgtaggttcaaccaggtctgcagctggatctatagaccaagaatcaggaagtcagaggaataaagtaataatgatagctcccatttcctaaggcttttcatggtagtatgtggtgtgcttttcatgggttactcaatggaatatccttaacatccctaagaggtcagtaccatacatattcccagttcaaggaggaaagatgaggctcactgagatggagcaatctgcccaaagttacacagcaggtctgtgacagctccacgtgactccagagctctcaaccactagccaggtcgtctacacacctatctgaggtgtataaactgaggcacagtcagtacgttgcagagcttataatacatttgaacatatatattaggtagaagctgaactacaaaaccattatagtaaaataattatcctttaatgaaaaattaatgaactctaggttagctagaaagtgattagtaggttacaacagaaattaaggtaaacattctacccaggcatgaaaaagtgaaaaggagagttggacagaaggttaattatcggactccatatcacattgacgagaggtggatttgattttgaatcactattactaataaccatgcagacaaggccctcattaggaaaacaaatttcctgatctaaatgaaatctccctaaaaccattcattttccccaccccaccccctctcttttgctcttatgtatggtgatcaaagcaattctctgacaactaattcaactcctcaaatctatggctataggtaaggtcatcaactattagatgaggtataccatttattaatacattgacaatctttttgaaacagtatcttaagtgattttggttactgtaaatcagttctcctcaggctgattaactttggagaaaccaaaagaacgtttaccagaatgaagcattgttccctcgtggatccatgaggaggcccgtcctgcactgtcccaaacctctccaaagcctctgcctgtacctgttctgccctccattacatgacccgccctaaaccccagacattggagggaaccctatcttgtcccttcagagttttgaagaatagacaggaagtaaaatagaagaggggaacctagctactgggagaacaaaagagcgcctgggcctcaccagacatgaactgaggtgacttaagcagccaaaggctgaagcagcagcagccggtgtgtttcatcaacagcaagcactgactgaatttccaccatgtgcccagcacactccatacttagaccaaagaaatgagactttgtttccatcttcaaaaagcctgtgagaaaacaagttcataactgttgagtactaggtgccttccaggcccgcaacttgggttaagtcaggtagcaggctggcagctaacatgtattccccagctgggtcccacagcttttccacgggaaactcacccaaatcccttcttccagctccggggaggagagcttaggggcatatcacaaaacacctgctttctccgcctgtccatgtggcctctggtttctgccaccgtaatggtggtccgtcacctctcgtgtttcaaggtgtggtgccatagctagtggcctgggcatctacctgcttctgcctgccccacccagcaagccatctcctactaagagtctatccccatatagcaagaggtccccacctccacccttgtactcctgagaaacattgtattctgaccagtattgaatcccgtatcagatcacaaagcagcatttcactgatagcctttcggttttctataggaacttgatggtagagagtttcattcagtggctcttgattcagcagctgtgttcctaacattcaggcacttgtctgagaaagacagtgttgtcatatccattggcacccagtgtccctccccgggagccctgagtattattaccaatccctctctctaaccaattgtgtgagcacaccttctctgtcagtaacagacctgagtggattggcaggtaacccttgttcccatatggccaattaggtcttagatcagagctctcccattagctccagtaagaccttttatgcttcccaagaaactcctctgttttatgcaaatacagcccttcaggtggaccctgcccaacaactccagatctgtgggaaatggctggcaactgtcgcatatcgcacttagatatgcacactgagatcctcatgacgctagttaattatatatgaaaatttcatgccacatctttgatttttgtttcagataaaggaatatttgttatccaaagtgagagtctcaagaaatgcattcaagcaggtaaatcggttctgaccctggagaactgcaagcaagcaaacaagcacatgctgtggaaatgggtttcaaaccatggcctctttaacataggaggcagtggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaaggtaaaaataatttaaagaagcactcagggaatggtgtttttttaaggtttgcctataagtaaagatttgtaaagcattacgtgaaagaagtacacgaagcctggaccctcaagggacttctgctaaatacattttagttgcttccttgcttatggtaaaagggttatgagagtctcagaatggacatactacattctgctaaagaagcagaacttctcagaatttaaaggtattgggaggaaaaacatttaactgactctgggaatcaatggaagggagcagaaagaataagcagacaggagggagagagaaaaggacggtggaaggaaaagatctttgaagacttttgtcatgacaaatataataatctctcctcccctgccgccatttctcttattgtaaaaactcatccccacctatggaggtatgtgtccaggacacctccaatgcctcctgatgctggctggcattcatgtgattaatcatgttacaagtcacttgaagagaaatgacagactattgtcgggggttatttggtgtgtgccaagcatggttggtggggaagcatggtttagaggggaatttcattttctatggttatttttgtcatttctaaacagaaaaaaaaaagaaagttacatagttaaattcaaatctcaaacctgtccctcagcgttttgtttggtagctcactctatccatccatccatctatctatccatccatccatccatccattcatcccgcatttttgtatagcactgctaacaaatccaccccacattcatcaggcactggactaggcacctggtttacaaaggtccacaggacaggtggagcccctaccctcgtgctgctctgtagaattatgctttcacaagagcatatgctcctaagaattctgtacggtcctgggaagcagagcaaggaactcctaaagaagaaatgattaaaaagagacagagccaagggccaggcattttcaggactcactaaaataaagcaagtgctgcaaaccagcactctgaataatctacagttctgaagaggaacttgatattttgctttatgttaactttttagccacatacccacactcatggtgcatgcaggggaagattctggggaacatatgctttggagtagaaggaaggggactgaaagaaaagggcatgtcctgaaatacctacggttcctaaatagccctaactgctaaggctggtgactggtgacatgtcatgagctcaggtcagcccctgccaattgtgggaaagaggtggggctctccactgctggtccttttgccccaggacataccattggcagccccagttgagtcatgaaaagtttttgttgattcctgattaaggccaagaatggccgagtattgcaataccctgagaaggcagccagcaggccacgtctgcatggtcgacttgctctagaccactgagaagccacccagccagctgtctcgcttcaccctctccctatgtcagctgtttgcccctttgcaaacagggcatcagtggttctttaaaaatgtaaatctgatcctgtcactttcccattcaaaacccgcaagagacttgcccccaccctcagggtagaggccaaagcccgcagtatggcggggagacagctctatgtgcactgacactctagtacgtccctggctccctacccagagggcctccttcctcttcttcattcaccccctcacttgttcttgtctcaggttctttttacttgctgttccttctgctggatcacctcttttctaaagacctgcactctcaggtcacccagttcctattcagagaggtctttcactgcccatcctgtccaaagtagtgccctgtgcccctccaccccatctctccctctctctcactttctctctctctctctctctccctctgtctcacacatacacacacacacacacacacacacacacgcacacacacaccccactctgtcttctcatcctatttatttttcatcatggcaccgctacctgcaatgatactgtatgtttacttgtatatttgctttctctttctctctccttgatagaagttccacataaaggaacttttgctggtttgttcactgttgtatccccagtactgagtacattaaatgttcaataaatatttattgaatgaataaattaataaatgcctatgaatctattgagctttagatgctaatggctgatgtgtttggcgactggaaggtattatgaagttaaatctccattaaagtttctttctcatccatccacaaatatgaatgttactgtgacagctcaccatagtaagtaaacaagtagataaatgcataagcaaaccatgtatcagcacttcctctgagcccagcactcagtctcacacctctactgacaggagacagtgaggacctgagggctcactctgctgtagtgagtatctgccccaagagggtttcagtccataaaaaatgctttcgatatatagcagtttccaaagataaagctgacatcatacttatctgactttgtacatttctttctcctagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccagtaagaataaattttgtcttctctatatgtcatgaatgaatcaaagatgattagaaagttatctgtatctaaacaaaagcactgggattgatatattgaagtctgaataagaaccctgatgctattaacacagattttgatttggggtttgtttttgccttgaaaagacaattctaatatatattctttttgccgtacattcaagagatgttaattagccattcttcattaagctcagtgcataatgatgttttaaccagaatcaaattataaatactctgcgatctcattgatcccagcttcttggctggatacttcaaaacaaacctgattgcatataaagcccagttagcctttcaatccactatctcttatgagctgctttaatttctccacatccaggctgctgcttgtctcgcccattgtcaagcccaggcaccagctggccccttgatgatctttctaaaatcgcaattgccctcattatttcttgacagtggattctcgtcttgactccctttcctactatttaccttctggctataacctcattttttttcttttcttaacttgattttcaaagttcaatggcagtggcaatgttctaacttctttttttcagttagtgccttattatttcattttatttttatttagctaaaaagtttccaattgttaccaagtattagagaatgtttatatatgcctcctactttctatattcaatttcctttcccttggtttctgtgagtcagagtacagcttttacagtcttcatctcccatgcctgcctcccctccacatatataaaatgcaacaaataaatttgaagcaaaagcaagttgaagagattaaccccaaagaatctgacttataaagtatctgtagaattgttttctaatccaagagctagtatggcttagcaaataagaaagagtataagctttgaaataatcacacaggccaagattggagtcctgcttcctcccaacaatgaaattttgggaagctctctccatctatctgagtctcagtttcctcagacataaaatgtaggtaatagcagtacctattaggattattgtgcaattcaattagatgaggcattcaaggcacttttcataatatctggcacacagtaagtactcacaagggttaaccattgcagccagaagcagcagcaacaatagcagcagcagcatcaaacccaatttatattttcagcatacacttctgaatccatgatttctcctctctgctgtaagtcaacaagcactaagctatgcatagtggtgaatgccaagagttttaggacttaggatcctccctttaaggaacttggcatctagagagaagacaggtttgctgtatgccagaaaatgcaggctgtatttgacacaatgccctagaatcacctgggagatagtttaaatgcatatcctggcccatcttccagagatgcagtgggtgcagtatgtaaaactcaaccatctgcatttttgaaaagtgccccaggtgaccccggtgcagataattcatcatcaagcaataatatggagataattctatgcaatatacatctatatacagggataatatcaacacatttaacagccaatatggtatgggctattggtcaatcgcaatggagaccttagtgtgggggttgggaattccagaggctctctgctgatattaaccccttagctgctacaatgtgggggtggggtgcagggaagcctgggtagtgggggtaatagagaagctcagaacagtggctattcaccaaccagaatgaaagcattttattattttataactgtcagatcaccagccttctctatttgaatctaaatgtatgcatgtaggtgtgtatgcatgtgatctctacaccccttgactcctgaaacagatgtcatattatttttattattgtcatattatttgcatcatctcttctttttccttttccatccccaatagaggtcattattaaaaccaaataaatgaaccaatactaataaagttaacacgtacttcacatggctctaatactagggacttcaaaaaaaaaaactacaatattcttcttaaggttctgaaaccttaagaagtttccactgggaaacttccaatgacagtttcccagtggaagcctgggttcagtggtgctccaggcttttcattccccagaccatctatttgttcagccttgtacagctcagaagcttcctctgcttgacagcctgccagattccagccctcctgccctttaccacaaccagcagagagcatgtttatttgttcagtgccagttttcttcctttcttgttacttttggctcccggtagccaatataactcaaaatgacgtgtcggagattgaaacctgagcaagctgatagctctttccatggggtcaacaagtggataggacagagaagagtgagtggaataaagtaaaggtctgtactgctgtatctcatccttcttatgtgggaaatttttttaaatatctcaatgtaaaatgatgctacatttaaaaaaaaagttgattgtaaatgagcaaaatttaaatgtagtattcataaacacatatacaaatatactagcggtgaaggatgtaataaaacatcttcagcaaaaaggatgacacacaggaatctctctgggtttgtttagaggcaattatgggccattctggactctcttggttgtgtgccttacagagctgcagaatcacacttagttaatttgagatatttttacgataccaacctgtgaaatgatatgattgcccttgaaccttatttttatataattctgatcagttgctcgagtgatataataaagcagatttaggctgggcacagtggctcacacctgtaatcccagcactttgggaggctgaagcgggcagatcacttgaggtcaggagtttgagatcagcatggccaacatggtgaaatcccatctctactaaaaatacaaaattagctgggtgtggtggtaggcacctgtaatcccagctacttaggaggctaaggcagaagaatcgcttgaacccaggagatggaggttgcagtgagccaagatcgcgccactgcactacagcctggtgacagagcaagactctgtcgccgcccgcctgcccccgctcccgccctccacaaaaaagacaaacaagcagattgatacaacaaaggtatggctgctctctcctgagccctcaacatggctcagcaatgctatatgtttctgtcatgcagttctcacaccccacaatgaccctgccaacctctctattctcctctaacttctaaccctaccttccaatctcctttctgattctcattatttgacctcagttcctacctcataatggcaaaaagatccatcagacagacagtttggcaacttcctgctctctcacctttaagcctacctgcatctgtgcccatctttatttcctcccttctatgcgcgaggatgatgttcctcctcctacatgggccaagtctccccacctgggctctggagcgccccatccaaccttctccaacctgtatctcagttgttctcaatgtgtggtccccgttccagcagcgttggaattccctgggagcttgctagaaacgcaaagtagcagtcacaccctagaccatcatatcagaaattctagaagtgcagcccagcaatctgtgttttaacaaacttctaggtgattccagtgcacacccctgggtgcttctttgctgggcccttttccttagcagttagacctgtgcgagtcttgaaataacatcttaaaaatactgcaattctttcatccctatttctgcctcctgaaaacacctctctctctcatcctctaaatagagagaattcgcaaaagaattgtctataccttcttcagggcactgtctcctcttgacttctacaacaatgcatgcctgaccttgacctccatttccacagaccattcatccatttattcatttaacaaatatgtattgaacacctactatgtgccagggacttctctggctcctggggttataaccgtgaatgtgaaatgtgaaagtcatagtgcctgccctgatgaaattcacattcaagtataatacccaaattaatacataattacagtttgtcataagttctaccttaagaaaatacagtattacaagtgagaaaccgaagttaaaattgggagtcatggaaggttttcctgaggaagttgtatttgaactgtagcccaagagatgagtagaagttgtcaaaatggaaagtggggaaatgagatattcacacggagatgcatgatacagacatgtgcaaaggaaggggagagggagtggtcagcatgggatgcaggcaataaagagggtatatggtttaaatagaactaaaaaataataataaaaccaagtaaaagacagcatgcttttgagtcaccaggcacatgctctaaccattccaaacaatgtcagtgataaaatacgcccacctgtccaggctgactgctcctccacccccagccctcagcatgtcactggccagatatctgaaggttttgaggggggaaagaggttattgccatctaagaaagacaatgtggcaagagtacagtgaatgaagaagagagaaacaagacactctgaaagggcagacagagtccatgagtgtcataaaggtaaggacttacctaattctaagtgcaaaagaaagctatcaaaagagttttaagcaggggagtgatgattttaaaaatatatatttaaggattactctggctctattatactgaatggcttggaagggagcaataggcaaatcctggagaccaggtagaaggctagagcaatagtctgggccaggagtagtggtggcttcagttaggtggcagcaaggggattggaaaaatgtggatttattgaagatctaacttgtagataaactgaacaggacctggttgtcaggagcttagctgggctggagacagcagagctgtcaggtgttggagtagctgattaaagcaacaagccaaaaatgaaggtgttaagctgttgatcactcactacaatggtataacaaagagactaaaagaagaattcgccacctcccccgttccatttttccccagggaacagcacagccatcgagggtcagtggatcagcacagatgtggagttcagctcagctcactattgagagaacactaaacaacaacaaaggcttttcagttgtatagattctgggttggggtaaggtgaggggaagagctaggagttgaaaagtactgagcactgagtcagggtggggaaaaagtgtcttcaagattcccctccttcccactccatcccagcctcagcagaggcacctgaagaggaccttggcccaaggcctcacatagaaagagacctaggaatggaaggcacctgcaccagaaatgcaaataacacagagcacgatgggcttgaggggcctgaaccgttaactatgactctctttagaaactgcagtgtgccagctcagcaccaagtctggggtaggggcagctttcccccatgaggcctaccaggtaaagcctttgtaactgcctgtggtcagacctcaagaatcacatataggtttttaaccaggagtaggacttctcactcctaagaacttggaggctaggagaaaaagtgagacattaattcagactccatgtttctgacatgcatagctaagtttatggagatatacatttggaaaagaaaattaaatactattcaggtttgcacatgttacatgtgagtcagttatgtagagatgtggactaggtaggtagatgtaatggtctctatgtatttggaagttataggaaatggacccatgagaacaggttagatagccatgtgtagaaagaatgtatagaatagaaaggaagggggctcagggccaagtcttaaggcctccaacatttaatttgagtagagaagaataaatcagcaagggagactgaaagggggcagccagggaggaataagggtagccaggcatgggaagtcaagaaaagagagtaaatcagcacggagagggaactcagcctgccaagtgctgatgaaggggcttgtttgataaagtctcaaactaacagttgctgaatttggcaacacaggggtcattgatggccttaaacaaggtatacattaatggctagattcagtggatgagactaagtgggaaattagaagaggatgaaacacttcccaagtcattctacgtatgcacttcacttcattaaaaaggaggtgtagtttaggaaggaaaaatcacctatttataacaccatgaaaaagattctggtaatctctcatcacataataggagactcaaagttatatatgacacaattgcttccctggagcccataatttagcaatagaagagatgatataaacacaatcaaagatgtaaagaatataacaataggattttagcccttagattagaatttttcaagaataataaacatacctgagacaccagcctttgattttcagagttctcaagctggggtgacccttcagagttgccccttgttgggatacaggggctaagtataccactacattgaccagtcatggtgtcagctgcccttgggaagggagagtgaaagggcaaagagactcttctgccaaagcagtccttagagagcagcacatcacagtgtctatgacaacattttcattccatttgttacttaaaacttacaaatgagattcctggagggacatgcagcctatcctagagaagcagagaaaggacttgtgtctgccagtacagaagtacaaattcttatacaggctgagtatcgcttatccaaaattcttgggcccaaaagtgttttagatttctgattttaggatatttgcatatacataataaggtttcttgggcacaggacccaagtgtaaacacagacttcatttatgtttcatatatacattatacccatagcctgaaggtaattttatacaatatttaaaataattttgtgcatgaaacaaagtattgaccaaaacccatcacgaggtcaggtgtcgaattttctacttgtggcgtcatgtcagcactaaaaaaattttcaccatgttgcccaggctggtcttgaactcctgggctcaagcaatccacccgcctcagcttcccaaagggctgggattacaggcatgagacaccatacccggcatctttctttctctttttgtagtgatagggtcttgctttgttgaccaggctggtctcgaactcctgacttcaagtgatcctcccgcttcagcctcccaaagtgctagaattacaggcatgagccactgtgactgtcctaaatgattcttatgcatgccaaaactatgaacacacccccgctcccccatcatggtctcagctgtcatggtggatgagtatggctgaactagtgtctcgtaacacgtagtagtatattgtccttctcagggaaggcctaggattttaactgaaaacaatctttaaggattccatctcaatggggaaatttcagccacctgggcaaaatggttactgaaaatttcccttctctttttcctttctttcttttccttcccttcagtgttacttggtgatagccttgtcttctgccttcctttaatcttggatccttctataaacacatgtatcagtcaggaaactctatagacaaccttagatttatatgtgatttaaaacctctggaatgtgtgttgcaaccagacatgaaaataaactttccacatttcccaaggggaccatctaactgttatgagggaggaaaaaaaaccaaacaaaaaagattttattgtcaaataagtttgaagtacactaaattaacagtaagcatgtttctttactacagaacttctcagagccttgaatatgctaatgttcattgtgaatttcccagagaacgctatgtatgcattgtgtccagattttcttggggagcctcttaaagttgtcttactttgggaatcacactttgggaaaggccatcctagacttcagctggttgcctgtcagtcattttcagtcatgctgcagtatggctcacattctctgtattctgacattctctgtctgagtttggtttccggtcattattgtggctacttagttcaccttggagtttgattttaaatgttagcaaaagcacccaaactcagtcttaattttctgttatttcaaaaaaaacttcagacttcagctccacatttcatactttattacatttccttttgagcacactatgcaatcttcggccagtgtcttacaagtggatcttgcttctattcctcttggctgaaagaactttcttaaactatatgtcagtgttcctgtgcttgatgtttatttgaaaacttgtgtttactattgactcatattcctactgtatccttttattttagcattttgtatttagggagaaatgcctttgaaataacatttgtatctactaaaatgaacatttaaagttacaagttttcaatataaagttctaaatgacaaaagaacttagatcttattttcacaaatacttcgcttctacttccttctcttaaaactggttcctattattactctggaaaggatcatagcttcttcattggtgatttcttatatttctttaggtaaatcatgaaagagtttaaccatatcttagcaatggaataacaatgcagattttatcataaagacctaatcaagaatagataaggccctgaagttttagagattgcaagatggaataattccattcagacttaccttagaaatatgttgctgtatagataaaataagacctggttgtttttaatggccattgtttccagcctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataaggggtaagtaggtggatgacgcacattgatattgatacaataaaagatggttgttaactgttttcacatatacaaaaatatattctgacaaaaagttcttaaaaaatatttttctttccataatatggcccaaaactctcacccaaaatttttccatgaaccttgagtgattccatttggcatccagtgatgtctttcttattttctcctccttggagaagagaatttgaggccacagcaagggacccaggagagttgcagttctaacaagtggatcaggaagatttctaaatttaagggctatttgcttgctcttctggagatcttagccattccatttccattaataaatcattaagcattttattaattaaacaaaatcttacatatcattcaccatgtgcaggtacatcataggccttctggtgggtcccaaaaacaaaaccttaaaatttagtgggaaaagcaaaagcacatatatgttaactaacagtatagacaataatatgttaaaagaattgtgccgataaactaagacttatgtttcgcttattgcctaaactctcctcttacttcttctttatagattaaatgtatttgtatgtgtgtacattcacctctttaaaaacttgtggaaacattagaaaatatcacaaaattagtcactttcattaacagtttttgatgccaatgtttttcaaattttattgcatatgtagtccatgtttattttagaataatttgtaaaattcaggtatatagaaagaaaaaccaataaaaaggttcccatagttctgtaatccagagacaactgtgtttctctgcaaaaacatataaatgcatgtgtacatacacagtatatataaaaaatggtattatataaaaacgtggcagcagccaggtgcagtggctcacgccagtaatcccagcactttgggaggccaaggcaggtggatcagttgaggccaagagttcaagaccagcctggccaacatggcgaaatcctctctctactaaaaatacaaaaatttgccggacgtggtggcatgcacccgtagtcccagctactaaggagactgaggcaggagaatcacttgaacctgggaggtggaggatgcggtgagccaagatcatgccattgcactccagcctgggtggcagaacgagccttcatatcaaaatacataaatacataaataaaaaataaaaataaataaaaacatggcagctattgcacagtgatacaagcaagtgatttaaccacctgctcaggttaggagcagggagccacctgcctgggtttgaatcctgcctctaccacttaagtagcagggttactcaagcaagtgatttaaccgctctgtgcctcaatttccccttctaccaagtggaaataataacaatgcaaattcctggtgtggcttacatattttaatacaggtgaaatcatagaaaagtgcctggcacacataacaaacactcagtgtgtgttaaccatttaacaacaactacgtacacagtttggtaatctggttattttatttacctgcatttaatgaacatttgcccgtatctgtaaatatagatctacatcataatttttaatggttacatagtagtataagttagtggtaatatattagagatattgataaaactatttgttttgttatgtatttattagttggtattataaaccatccctgcacaaacctttgtgcatacatccccaattatttctctataagtttgcagaagtgggttcactggatggaaaagtaagcacactttaaagcttttgtaagttgttaatatcttccagaaggattgtaagaaatgaatgagcaatgtgtgcccaccctaaaagtcagaaattattattgaatttgatttgagtaagtcatagtgcaggaaaacatcaattttcaaaatcattttaagcctgaaatggtttttatataaaagtttacatgccatttatgaattacaattatctatcttaactgccaggatttctcatgagaaggtctggacttattcatcaaatttgaataaccatttaaaaaaataagacatgtcagggactttgatttaactacctcagttctataattagtctttgggaattgtttggaaaaacagaagtctgttcataaagacagaaacctgttccaaccaaggtattttttaatgatgaaaatagtctaatgtttcttgctaattctggtgaacatatactatggtacaaggaattatctaagctgtcatgaatgccgagaaatatccaaaggaatttaaattcgagtttcttattacagtatcgtgggccagcttagtcctaaaggtaaatagatggttttttgtgccttcagacacaggttataaattgcacaattattttttatctgcattattaaaacaattgcacaatgggtattcaaaaaaattctaagataagaataattaacgttttaatattttaactagattttaaaatatcacttggcacttgcctggatgtgaaacgtgaaaatttctccctgccctgtcaatccatttcacttcttatcatcataagacctgctaaacgattcaatcgaatggtgctattgaaaggaataatcaaatagacattagaaagagattccatatgaatgccacagaaacttggaagggtgaaacccgtgtatagtatgctgtttctgtttattgatttctgggagtctcaaaattataaagcacctttttctcttttcttaaatgggttagtttctttgagtttttcacaattgtattgaaatatctagtcactgaggatgctgcagccttgttatatgactacaatgaccttcacaacctgggtaatcatacagtctatcatccaaactgagattcttttgatagtaaaagggactgtgattaataattattctggaaataccagcatgaaccatgagttttccaggaaaatgggggcatacggtcaccctgtttataacccttatccgtcagggtcttaatcttaggcaggacccctgcgtctgactaaaaataaattgggctctgaatcaggtgaattgtaagcgaacaatgctctcctttatagattaaacgagtaaatggcaacatttcaaagcatcacaaaattgccactttcattatgtttctgacactaggttttggtttttttccccccgaaattttgctgcataagtagtacctatttattctggaataatgtttaaaatttaggtgcacaaaaagaaaaactgaggaaaaattcccataattctttaattttgataactatgtctttctgcatgtcaatgcatgtttttattcatagtatctataacaaaaatggtattgcattaaactgcaagttgtagtggactggttaagaggaggggccacagagccagcctgccattaaacttctcccacctcaagctgtggaagcagcctccagtttgcactgcacacagccttaggtcccaacctgctagggatcccccgagacactctggtccctcctgttgagcagacatctcctggtggctgtcacactgtacacccctccctgatctacttcagcacaccgttttacctttgaagatgtgcctctgttcactttctgggactgaccctgcacacctcttcctccaccctattaaacctttaagttcatgagctcactcaagtaagatggcctcaagtatgcaaccatgcacccttgtctagattgacaaccctgaaaggcaacctttctgggtacttgcatgaagcattcacagttgaaaaacagctgtcagtgagcctgctctgtttctcaagatggtgggagcctgctttatcactcagaagcaccacgtgcattctgtgcacctttcccgtcattgactggaattagtttctgactccatgatccaggaataggagaacaagaaagatgtgtaacactggattttttttttgaagctccataattttcatttcagagcacatgagcagtaaaacagtggaggtgtggatgggcctcaatcagctggatgaacacgctggctggcagtggtctgatggaacgccgctcaactatctgaattggagcccaggtacccgcagtgttttctttgccttcgtcacgtggcatcatcttgcacccttacacagcagcatttcccatgcacataggacatgcttttttgagagtagtgtataaacattttttagcctgactgaattcctttaaggcaagcttttccaaacaagaaaatagggaccaggaagataagctttttagccaaagttgcaggaggatttgggtgtaagccaagattccagtctgctgttttaaaaatagctacaaattgcaaaatatctctctactttaagataataaaagtgggtcttttggaatctttgggaaatcatttaattgacatgcctggactgtaactgcaaaatcatagataacatcttataggatttactatatatgacaaatagaaacgctgtcccccgatgctgaaaaccacatttcaatatatattaaactaactgcttttgcttctaatattaaagacactcattgtattttcagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttggtaagcgtttttattttaagttgttcttaggtgttgttgacttgtcctctcaatatatgtaaatttctctattttttgctaataattcataatgtaaacttagctaaatctagtttatatttatatgaaaagatgtgtaactagacaatatctgttatgtcaaagggactgtgattttaacaaatgcatttaggtttatactaaaaactgaaataatctgagcatagcaaacattttcttctcttttaaaaaatttgcactgttagtcattctgtattagagaaataagatacatttctttttctattctagttttgagtttattgttcccctagaaattaaacataatttagaaaacaattttatataattatttacttcattgattttctgccacactctgaatctcttattagtaacacaccttcctccctgaaattacatgcagaacttttagatggagttaatacttaaataatatctaatcacagtctagtaccagaagtccaattatttctgtttttcaggtctataacctctttttagtttctctgagaattaatgtcttagctccaaatgtagagataaaagtataaccattttttaaagaatcattacaaaaataattagaaaaaactctagatttaaaataataagctgaattgtcatttttaaatattgtctcttagaattgggttttaactttcattttcctttaaatagctaagcctagaagttttgtagaatatggggtacaagctggggaaagaagaagcaacttgtcatttttttatgtagagatttttccattatttcaggaatttgctgaaattgctaccacctgttattgtccttttccctccctctcttccttctttcatattcctttctccgttccttctcttttcattttttctttctttccttcttatgccatcttgcattccctcctgccacccttctttccttctgttatatttatccttctatctgctaattgaggtcagaagaccagaaatgggagtagttaagttagcttgtttggattatttgctttgcttcaagttcaacacattcttctgtggattgattgaagtcttgcttttgtggcccaggctggagtgcaatggcacgatcttggctcactgcaacctccgcctcctgggttcaagcaattctgcctcagcctctcgagtagctgggattacaggcacctgccaccacgcccggctaatttttgtatttttatagagacggggtttcaccatgttggccaggctggtctcgaactcctgacctgaggcagtccgcccacctcagcctcccaaagtgctgggattacggcgtgagccaccacgcgcagcctaaaattccaagttcaaaaaggatttcatgagtgcttttttaggctgaaaaccattggggtcaatgatatacaaagttctaacactctttggccatgattctaattgctgccagagtcctagaaacaattttaaaagaatgttttgtttcccaaatagcagtgaaatcatatttagtttaactaaattcgttcttaatggaggcacctcgttgtggttaataaaataaggtaaaaatgccatcatcagattggggacagtctcgtgagaaaggaaagccaaaataagcatgtgcatcaccactgccctccaatgtccaaaacatcatggcactgtgttcctgaaagccccacctggagtccatatcagcccagagcaacatcgtggacactcaagacttattttcaaagtgaaacctatttgtcatccccattttaaaggaagtcatcagagttttaggctcttttcagctggggataaatatctaccttacccacatactatgtataaaatccttggaataccatttaaattgtattccataatacttcttttaaatataaaaaggtttcaaaaatgagcagctctgttaaattttatatctagccccaacactctgctttcattgtatgtcctctgtcaagtctctttacttctttggttttgttgttgttgttttacttttttactattttttaaaataaaattgactgtgtatgttcaaagtattcaacatgatgtcataggatacatatatagatagtaaaatggttatcttagtgaaacaaattaacacatccatcatctcacttagttacccatttcccccactgtgacaagagcaactatagtctactcatttatcaaaaatcctgaatacactacattaactatagtcctcatgctgtacagtagaccttcagacttgttcatcctacatatctgctacttgtatcctttttcctacctctgctcattttctctcgttgactcctataacattttatccattcagccattctgtgttttgattagataatttaatccatttgcattcagagtaattattccgataggtaaagacttactactgccatttttttcattgttttctgcttgttttatagattctttgtttcttccttcctctcttattgtttacctttgtgatttggtgatttgtgtgtgtgtgtggtgctaaatttcaattcctttctctttatcagttgtgtatctgctatagttttttttttttttttttttttgctttatggttaccatgtggcttacataaaacatagttataatggactgttttatactgataactgcttaactttagttgcatacaatcactctagatttttaccctacccccaatagttaaaattttgatgtcgctatttacatcttttaatatcgtgcatttcttaatttattgtagctatagttatgttttaccatcttggttatttatttatttacttatttatttatgctttagagacggtgtcttgctctgttgcccaggctggaatatggtggcatgatcatagcttgacctcctgggttcaagtcatcctcccacctcagcctcccaaagtgctgggattacagccatgagccactgtgcccaatctatttttgacaattttgactttaatcttcatagtagagatataaatgatttacagaccaccattacggtatttgaacattctgaatttgactatatatttacctccaaggaagaaggggtactctggaggtttggctccagggaacagggcacggctgtaacttgggaagcagaaccagtatggcacagtggcaactcaagctctaggggatgaagcaccaggcagtggtgactccggaccctggggtggtgggacacagcagtatctcaggctctgtgaggtcaggttcagtagcagcaaggacccaggaatggtggcatatacctgtggtttgtttcctgggggtcaaggagcagcaaaatgatgactcctctccctgggaaggtggggtgcctcagcagttcaggctttgtgggactagtccagttccaggaaggcaaggtgctacagctgtttgtgttggagggcaggatgtcccagccttgccaatgctgtttcccttggatgcagggtaccacatcagccaagccctacaaggcacagctgctctgctcagctcagccaaggcacccattcccccatgagatggggctgcttcagcttaggtgctggggggtatgactgctttgggcagctaaagcactgtttcccctggatttgagagccacttcagctcaggtgcctggggtgtgactgttttgggcagccagggtagggattccctgggaggcagggtgccacttcagcacacacactggggaacatgactactctgggaggccaaggcaccatttctttggaggcagggtgataagccagctcaggctctgaggggcacagcacagcaacaaccaggaagggtagatggagcagctcgtggcaacttggccacaccaggtagagtgagagccccacagcagcttggcatggggatggtgggccacgaggtagaagtggtgcagtggttacaaagcctcaaggatggaggggtgctgtggctactcactactggagcagaacatgacattctagcagtggttcttttttcaacattgtgcagcgcaatagacccatagtccacagagagacagggtgcagcatcagaactttctctgaggcaagcatagtcctgtagactccaggcagctccctcaaatgggcttagtgcctgtgggggctgcaggggtcctcagtggcaagaactgtaggtgaccctggtggtgttggaggctgctagggtccccttgctcttcctttccttacagagagaagtctctcctggctctgagctgcttataacgggggttgggggagatggtgggggtgggggcagcaagggtttctgtgctccgtgttgtttctgctactcccttgatgtgctccagcactctccttcagctgccttcgtgaaaatgtagtcatttattcattgctttggctgttcctgtggcagggatgagatcccaggtgttaccagaaaggggtcctgatccaaaccccaagaaagaattggaggcgaatccataaaaggaaagcaagtttattaggaaagtaaaggaataaagaatggctactccataggcagagcagcagcttgggctgctcagctgattacacttacagttctttctcgattatatgctaaacaaggggtagattattcatgagttttctgggaacggggtatacaattttcggaactgagggttcctcccccttttagaccatgtagggtaacttcctgatgttgccacggcttgtaaactgtcatggcactggtgggagtgtcttttagcatgctaatacattataattagcatataatgagcagcgagggtgaccagaggtcaccttcctcaccgtcttggttttgatgggttttggccagcttctttactgcagcttgttttattagcaagctttcttgatgagactttctgtctcatcctgtaacttagaatgcctgacctcctggaaatgcagctcagtaggtctcagccttattttacccagctcctaaacaagatggagttgctgttgttcaaaggcctctgacacaggtgtctctatcggccatcttgctgccatccctcctctccttacttctttgtaccttcactagctcatccggaaaatgaaatactgaggttcatttgatcctagatctaaatctagatcatagattagacccttctcaactctgaagatctagaattccatgatatatgtcattttgtatatttctgtttttcacatttttaaagtaatcatattaatggcaatttacataagctgtaataagtaatgttaaaataattgtggaaaatgacattgttttttgttggtttaaaaagaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatggtgagtcccagctgcctttggtttaaaaggcataaaatataatgtagtaactacttttattagtggagttgaaaagaaatttaagctatttaaaagtggttattcattgcacatatatttaaagtttctaaatgttattcaggagttcaaatttattggatttttacaaaatacatgttcagaaactttgtaacatcttcatatatgccacatatattagatgatttttaaatttttggaaagtaggaaagttcatttcctaaaacttctaacgaaaaacctaaacctgtaatttagctttatggccactagatagcagtagtgtgttgttaacatgtaatccacataataaagggaaccccttaggcaaataattagatgtaaacaattttcgccagtgaacatgggtaatttatttggtgaggtgatgttcagactgttccccatgtataggaattttaggctcctggcttccgcacagcctgagtccctcagagttggcctgctcttcactgtgtcatgtatttgacatagacttatgctgaaaaatactgaaattatttatttcatttttcagttttttaaaaatacaaaaaaatgtccaggatctcctttgatgaccttttcaattgttacattttagtttggagtaaaaacatgcatccttctctgttatttttcctaatcatttgcatttgggattaaagaaccctgtgggctgcttatctcaacaagggcacttacacatctctttcagccacatagggtcctttcctacctaggctgtcaagttttaattacttttgcagcaactccatttcaatgcctttaagaggttttgctccttttttcctatggcagaaaaaagaaaaaggaaaaaaatactttaaaaaataggtttaagaggtacaagtgagtatttcttacatgcatatattgcagtggtgaagtctggcctcttagtggccccatcacctagatggtgaacattgtacccaacaggtgatttttcaaccctcagcctcacctctgctaccttttggaatctccagtgttttttatcctgctctgtatctccatgtgtccccattgtttagctcccacttataagtaagaacacgcagtatttgacattctgagttatttcacttagcagaatcgcctcaagtgctacctgtgtgcgaaagatatgatttcattcttttctatggctgagtagtattccatggtatgtgtatgtgtatatatatattccatattttctttatccaaccctcctctgatggatacttacatgattccatctttgctattgtgaataatgctgtgataaacatatgagtacaggtgtctttttgatataatgatttttttccctttgggtatatacccagtagtgggattgctggattgaaaggtagttctatttttagttctttgagtaatcccagtactgttttccataaatgttgtactaatttacattcccaccaatagtgtataagtgttcctttttttgcatcctcaccaacatctgttggggaaaaaaaaactcctatctttaagctagactatcattaaaagtttgtttgtttcatgcccttttcataatccagtgggccttcctatttttcctttctctaggcagaagcaaaaccagatttttcagatctacttaacatacatacatggttctagcagaaaccagagccccaggaatccaacttgcttaggctttgttgttgcattggctttagctcacattctgcctcacttataaggcctatatcaagcagatctggatattatggggatgtcttagtccattttctattgattatagtagaatacaaagaaactgagtaatttataaataaaagaaatttatttcctacagttatggaggctgggaagttcaaggtcaaagggccacatctggagagggtctccttgctggtggggattctctgcagagtcccatggtggcacagggcatcacatggagagggggctgagtgtgctatctcaggtctctcttcctcctcttataaagccaccagtaccattcccatgagaactagttaatccattaacccattaatccattcatcagggcagagccttcatgacccattcaccccttagaggcctccttctcaatactaccacactggggattaagtttcaacctgaattttggaggggacaaacattcaaaccatagcagggaagggaaaatgtttaaacagacattttataccaagacttaaacagatttcatcatgcaaagaaataaagaagaaatcacatgtgaagtggtatattttagtaataactccagggtgttacctcctttgcaaataataggatcccataagtaatttacatttatctcttacagaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgtaagttgattcatttgttcagtgctcactttgctggtcttgtactgaaggccacctgtgttggagctttgggctgtggcagagaccaagacaggtgcagtccctgttcctcatgggccttccatgttagagagcaaacaagtacacacagaaaaaacatggtaattatagttgtaatgattgctccaaggaactatgtgacatgatagtgaaaagcttgggttggggcaggacaggacagccacagaaagcatttctgaaaagttaatatttaagcttggacttaaaaaaaaactctcagagagaagggggaagaatattctaagcagaacatgcagagggtagcaagtgcaaaggcccaaaggcagaccaagacttgccatgttgaatgatcaaaaaggagaccagtagtgaggaggtcgtaagagatgggcagtaggaattctaaaatgccaggtttctagattgtggtataggaaccaataaagtacttcaaggaaacaaagggcatgacctgatttacattttacaattaactgtggctgctacacagagaatggttaggagaggaataaaatggaagcagaaaagccagtttggaggctacaccagagttgacttagggtagtgactgtgaagagaagtggacagatccaagtgtgctttggagaacagaaggtgttgctaagttagatgtgggggtgagagagaggtcggcttttggcttgagcaaccatggttttggtgtatggtggtgccattgactgctgtgatgaagatgaggggaagaactgagggatggaagattactctggagagtgatggtttttaagctccattatgttattcacataaaaggatttaaacagtatgtgtaacctctttgaaaattgtggatcagtggcaaatcttgctttttttcctcatgtggatggagtggtccccgtagcctgaacatcacattcatccctatgttctagtctctcatttatctaaagcatctgattatacagaattagcttaatcccaagccatttgaacagtttattatgcctaaaacagacttaatctctttgatcaagatagctgctgaatacactggctgagttttagggggttgttgggatttggtagatgtccatgttcttctaaccaccaggatactctgtcaggttctccgaagaggcagtttattaaatgttactgatgtggcttgacaaagtaattatgccagcaaaacaggaagcatttctaagcacttaacttttgtgacatgtttcatggttccatcttttaatgctagcacagacaattacaattgtacagtgcagtaacaattatacatgctaaggcagtgtctctcagccccatataaaggagaaacaatacctctaaatgtctgtcctgggtctagctctgctgaaatccaccacaatgtttgtttgtttgtttgtttgtttgtttgtttgtttttgagacagagtctcactctgtcacccaggctggagtgcagtggtgcaatctcagcttactgcaacctctgcctcctggattcaagagattctcatgcctcagcctcccaagtagctgggattacaggcttgcaccagcatgcctggctaatttttgtatttttagtagacatggggtttcatgttgcccatgctggtctcagactcctggactttaccatccttggcctcccaaagtgttgtgattactggcatgggcaaccgcgcctggcccaccacagtttattctacagtatctgctgatttattggttcattagttttgatataatttaggtgatcatttcttattgacaggcatgggtatgttgctctgcaagtttacagaacaggagccaatatttggacagagatttttttttaagagattgatgataggtattaatagtattggatatgtcaggacaatgctgccgtaagtgtaatattttatggccccttttctggaagctcagaagctccttaaatagtagatgtgtaaaaattaacatttatttccatggagtagaacttagtatgaatataattattataattaacaagttccccaatcacagttgacacaaatttgaatatgagagcctaggaaacaattcatttgttcttccattcatctaacagttcttaactatagtatgcctgacactatcctgtaactggattgtttgctggaagactccatgggggagcgatgcagggctcctcttacagatgaaggtatcagccctggacgttgtatttttctaagggtcatggaagggctccacattcccctaaaattctagatgtgtgaaataccacctggaatttgaattgtgtaactttagcctaaggttctgatttgtgttattaaaaaatcctatgggaggataaaattttaatatgttagcagttattatatcattattaatgaaagatctgagagtagccttcaataggattagagaaagacatgaaggtatctgcctagcatataaagaggagatggggtggtgctgttcgaattcctgatggagggatcattgaagggtgaacatgagtttcagctatgccaatattacctagggtgtttcatggtagcttccaggaatttccccagcatcaggtagagacatgaaagcagcaaagcatttaatgtaacacttagaagtggttgaagagaggcgtcagcactctcacttggtcaggaggatggcttcatcccagtggttctcacagtgtgacccccagaccatcagcattaacatcacctgaaaacttgttaggaatgccaattctcaagtcccaccagacctaccaaatgagacactggtcatgcagcccaatcatctaggtttcagttagccctccaggtgcttctggagcacactcgagattgagaaccatggctctatcccatcttttcatagaaaaattgagaacagcttaatggaaagccaggctgaccttggtatcaatcctagctccaatttttactgactctaggaccatgtaaaatgctaactctaacctttaaaatgggaattataatccctacctcactggaacattgagataatatatgaaaatcgccctgcattaagcctagcacatggcagctatcaagaagcaccagttgttaatagttgctccctctctcctgcccacccagttacagattgcacaccttggaactcatgctggagagaggggcctttccctagacaaagtgtcaaccctttccgtgacaaagcagagtgccgcctgaaacattatcccacgcgggagcacattattcatcatatttttttttataagaattgctattgcccatcggtatcagcacagagtgtattcattctcttgtaacatttttctccgtaggagggacactggaaagtcaaaaattgtgaagaaagacttttttacatttgtaaaaaagcaggccatgtcctctctgatgctgaatcaggatgtcaagaggtaagtgctgttaacattgcaatttaggtacagggacttcatagctagaatatcaattccaccatcaatttgaagtgaatttctctttctcctctctctctctcctctctttcatctctctctctctcctcgcaccccccccttctttcctttcctcttttttttcctgtcctgagaaatgttgtcttgctatcttctacacaggattacttttcttttgagattaaaaatgtaaatggtcctgatacagcatctgtacagtgactatcctgtgatgtgtgatgccctgtctcacacttggttttcctagtctttctttcttttctttttctttttcttttttttttttttgagacagagtcttgctttgtcacccaggctggagtgcagtggcacagtctcagctcactgcaacctccacctcccaggctcaagcaattcgcatgcctcagcctcccgagtagctgggattacaggcgtgcgccactacgcctggctaatttttgtatttttagtagagacgggattttgccatgttggccagacttgtctcgaactcctgacctcaagtgatctactgcctcggcctcccaaagtatcgggattacaggcttcagccactgtgcctgacctatggttttcctagttttcaagtgagatgtcataaaacaattgtgttcctctgagtcagagtgaactatgctttatcagtctcaacagttttccagacctggtctttatgcaactatgctttaattattttctcttctaatccagttatttgtattgcaattgaacaatgacccatccccttagaatcttcattttattcattaatcaatgtgtaaacaagtgaacttcatactctagttggatagtagatatgccgtagctgacatgtcaccattttatctaatgattataatctctgaattagttatagctgatctctgattaatctctacctgatatgaaatattgaagacggggcaggggtgagggtggggggatttgtcttactgtggctttctgggaaactcaacgtgttttatttttgttgaaaggacaattaactttttacactgcaaatacagaactgatgttctattcaaacttttgttcatggcttcccttttccagccagcattaccagtatttaaagttcctgagttcatagccaattctctagctttgtgaagaaatttccagtaattttattatgcatcagtctatgaatatggttttgaaagttttctcttttttagaaagttgcttcaatgcaattctctaaacagtctgcacttgaaaaatcaatttgtaaaatcaatcttgataatttcaaagcaaaagaagtgatttgtttttccttctgagtcacttttttgggattggacaatatgagcaattccttcagttttgtcaccaccatcctttcatttaaaaatgaaatggcacctagtgtacaaagggttaactgatataatcagttatccttcccgtattcattgtgtggacaaagtcttgaagtaacaagtcggtgtttctgattattctatgccagatctttttttccctcccttttcttgagctggttcagttattggatttttttgtttgtttgttttgctaagcagcctatgatctaaaaactgctaatgaagaagaatacattatcggaaaggtcaaattgccagcctccctctccctgtccttccaagtacaggagcagtctaatatccctgctcctaccctggagggatgcatgaaggagctgtatggagctgtcagttactcacagagagaagattgggaatagaagtgaaggggagtgagttcagagcagatcctagatggctggatgtgggagctcctgtgcttcctacctcagttaatgatatgtttgaactaacacagctgatctctaaattaaggttttctttaatttactgcaagaccaacatcttttccaagaaatttatgagaaatcattttataactgatcaaaagctggcaagaattggcatagcataaaatgaagagtgttttaaaactggtgaataaattaaaatagataaaaatgatgtgatttaataatattggggaaaaaagaactaaaatagctcagtttaaatatagaggactaatgaatgtatgtcttaccatactgtgtgatttcagatgagatcgggcacattcagggtggtgtggccatagactgtactgcatgatttcaaaggaagagccacccttcgttgttcccagggctaaaacatagacctacatgtttgtcatttttgtctgagtgccaaagcttactttcttcccctccaaaaggccagccagttaatttaggaataatctttacaaaaaaaaaaaaaaagaaagaaaaagaaaaaatacatatattggccattctctatttggaagcattatgctccaaacaagaccatcctggactgttccagaattgggtttcaggcccaactgatccactagtttgactttatccaagtccctaatctcaatgaatctcagagggataacatgaaataatcaatatgaaagttgaaaaaaatctctaatattatctagatacatatattctctttgttcatgttctctttcccctctgttcaattctaaaatctctatctgtattgtccttctctgattctcagaacaaccccataaatactattattatcctcatcgtatagatgaaaaaactatgatattaaacaaggttgcacagtagtggagccagaattcaaacccatgcatcctgaccctagagccaacacttaatttctaccctcctgtcggggccatttatatgaaattctgtaagtcagagagagagagacacacacacacacacacacacacacacacacacacacacacacacacacacagagagagagagagagagagagagagagaaagagagaggtagagatcttgaatgaatgccctttattttcatttacttttaaggttttacgttttaagttaattaaaaattttaggttttaagataataaattaaataaatgtagaagtgggtgtagttaatggcattactggatagaataaatataaaaatatcaagacaaaaattcaaggagttttaaaggagtaagagaagaaagttatgtaggtggtaaaagagtatgcaaaaatatctcttggtatttaactaaatgagattgtgtccttaatttcccttttattctttttaagggatgggagagacatggtggattctgttacaaaattgacacagtccttcgaagctttgaccaagcttccagcggttattactgtcctcctgcacttgtaaccattacaaacaggtaaattaaactttttttaacagaaacaagacggctttcacatgaggactcttggaatgataaaatctagctacaatcataactgttcaaaatctaaattgtgctatacatcaaagtactaaattatttaagttatttattgagatgaatttaaattatactatgttattccagaattgatttttgagtaataaataataaaatttaaggtgacctttactatctgtaaagatttattaattatccagcttttctaatatattcagatgtttttagattttatcttctaactgcttatatgggaaatgaaacccattatttattttttattttattttttttcatttttttgagacagaatcttgctctgttgcccaggctggagcgcagtggtgcagtctcagctcactgcaacctccacctcccaggttcaagcaattatcttgcctcagccccatgagtagctgggattacaggcacctgccaccacgccctggtaatttttgtatttttagtagagacggggtttcaccatgttggccaggctggtctgaactcctgacctcaagtgatccacctgcctcagcctcccaaagtgccgggattacaggtatgagccaccgcgcccagccaaaacacattatttaacaagtatttttttgatgtaatgtatgtgaattgtatgggggtgtttttagcagaaaagctataaaatgtggaggatattcaaatccttcaccatcacttcttccatctattttatttagattgagacttctctgtgcacatatgccttcctgatgctggcacagagactgtgccctttttacactccatacaatctgccccatggtaccgatgcataatacctgtaggggataaaaataccaagagtaaaggtgacctcatatcagtatcgatgccaggaggacagtgggggctggaacacctgggagacccactcctcctggggaagacagaagcggggtagaactccagtggtgccacaggaaactacacctgcaaagcaagtcacttgcatatttacctgggccattgcctttaaaaatattcactgaataccagcaaataggacaactggttttacctagagacccttcccatataagcctaatttgtagaggaattcctgtatgatttctctgctcctcccacattggaagtcaacatccaaagctgccagtatgtccttcctcctcttaccctctttcttgccttcttacccagcttctgttccaaacaatgcacaggaatgcatacacacacacacaaacagacacacgcacacacacacacactcaaatggattgatagcatttggcagactaagtcacctggtgaaacattttactttcaggagatcctcccgttgaaatatagcactacctttgatgtatctcagcattgtttttagttctacctttctcctcccaggtttggctaacaggcagaagaaagcctttatcaatttgttaactcacccaaaaggttccaagaacaccttgggttggaagtcccccagtcagtgagtcaatactggacttcacaggaggctgaccaatgaagctatacgctcttttgttaattacaatttaattatgttttttaccaaagaaaataagtccaattgtttcacctgttttttatgtcttattctttatttttttgtttaatgttcattgagtgcctgtcacatacctggcactgtgttaattatttttcatatgttatctgaccacacaaaaaattaatagccaagagtttattagaaaattttttttgaatacctgttttgtgagagtccccatattaaacactgacatgctatccacaagaaataaaaggcatgctattattgtccagtgctttctgaaacccagcagctgaagagatcgaacatagacacaagaaataagtgaagaaggtagaatagcacaataaatggataaactcacagtgacattacagataacccatagtgccacagtgacccaagctaaggcagaaatctgttagaacaaatgcttcatattccatgaaccctttggggacctcatacaaatgacagaaagtatctgggaaaaaaatctgtttcattttccccaaaactggatacaagactatgttgtgaatactttaaatgttttctctggtaaactgtattcagtagcaagcgctcatgcctggtccatctgtaaagcagaactatggcatagagaagtttgtttttatcccagtcttggcctcctacgcctgtccagattgccctgtgctggtgtgctgcctggtcacccgccaagccctgagggagtacagatgagcaggatgtgtcatctgtccaagtcagttaacatatacttatgctacccccaaaacatgtctacattcaaagcagcaactccaacacaggactcatgagttgaagaaagaaagggccaatgctcttggtttttaatcattcagagtccatcagggaagaaacaagggtccacactgtactgcttttgattcaccatacacgttggaatttttgcaaacagcatcttttgtctgagaaggttgggcagtagatggaaagtgtctcagatccaggagtgtccactagtggccatggtaatcattttcttccattactgatttcctgtttaagacactcctgtcactcttcagtacccaagcttgtagttgctaattgattttccactcttctgcacaatggaatgacaggtttgatgggcacaattagaaccacctgctacaaattacttatttcttttgtgatcaggcaactgctcctggtctaagacttttaacactttgtggaatagagaggggaagaaaaacagatccttattgttgagtaacaaatttttgtttgcttgctgattgttacaaaattttttcaggcctggccactttgcttccagacaaagcatgaatgcaaaagttgagttccaaaattataatggataattggctaaatccatgtatgtctaaattttgaatcaatcagccatagaatattggtacaaaataatccaaatggcattcaattttgtgaattttgccaaaagtgagaaattctgcaatatctcattttctcctaagtttattttactttcatttatttttgagacagtgtcttactctgttgcccaggctggagtgtagtggtgccttcatgactcactgcagctttgacctcctgggctcaagtaatcctcctgcctcagccccccaagtagttgggactacaggcatgtaccaccatgcctggctaattttttaaaattttttacagagacaggttcttgccatgttgccatggctggtcttgaactcctgggctcaagcaatcctcctgcctcggcctctcaaagtgctgggattataggtgtgagccactatacccctcctaagcttaaatgtgcattattttaaagcatttttacagctctaccgttttcctgcaactgtcatatctccccaaaacacttttgcagttaatattttttttattgtggtaaaatatacttaaaacacacataaacataaaattcaccatgttagtcatttttcagtgtgcagttcagtgtcattaactgcattcagattgttgttcacccactaccatcatccatctccagaacttttttcatcttcccaaactgaaactctgtacccattaaacaatagctgcctattctcccctcctcccagaccctggcaactactattctattttctgtctctgtgagtttaactactctacatgtctcatataagtggaattatgtttttctgtgtctggtttatttcatttagcatgttgtagtgtcagaatttcgtttctggaaattctgttttaaggctaattcatattccattgtatgtatatacacatattgtttatccattcatccattaatggacatttgggttgctcccaccatttggctattgtgactaatgctaccatgaacatgaatgtacaaatacccttcgagtccctgctttcaattctttggcatgtatgcctataagtgaaattgctggatcatatgataatttgattttaaattttttaaggaaccactgtactcttttccataatggctacaccattttccattcccaccagtagtgcataaaggttccagtttctccacatcctagccaatgcttactattatctggttgttttgttttgataatagccatcctattgggtgtgcagtggtatttcactgtggttttgatctgcattccactggtgattgatgatgttgaacatcttttcacgtgcttattggctatctgtgtatcttctttggagaaatgtctattcaagtcctttgtccattttttaattgggatgtttgtcttttctattgtttagttataggaatttttaatatattctggatattaatcccttatctgatgtacaacttgcaaatactttctcccattttgtgggttgccttttcattctgttgatagtgtcctttgatgtgcaaagtttttaatttttataaagtccaatttattaatttcttattccgttgcctgtgcttttggtatcatatacaagaaatcattgccaaatacaatgttatgaagtctttttcctgtgtttccttgtaagagttttatagttttagctctcatgtttaggtctttaatctactttgagttcatttttgtgcatagtataaggtaagggtctaacttcattctgttgcaagtggttgtctagttttccctgcacagtttattgagaagactgtcctttctgcactgaacagtcttggcaccattcttgataatcatttgacatatatgcaagggtttattcctagtctattccactggcctatgcgttagtgtttatgctagtaccacactggttttttgttttgtttttgttgtttttgagacagggtctcactctatcacccaggctggagtacagtggttcagtcatagctcactgcagccttgacctcctgggctcaagccatcctcccgcctcgacctcccgagtagctgggactacaggcatctaacaccaccacccacagcaaatgttttttatgttttgtagtgacaggatctcactatgtttcccaggctggtgttgagctcctgggctcaagcaggctgcctgcctcagtctcccaaagtgctgagattacaggcatgagccaatatgcccagcccacactgtcttgattactgtagctttgtagtaagtttggaaatcaaaaagtgtcagacctctaacttggtttcttttcacgattatattggctattcagggttccttgaatttccatatggattttaggatgaacttttctatttttgaaaaagatatcattgggattttgatagggattgcattgaatgtatacatcactttaggtagtatgagcatcttaacaatattaagtcttccaaggcatgaacacgggatttatttccatttctctgtggcttctttaatttccttcagcaccattttgcagttttcagtatacaagtctttcacctttcagtatacaagttttcagtatacaagtctttgtgtagtttattcccatgtattttgggggcactattgtaagtggagttattttcttaactttcttctggccaaactccacatcgttcttcctgtcgacggcctgccggcatctgccagtgcctgtcggtgtgctcttccaccggtgtgttcctctggatgtccagccgcttgtctgtcttccagctaaggcctcgggggattttacaagcacaggatgggggtgtggcaagccagggtggtcttgggaaatgcaacatttgggcatgaaaacagaaatgcttgtcctcacctaggtctgggggcagaggctgggggtggagccctaaccagggaccccgcccttctcctcccagcacttccctgacccggtattactactctgcctcagaggagatagagaaaagcagatcgtatattattgagagcatgaaccaacagaagtgtaaggaaaattacaacagcatgtaggcaatatttagtcttctatatgttccttttgaagcacatttatataaggttctgccagtatgatctggattaaaaaaagaacttttcttgtttcaaatgtgtgctatttaggttattaatagagtatctgcagaaaatatttactaaagtatgacgaaaatccatatcccctgcaaagatgagtaccataaatacctaagatctctaaatgttgctaataatatctgtaaggcacttaaaatttttacttctttttattcttttctctttttatctcctatttcctttgagactcttctattcataaatgacctcattgcttttgcttcccttagcaagttaaggatgcacagtaacgaaaaaagccaccaaaattgaatgaaaagatctaatttgctttctccttaggtttcctgggtaatggcttcagcctttccttttccattgactcagcaggtctgcccagaagtcgccactgtttcaaatgtgcttcttctaactttgtatgttctaaaaatagctttctcaagatagtttcaacttagctgaaaggttcaatgctagttaaattttaatagtcatgtttttcttagtaggtgtgcatgtggaagcatgtatgtgagtcttctatattctgcttttgatgcattcatactggaaagggggcactgccaccaatcattgaacagtaattcattcagctgtttgggaagtatattagtggatgtacggccttagattagttcctaggctttcacatttttcttcagtgaacatgcagatttaaacacatttgaataagctgagacctacctctgcctatgaacacactgatttgggagacataaaattgctactttaatttctgtttctttctcaccaggcaagtgaggtaggtgggtgtgtgtgaactctgtattagtaaatgctcattcagaaaagcataatatctttcctcctccctcctgcccacctttaccccgtgcatattgtggcatggtgtgtgtggtgtgtggcctaattacaaaataggccacatcgtactccaagaaatgcattgctggccatgtgaactttaccacctatgctttgaaactggagctggactctctattctgtgcaagaattaagccccatatgcaagagtcagattctgctcactcatatagttctgggaattgcactgacattcggcatttattagtaatgttcagggtctttgggtgttttcctgttccatgttctaaagaattgatgagaaatgcttactctggggccattctgtgcacttcattatgctttaatgacatttttttattgcccagaaacttaatgtaaccacttcttttttccccttttaaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgtgagtagagtgtgctgcatcaccaaccctccctgttttctttactccaaattccttccaccccttggcccacctcctttgattctttcttaatgttttcttaatgcctaaatcaattacaaggatcaacacaggttaacagggggtgacatatggctgatctttgtttttatttattttatttatttgtttgtttgtttgtttgtttgtttgttttgagacgaggtctcgctctgtcacccagcctggagtgcagtggtgcaatctcggttcactgcagccttgacctcctgggctcaagtgattctcccacctcagcctccccagtagctgggaccacaggcatgcgccaccacacccagctaatttttgtattttctgtagagacagactgatattgaactcctgggctcaagcaatcctcccaccttggcctcccaaagtgctgggattatagacatgagccaaattgcctggcccaatggtcatttttaaaagtataatccgtatgagtcatttgacatgttaaaggtataaattcatcgctcaggaccaccactgcctttattagcagcaagtccagcttctccctcctaatgtctttctccccacctgcaccccccactgtctaagaatctcaagtgcttactcagttcagaatggtcagttaaacttcaaagtacggtggatgggcacatatgggtacatccaatcagttcacagtcactgcctggggtaccttagccaggattccagcgttaacagctctactagttcatcctcaggtgttcagctctgaatcccaaggcatgaaactgtgccaggttggtcagtaccagagaagctgatgtcttccgccacagcctacactagaaccagtctctgtggaacaagcttcaggcccttgtattaagctgaggttgacagcctagacccaacagcccctctacttcagggtgagttcttgcttgcctgtatctccatcagggctgtgccagagacaacagcaaagagttactaagtttgtatctagaggaaatggcttaggggccccaggctcttccctccttgaaggcccggagctctttatacaaattggtctattccatcctcagagctctatataccaaggtaaggaaagtgtttgctaagccacagggggaggtatatctcccctttagtgtggcctcacactaaaatataaaagtggccacacaagccttgtttctcataattacaaaagtccagtccaaggtggtttgctaatcccaactctagacagtggttggcaaagctccaccgatttttaaaattcaacgatgaaatcatgaatatattcttactatagataatgtgaccatatacctcatttgcccagaacggttctaatttatgtctggtgtcccagagcaattaacagcaggtatttttactccaaatttttctggcttggatggtaaattatgtagatgctctaattatagagaagtgtgctaagtaaaatgtggaagtactccgttacatctttctcttcaccttcccaacatcaatacatttcccttttcagaaacaaccactgttaactgtttggtatgatcctgctggtgtttgtctgtgcattgcatttaaatacatttatgcatatgtactttttaaatggatataaggatttcatgtttctgttatttgatttttttcacttagcaatctgtcttagagaactttccacatcaatatttattagtcgacatttgaaacagctacatagaatttcgtagtatgtaggactcataatttgctttgccatgaccctgttgaaggacattgggtgaaattcattttcatttctgctacaaaagtgttacaacaaatatctctatgttgatgtcgctgtgcataactatgagcatgttggcctaaaagtgtacatcttactgaggcattatcagtttacaagttcatctaacaaaatttgagagtggcagctttcccacatttttgtcaatactgaatgtaacaaccttttacatttttgccaatttgatagaataaaaaaagttttactattcttttaatgtctaccttttcatttagttatttgagcaatttttcatatttgttctatacattttgttttgtttttcaactacatggtcacataatttgatcactttctatttttattttggacactttctattttctcattacttagtggaaatttcattatattctaaatataaactctacatgtttgctatttgccttttaatttttctatggtatgttttgtcacacataaatgttaaactttttgtagtaaaaaagtttatatttttcattttagctttgtagatttttatattttctaaaggctttgctcaaccaaagattataaaaatataaccttatatttttatagtttggctttttaaatgtataattttgattgatctgagattttaaaagtatgttctaggagatagctcattttaatttttctaaatagtaaccaatttcaacactatatagtaagttcaccctttcgtctactgattcgaaataccataataaacataacctacattctcattttctgtttccctgccaatatggcactaacataattcaagcagtgtggtattgaaaaagaaatagaaaaaatagaatcaatgtagctgaaaagagagcagtaatacaagaatataatttctattattcttagttttcttggagctcttttttaaaattattaacagattttaaattttactcaacactctgaatctactaagacaatcctaaggttttctcctttactctcttaatatgacaaattgctttacagtagtaaaccagctttgtactgttgggtaaacttaacttagtgatatgtattttaatacatctctgggtttagtttgctaatacaaagcttcacctactataatgtacataagaatatcctgtagattttgatgaagttaaaattctgattcagtagatctggggtaaagtccaagaatccgcattttttaaaaagctcctaggtgctgcctatgttgcaggtacacaaactaacctttgagtggtaggtttatgattttagcaaccttttttcatagggaaaactagtccacatttcttcatttgtatacagctttggtttcatgattatgctaagtttcatagaatgaattggagagtgttcacttttattctctacagaactatatatacagtaaacatttattagaatttgccttatgttttatataggaaatttaaaaaccactaattcaatttctgtaatgcttataagactactgaggcttcctacttccttccaagtgctgcttgagttgtatttcacaagatttagtagagttttataatttttcaatttagaatacattccaatttccaatatgaatatgatttcaacccataaattatttagaagattttttttaatttcccaaaatgcaggtgtttctagttccttttgttgtcaataccttatttaattgcactgtggtcaagaaatacggtttgtttggtgcctgtcctttcaaatacaaagttggtattatggccttgcatgtgttctttttatatatatatatcccatatgtacttgaaaagattgtatattctgcttttgctacctgaaatgcttcatctatgtcaacagattatgttaaatgtgttgttcagatcatctatagcctcaatattttttgcccacgtgatcaatcaattattgagagtgtttgatacctcccactatgatggtagatgtgtaaacttctccctgtagttctgtcgaatttttgtattacatactttttaggctgttttattaggaacatacaagtttagaattgtgatatcccacctgtggtgtcaaaatcggtatagtagtatcccaagtgatcctcttgttctttcaaaattattttctccttagagttaatttgtccatgaatgtagctacagtaactttttaaaaattagtattggcctagtacattttttaaatttttttctaactttgaatgtttttgtgttcttagagttaatgtatcacttataaacagcatataactaaatttttaaaactctattcacacattctttgtccttaactgtatagtttggtttacttatattttttgtgattatgtatagaattggatttatttcttccattttattatgtcctttccatttatcctgcattttttagtcatgttttctcttctttcttgccatcttttgaatgtatctttttcttcttttctcatttcattctttcccctttacttatctgaaaattgtattatctaaatctatttttttatttgttacactagctattcaacatgcattcttaacaaaatcaacaatatcaaagttattcatctttaaaaggattataatttgctgttgctgtctagttttgaaaattctgaactgcttcatttctgttagccatgattttgttgttgttatctttgcaatgaatatttgtttagatgtattcatatactagtgtaccattccttctgtgatctggaacaccttcagtttcgtatccttttcattagactcccgcaacctgaagatggttggttttacacaactctggaaatttttcaagcattatctcttcaaatattgcctctccccattcattctaatatttccttttatcattccaattactcagcctctcctccatgtttgttaatatttttaaaatattttctacctctgtgtctctcaaggatgcattttaaataaagtcatgaattatttcaattcattgattctctcttcagccagatctaattaaattttattttttagttttcagtgttagatactatatttatttcatttctagaaagtctatttctgttttaaatttggtttgtggttctttgtagtcacttgtttcctactcatattttaaagattctctttcatttccttaaatgtatccgagttattttgtatttggtttctaataatctcatacctgaagttgtatgggtctgtttctggatctcatctctttcattttgtgggttttgcctagaactactgatttttctttgtactttatttatgggagttctctcacccccagggtgaagttgggctcctccagtgaaaattagcatttgtttccaccactcagtttgaggcactaccaactaaggactgctttaaaagctctgactgaggttttcttgaacacataggtagcatgaattcgatgactaacgactaacctgcatgaagtttgggttgtggttataaattctttagaaagttatttcttttcttattattcactcccaagattgacagagacaagtttccttacaaacagctgagtgaatatattctcatgtacgcttaccaaaagtggccatttgggattctattttatgcaggtttcttctgttagacttttcattttgtatatctcttaggcttcatctcctttcccttaaaatctccatgcaactatcaaagcagatgctcaaggtctccagaattggaaagaaacctttagggtaaatcccactaggaaggtagtttggctaccatggttcatacttttacttcatttgcaagctctatagatttgtttattttatgccagctcagccatacatttataaagatgttttcaaaatgttttatccagcatttcaactagtttgaccaaaagaatctttcagggtacctaatctgctggttatttctcatagcaccatttattttaacacatgagattttaggatagagaagagataagcacatgtattcagtctactgctcaatctttgagatgtctctctctgtgtttttaaaaattttttctttctataaccctattgcataattaaagccattcatttaatgaacttttacaaggcatttgtatgacaagggacatttaaaaattacgtaatgtgcatgccttcatgttgctataatctgggagtggtgacagcaaatacaataaataactcatatacagattcttagtcattcctgttactataacaaaatatcacatattgggtaatttataaataacagaaatttatttctcacagttctagaggctgggaagtccaagattaagttgctagcagattcagtgtctgctgaaggccttcttgcagcgccctcacatggtggaaaggcaaaagagcaaaacaagactaggacactccctcagcctcttttataaaagcaccaatcccattcatgaggatggagcactcatgactttattacttcccagaaggccctgcctcttaatactatcacatatgcgttttggagggatatattacattcaaaccatggcaacaggaaaatgtgtggtgagtgttgtaagaagtataaaataaagaactctaacagttaaatgaagggaggattaattcccattgaagttatcataaaagttcaagaggaagtggcctttcacctgggattgaaaatgtctgaaatatagtaggatttagtggttaaagaagtaaaaagaattttctcagcaggaggaaatatatggggcaactttgagaaattttaggagcactgtgtaattagagattaagatacatgcaaaagagttgtaaaagataaggccagagtaggacattgaaactacagcttaatattacaagctaaagagttttcacttcttctctaggtataggaagtcactagaggttttggatcgaaaaatattaggatcggaagtgttcttcattgaggttattatgtagggtgatacaaacagatataagagactgcactgcaggataacatatgcataaagagtacctacccactactgagttgaactaaagttcaaattccagctctatgatctcagggaagttatttaatctcttcatatctcagttttctcttctttaaaataaggacagtaattgtatctacctcacaggattgttgtgaggattaaaagaaatattacatagttgctactgcattgtaaatacttaataaatattagactttcttattgcagagaaataatttgcaggattttacctaaagctacagatagtgacattgctaacctattagggttcctcacccatacattctaagatgcaggacctattctgtgctggaccagccaccaatgtgagcaccctgggaaaccacagagttttaaaggaaggtatgattgtggcctatacacatacatttccccaacacttaggagctagtgttaaatgtttttaaaaaaaattcctttagacctcctgatattagaaaaagaaaaaagagagagatcaaagaaagtcagtttacattctctctgttaaatacatggtttaaaaccctgtacttttgaagacttccagttcccagacgagcatataagaagtttagaagttacaccatcctaatgagtaaagagctgaacaaactgaaaaatcaacaactcttcttagatccatcgcaaggcaaaccactgctgccccaaactggagaaataaaaagatacagagaatcacagcttcctggatcagaaacccatgagcagaaatctccagaggaaccagtgctgggagaggaacatctgaactgtcattgataaaactgctggaggctcaacacagacaactctaagggttaaaaactgtaggggactcagtcataagggacccccacacttttgtgagttctagctccaggtgatctatcaggttatcacagtgaaatatcagagaaaaattgcctaatgcttccagcagagggagaggaaaaataaccattttgaaatatagcaaagcattctgttcttaacaaggccccacctcaggaaaggctattttaccagagactgctactggagttttatcagagcctaatttatctggaggaagggaaatctgcaactccagccagctctatcctttcacgtgatggaaaggaaataccccgctccagctctctagccatcctgtcccaccaagcagggaaaaataactgagaagcattcactggtcaagggtgcagtccaggaacacaggctcaccaaaaggctgagacctaatggtaaaattgtagaacgcttcccctcctctcacaccttaccattccatcacaaaggcctgtttactgcagtttcttttacccaatatattacatccacttttcaacaaaaatattacaagacatgctaaaaggcaagaaacacagtttgaagagacagaacaagcatcagagccagtcagctatgacaggaatgttgaaattaccagacaagcaattcttttaaactatgattaatatgctaagggctttaatggaaaaagtagacaacatgcaagaacagctggatcctgtaagcaaagaggtggagagtctaagaaaaaaaacaaaaagaaatgctacagatcaaaaacaccataacagaaatgaagaatgcttttgctgaccttatagtagactgggcacagatgagaaaagaatctctgagcttgagtatatgatgatacaaacttccaaaactgaaaaacaaagaggaaaaagactgaaacagaacagaatattcaagaactgtgggacaacttcaaactgtgtaatgggaatatcagaaggaaaagaaagaaataaaagaaaagaagcaatatttgaagcaataataactgagaatttcccccaagttaatatcagacaccaaaccacagatccaggaaactctgagaacaccaaccaagatgaacgcacgaaaaactacacgtagacatattgtatccgaacttcagaaaataaaagataaagacaaaatcttgaaagaagccagaggggaaaaacaccttatctttagaggagcaaagattagaattatatctgactgctcttcagaagtcatccaagcaagaagaaagtagcatgaaatatttaaagtgttaagagaaaaaagccctccaacctaggattctatactctgtgaaagtatcctttaaaaatgaaggagaatttttatcagattttatctgatttttatcaaacaaaaattcaggaaatttgttgctagtagacctaccttgcaagaaatattcaaagaagttcttcagagagaaggaaaatgatatagaagctcagatctatataaagaaagaaggagcatcagagaataaatgaaggtaaaataaaaacttctatttttcttagtcttaattgatccaacaaataacagtatgtttaaaataatagcagcaatatattcagacataggtgagatagatagatagatgacagatagatgatagatttgcttttatacaagtgaaatgagtgacagggatgatgcaagggataagagggactttgggtgactgtgatgtgtccttgtaggttcatcagtggtaataaatgtaccactgtggtgtaggatgtctatagtgaaggagattggagggcagtggtgttagaggggaactctctgtattttgcgctcaattttgctgtcaacctaaaactctctgttactaaattttaaaattatacttttgaaagatgcatgcaaagtgaaatgaagacaaattagatttttttgtatataaacatcagcttaggaaatttgtatggaaactggtgactttccatagctccaaacaagtaacatcacaatttgctcaacagaacgaccttgttctacaaatctatgaatattattaaaataaagagagtaataaacttccatgtcacactatactgcaaaaaaataaaagtttaggtatcatttctatatactttggaattttgttaggaatgtctataactgtcaaaataaattaatacattttgagtagagaaaatctttggtttttaatattaagtttcttggggcatatttagatgtcgaaaatctggaattgaagcagagttccttgtcattcataagtttctgctgtaatttatttgagtgacactgctctttttctcttttccctaaagcaaaaataatgccatgatgttcagtttggctgctcaagctgattgacgctgagtaaattgtctctgaataagatgaaaatgtaaatctttttgaagaaaatagcaatataaaagctcctgtgtttccctttttcttttaaattgcagcttgcagagacactacctaaatcacatttctttcctgcctgtcacaaaagaatccattagcttggtccccacatcagaatcttaatccagcaaagactaactacatgaattgaccactgaacaggaagcctacagctttttataaactcagccaggactctgtcttcatgtcataccagcaaaatattcacccaccccacatcccacaccacagtcgtacatttgctacaattgacgaacctacatgaacactcagaaccacccaaagtccctctcatccctcctatcattcctgtcacgcatttcactagcataaaagcaaatcagaagggaatcacctttccgccatttttttttcaacttagtattaagtttatcaaatagtattaccaccagatggtatctaccagtagtagaaccactgtggtacatcaccaagcatcagcaattatcatttcatgaccaatcttctttcatctgtatcctcacccctttcccatattttttcataacaaatcctcaacatcatattgtttcatccataaacatttcagcattatttccaaaaaataaagactcctttttaaaagacataataatacaattatcaccccttaaagtaattaactataattgcctatcattataaatcttcagttaatgctcaaatttctaaatggctcataaatattacataatgtattttacagttagtttgaatcaagatccaaagaaggttcacacattgtaattggttgatagatctcctaaagtctgttttcatctctgtgtttcctgcccctccccaatttccacccctgcctttatttgttaatgcaaatgtgttttgtcttataaattttcctacagtctgggctttgttgattgtattcacatcacattgtttaatgtgttactctattttctttttcataaaatacgcatttttatttttaaaaagaatgaaaggattgatcaaattcagattttatttttttttttgaaagatcacttcctaggtagttgtgtgctctgtctagaggcacataatgtcccatttttttttctctttttgtgacattagcagcctttgatggtcaattcttagatccattgactcattaggggtttcttcacttatagctgggatagtcctataaaaagctaattccttttaatcaatttttgttaccccgtggtacaatttttataggaaacacagaacaaatgcttagttctttccctttactagctttcaaaatgattatttttgcattagcatccttcatctgtgacccattagaggtgtttttctttttttagcattactatggagtaagggttttaaacatatttgatatgttttagtccattgcaattatcctttttaatgctcaaattgccccatccttgtgatgggaatctcttcaaggaatatcttctgaatccttctgatgtgatcctagtagtctttgatagtgtccttgctatctggtatgacaagatataaatttctgctgcagacctagaagcatccattgcatcaaggaaccctggtttcttctgatgggaaatgatattatttcagcatcacagtctgggcttaagggtgctcgtcgtttgtggtttgttattgtttctaggccatttcaatggacagatctaggaagtgtgtgtgtgtgtgtgtgtgtgtgtgtaaattaaacactttttgagttcaaattcatatttacaatttgaattcaggactacaaggttaattaacctatattttaactggatttcctttctttcatgccaaatttcccattctcaaaacaccagaaaatcctgttatttttagtaaaaagcaacaacaaagggactctctgacacttggtatttcaagagaaatgaaatattcaggtgaaacaggaaaaatggttttcatccatactaattattgccactgattaaatggaaagatgataaattagcttctcattcaaggagaagctaatgcttagaaactaaaatgtactttgtacccctagattaaagattcaatataagtggaggttgctctatggtgaaagagaatagatgagtctatacttgttaagacattcgaaaacacttttccaagttatattagaggctcataggtgtctgtattgagaaaaataaacactttcaatcactcctttgcagccctccataactcaggctctgtgaaaaatgttttgtttctagacctagatacccctggcgtgtttcattcatatgggatgactccggggcatgttcaacccaattgttccaaacccatggaaatctgcaagtgacaaagaaaataagatcccagtagagtaagtcaggtttattttcttgaaagtgccctgtagtatagtttgaagtcaggtagtgtgatgcctccagctttgttcttttggcttaggattgacttggcgatgcgggctcttttttggttccatatgaacttcaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctctttgatttccttgagcagtggtttgtagttctccttgaagaggtccttcacatcccttgtaagttggattcctaggtattttattctgtttgaagcaattgtgaatgggagttcactcatgatttggctctctgtttgtctgttgttggtgtataagaatgcttgtgatttttgtacattgattttgtatcctgagactttgctgaagttgcttagtgggtgaaggacatgaacagacacttctcaaaagaagacatttatgcagccaaaaaacacatgaaaaaatgctcatcatcactggccatcagagaaatgcaaatcaaaaccacaatgagatacccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatgtagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattcttagtaaactatcgcaagaacaaaaaaccaaacaccgaatattctcactcataggtgggaattgaacagtgagatcacatggacacaggaaggggaacatcacactctggggactgttgtggggtggggggaggggggagggatagcattgggagatatatctaatgctggatgacaagttagtgggtgcagcgcaccagcatggcacatgtatacatatgtaactaacctgtacaatgtgcacaggtaccctaaaacttaaagtataataataaaagaaagaaaaacttaaaaaaaaaaaaaaaagaaagaaagtgccctgcactttcagcctgtcccatcagtagacactagagaggccaatccattttaaggctcatcagagctctgaaatgagccaccatataaataaggataaacccagtctcatttctgagagcccttagaacatttccatatctcctcataatcatataagtaactgtcatgcaaagtgaaaatgtgacagtagatcttcaaggaaatgctgtggccacacacaggagagaaacaggatcagagggatgcaagagagctccatgggacaggagcataattttaggggaactcattcattcagttattcaactgcttattgaatgcccacccactcactctgtaccttgatactgtctcacagacccaaatacatctggtttcaaatcctggagcaagcctactacgtttgtggcctttggcaagttactaagcctctgtgccctaatttttccatctgcacaatcaggcactaatgcctgtctcaaagagtttctgaagttaaatagggaaaagaccatataaattgcctagcacagtgcctgtctcacagtagacccaaataaatctggtttcaaatcctggagcaagcccactacgtttgtggcctttggcaagttactaagcctctgtgccctaatttttccaactgcataatcaggcactaatgcctgtctcgaagagtttctggagttaaatagggaaaagaccatataaattgcctagcacagtgcctggcagatacacagcattgcaggaaacttgccttgcctacccaaagagcttcacttttctctgttagaggagagaagaaggagagagagagggaaggtgagagggtagaggacttgagagatgaggatgtaaagggttgttgcagggaaccagaaaataagcaggcagactcaagtgaaataattgtctagaggcactgaaaagccagcacaaaaagttttggtcaatgggtttgtttttaggtatttgaacagggaggtggacagtggaggttttcccagctcacttaattttgcatagataacttggtgaatcagaatttcttaattgacagaaagtctccccattcgtgtttgcaggagagagtgagtggggtgggggtaaggcaggtaaggagaatctgttaaaatgtgagattcacctctgagaataatcatttttcttctccagtgggaagtgagttatcaaatttaagaacaacttctctgaaagaaaattcgcctctgctctttcccacacccttacccttattatttggctttgcaagcatccccacgatataggcttataaatttagtttatctctcccttagcctggtctccctttattataccactttactgcttctttggggctgagactcttaaaatttgggtcaaatgttccattaagttaaccactttagaataccaataacacttctgcagcacttttcatcttcatagtggttcacaaacatctccttcttcactaatgaagatgagtcgaatatcttatagcatctaaaaccaaagctatttaatcattgtctggtgtgggaaagtgagacaaaatgcaagaccaacaaaaaagtatattacatttcaaacttgctgattcaaacttttgaaaaattctttgaatatgcaggcagaacttatgccacaaaaccctagtttttgtaatgaaaatggccataagcataatagcaacattgcaggggtatttttagctcttcatattttatagagtgcttttcagttcattatttcatttgatcttcatgaaaacccatgagaagaaaaggaattattattcacatattttagacaaggcctattgtggttaattcacatcctcaagtttccagttactaaagatttgtgctgagactagaaccccaaacttcacgctccaagtccgaagttctttccatgaggtttcctgcctgtgctgtgcagtaactggagtttccactggggcccctcaaaggacgggggaatggagcaggatgtgtgcgttcccttctctttcaactagagcagctccacaagtatattgcatttggggcttccacatggatttctccagttcagttttattgcacagagcatgcagcatctcttgtactgttcatgatccagctggactgtgagctgcattctgaaattattcaacaggcctgcaaagctccattaatggcaggggcagttgcatactataatttctcccccttgcctgcccacaaccttgcatctttaacaccagctagctgttctgggccagtagagccatccgatggcctttggatgcaccaactcttccttgactttcttttcttctatgtgagggatagcgtgtttcctcttttaccactggacatttttacctttgagggtctctgattcatcacagaggcccagggggttcttccagatcagaaccatcttgccatggcgatgctggtgcctaacacacttgtgcagccagcgctgttgaagacacaaacactcatacactcattctttagcaaattattccattcctaaagagatgctctatgtcttcctttgtcttctttcttctcctttgcactcttcattttccctctcttgtgtctttccatgagcataaaacaatcagaacatagatgacaagcacaatgccaggtactcagtatctgaaaaaattgaagccattacttctgaagggaaattaagcaagataaatatcaagtagcaagtgacgacattttttaaagagccttcaggtacagaatcatcgcaagtcgtcagtcatctataatcactctctttttacaagcatgccttgaaaactcatttctccttttcatccttcaaaattcagctcaaatgtcacttcctgcaaatgttttactgacatctctggacaggctccatcaccccttctgatgtctcctccagaactttgaacacaccttttactgtagcactttacacattatatttattagaattgcttatttatgtgtctgtgtcttacactaaactaagaattggtttttggtttgctttgcttcatcctttttttcaagcagttaatatacagcctagctgagcacattgcggatgtacaattttttattgttgttgatgaatgtgaatttagttaactaaatgatcacccaggattcaagaaaaaacaagctcattcttactcattttaattctatttttggaatagaattgctttctactgttcttcactgaaatttgaagtgtatttttttttttttttgctgtcatatgagttgtatagattttgctgacaatcttaagaatcttaatttataaattgtttctgtggaaaaatacattttaccttctaaaatgttcaagcatacacaaagaaaaaagtggagttttgtccataactagtatatcacattttccaatatctcacatatactatgaaggtgggagggaaaatctcagtactttgcttttcatataaaagcccctctctctctctaattctgtcttccttttccctgatgtctgccttgtccctgcccccggatctttacctcatttagagaattcatctcattctcttcattcttccaaggtttacagtttggttttctgttgtatactttgtggtctaccttgaatctgttattcacctattttcccctgttgaatccagttgttagaggatgagcactatgcacctttcattgttgatttttcacaatggaattttgaagtacaatattgaaatatgggggatattttggttccagataggaatagctcctagttcctcatcatttgccatctgagcacaaagcagacaaggtccaaatttcagccttcacactctcttttctctctttcccatcttgcattcttttctccagagatgaagagaaatgacataatcaggtcaataagacattcgttttcatcttgattgctcttgtctgggtgcttaattatgagatgtcaattattcaacactctaaagagcagtcttctgagcacaaaacgttttagtcgtctggtattaaaaatgcttgttttctgcttttaggctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtgataccaaggttacatggacattcttaacaggaccaacactattttaatttgatccatgtatcccaaattcctttattccggggccctttttttttccagaacagtgcctgacagacagcaggtgcttaatcaacatttgttgcctgtctctatcctttcaatcatattccaaataatttttaagtaaaaaaaattgacacatcctggtgatattgaaggcttcctcatgaagattgatatctgttaagcagaaataccaggcacagggccaggcacagtgactcacgcctgtaatcccagcactttgggaggccgaggcaggcggctcacttgaagtcaggagttccagaccagcctggccaacatggtgaaatcccatctctactaaaaatacaaaaagtagccaggcatggtggcatgcacctgtagtcccagctacttaggaggctgagacaggagaatggctcgaacccgggaggcagaggttgcagtgagccgagactgcgccatagcactccatcctgggtgacacagcgagtctctatatcaaaaaaaaaaaaaaaggaaagaaaagaaatagcatgcgctaatattaatacctggaaggagggcaccatgctgtggttatcactcctgggggaggactctaaacacctaaccagtttctgcgtaagttcctagctctgacaggaggttttgcacaaacttggctgccagagtatgaatctggtgagacagaattcccacacaacaagatgggcaaagtaactttattacaggttgagtactccttttctgaaatgcttggaaccagaagtgctttagatttcagatttgttttttttaatatttgcatcgcacttaccagttgagcatcccaaatctgaaaattcaaactccaaaatgctctaatgagcatttcctttgagcatcttgtcaccgctcaaaaagttttgcattttggagcattttggagtttggatttttggatttgggatgctcaacttgtattcacagataggcagcaagaagcaaccgaagtctaggatccatggtgagccattcccccaaggctcaggaaagcacccccaggaagatggaatcttgtctgcacatgccccactttgcatgacagctgagggctccccaaagcgcttctctcggggttttatatcccaggtgccacctgaatcactgagcaaaagtattacaagacatcctattctaggagggataaggacagttcctccttatctcaggacgttgcactcttggtacactctgcctgagaattgccaagaaaaagaggaagagctgggtcagcaagggtcatctggggacctgtcctcctgcaatattgaggccccagtcaatattgttcatacactaagtgaaggaggtagacactcagagggtgttaaatggtataatttcatattgtttgtaaaccaacaaataaagtttttattattgaatgatacaatattactaataaggatagcttttgcagcttgccagacatgtgaagatcaaacaaattgatgcatacggttgatttgtatgtgtatatatgtgtgtgtgtatgtatgtgtgtgtatatataagtgaagacatttctatttttaaaatcagctttagatcctacatttaaattagttcctacaatcttgtcagaaacacattttttgaaatatgatttttaaaaatgtttggtggttttgtcttggtttattttacaaataggggttcactaaatcttggggaaaagttccccagcatctctgcacaggcagagcagaatgaagacagactctatctctggaactgttgtagcttgtagatggcatgaagcagctgtgaatgtgctcgatttaaattgtacacatgtataatcctacattacattcatagaataataggcccaaaagtggcctcgcccattaataagttaaaccttagagatgagtaaactggggcctgtgaaatgtagtgatttgcccaagatcacgattatttattgacagagttggaataaatgcctggtttaggacttctggtctggtgccttttctactatatatcaccctgatatgtcaacaaatgcatggtgtgtgtgataggcatggtggtaggatttatgagcttatagtgattcgggaagaggttcccagaggaggcaagttttgacatataatttaaaagatggaaaggttgtgctgtggtccacaggacttggaaagctattcattctggtctcagcaagtaagagcctggtgagggctggccacagggtgtacctgtctggcatcagaggctcaggcttagtgccaggcagttaaaaataagaagggtaagaggactgggattgcaagctctgggtcttcagtccctttccccaatcttaaataaagccaacagaagaccttccattcatctggcttcttcctgccaccatgaagacagctgagaagcagcagagattttaggcacagctgaaccactgcactgccagttcaactaagattcaaagactctagaaatagagctaccctaggtcccaggtctaatttctcatttcttgccctgggtcagccagagtaatgatcaatctgctaattctaatctgtcagaaggcaatctggtgggatggaagtttatggactctggaagcaaggtattgtaggtctaattctagctctgccagtttatagctgtgtgacctaaaattcttaacctctcttggcctgactttatttatctcttgacaaatatttactgagggacaagtacatgccagtcacagaagatttagggtgaaaaaaaattcctcaaaaagctcatttataaaactgagtttattatattctcctcagaaatttgttatgaggataaaaggaactaatagttttatgatgactaggcacattctaattcagtaaatattacttcctcccactagatcaagctctttataaataataatgatgattatgttaatattactgttactttcttgaacagagtttaacaacctgactttatctataacaatgttaatttattttcttttactatacaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggtaaatacttgttaattatgaaaaattacagtcaaatattctatctcccagtaatggcttctgagggtgagtatcccaagtagttgtttaaaattcccatatttgtattatgcccaaagccaagaaaaataaatatacatatagttttatgtttatcttgtaccaggttctcatttcataaaacaaagaacaaagtgacaattgtttagatatttgaaatcttttctttgtgcctcaagtcagaactgtagagctttcctgccaaactcaggaattatctaccccaatggttttcaaagtgttgtggaaggatcccaagaatcctggaaccccaggagtatgagagggccacgtaggcagagctcctagttccttccacgcctcaccagagcggctctgaccagctccaccgctaattattttgtatataattggagcctatgtaagattttgtttggaaaaaaaaaaaaaaagagtcccagtaattttttttttaattccaacccaacctcctaagttttcatttgaggaaacaagctttcccttatctgtatccatcttgcaagtttacagaaccttgaattcagtggagttagaaactcaagcttaaattgtaagaactctaaaccgtcttgtgctacctcccaccacataccgtggtcatctgctgtctgcataattccttccagtttcagaatgcttcttatttgggagaaagcccattccattgcagaagcctggtttcaaagagtagttttctaataagccagaaatctgcctcccctcagtttgagctagagcaaatacagatcaaatctactctattttcaaatatttgaagacagtcatcttgtctccttcctgtgagccccccacccccgagtttggcctctcactttggaatgttcttgtcagtcagcctgcattgtgagagtatcttctgtggaaggggcacagttacatgcatagctggttggataattcaatagacatgacaaacaagatcctgcctctgaggatgttgtgatcatcacacctccatgactctgtatatttatttaatgaaaacaaccataataataggtactctgcttcaagctctggaaatctagagtctcaatgaaacactggcctgaatcccagagaaaaatcctgtactattttttcaggaaaattctggcctttcccacaagtttccttgtaggacattcccataaaaagattaacatgcaacatctatcagattattcatcttccacatctacagcaatgaccttaaagctgggagtttttgacatctctccatgtgagtcttgtgcagcattctgcaggggaggaaggagattttatggtcaaatatgtttgcaaaacaatgtacaatcttggagatttgccatgtacattagcatcgtaaagggttctagaaggaagcactttctttgaccacaattcccttttttaagaacacttattgacatcccacagaactgctagtccctacgggaaatgctgacatgaggccatgactcaggaacctggctgctcatcacacttggtcgggacaccttttaatacagagctttctggcctcacaccagagctgctgagtcagactctctgagtctgaagaaaagtttaagaagctttctggctaattggattatcagccaggtgtgaggccgcaaatccaagggataggtgatagtctccattgttcaaagttacattttgcttcattactttagcttcctttaaaacatatttgcatattctgtccttgcattttagtgaggtttgccatatgacaaccacacacacactgcttcccagtttgctttaagatcaaatgtcactgtcatttctgtttatgtaagttctcatgcttgaaatgtctagcagaatttagtcccaagctaaatcatggatcttcaatatctgatcacaaaagtcatataatatgagccaggcacagtgggtcacagcactttgggacaccaaggtgggaggaacacttaaggccaggaattcaagatcagcctaggcagcgtagtgagactcagtttctacaaaaaaatttttcaaaattagctgggtgtggtggccacacctgtagtcccagcaaaacctagttcaaagttacagtgaggtatgattgtgccactgcactccagcctgggcaacagagcgagaaccgtctttaaataaaatatttaaaaattcttgactgggtgcagtgacccacacctgtaatcccagcactttgagaggccaaggcagattgcttgagcccaggagttagagaacagcctgggcaacatggtgaaaccccatctctaccaaaaagtacaaaaaaattagccaggtgtagtggcacacatctgtagtcccagctactcaggagactgaggtgggagtatcaattgagcctgggaagaggaggttgcagtgagccaagattgtgtgctactatactccaacctgggcgacagtgtgaccctgtctcaaaaaaaaaattatcaataactgtgtatgtttcagtttattcccagactaccagagaattcagtcaaatctgatgcttaattatagcaaacataccagatctcatagttagcaggtatagcaggtatgctgcttttccttcctatggcactgcttttctatttctattttattaatcagacacacacacacacacacacacacacacgtatgcacatacatgtgtgtttattaaatattgtacaatttcaggaaactgatgaagagaaagtaaataccatttcatcttccaggagccagtatatagcaggaaagacatagaactctgaattcagtgaggaaagaaaaaggtcacaacaccaggagagtgacatggattttcagcctatgccatcgagattaatgtgcttggcttaaactgaaggtggccattctcaccttctcccagccttaaatgaaagttagtatcatcatgacaatgtccaaccgggcatcagtgatctcttggatttctaagctgaatttgaatttaatttgtgtcatccaggcagagtagctgacatatctgagaaggaattccttgcttctctgcacaaaggaaaataaagtatctgtcctgacatctgaatattttaaatctttgattcttcaaaattattctcagaaaattatcttagtgagatggttcattgcacaggtaggctttattactcgatttattgagtattctgtggacacatttgtactctgcctcatagaagggaaggtgattctctgtggagcttctcaccaagtataaaccaatggtgacaactgaagttaatgaaccatggctcagggtgactggctttagaattatttgtgttgatatctgaaaaaaacccaaaacctactgtgtaccttttattcagtgaagatgatggtggttgactttcagagaatacatgaatgtttaacaaaagaacaacaaatcaaagcatagtaaagtagaataaatagtatagtgaagtagcaaacacacagtaaagtagtgaaaggtcctcttggctagagatgttccaaagtttcttaccaattttcttttcatgtgttcttgtcctgactgaaaggctttgctattcctgatgagaaactcatgttctcaataaaagctgacttttacccacctgtatatcacctgtgagcaaaccacacaaaccaagagtaatagaatgtgaggcttattcttctctcagttcatgtcacagcacagggttttgcacatttaaaatgttcaatgcttgttgacttgatcaatcctgccagtagcatcagctgtttcctgcatacataaatattttaaaatattttttcttttattattattatactttaagttttagggtacatgtgcacaatatgcaggttagttacatgtgtatacatgtgccatgctggtattttttgaacctttcacataatgctgtaaatttgatgggaaaggcaaagcttttgtttcttctctttacaggacagaagaaaggcagttctggattggatttaataaaagaaacccactgaatgccggctcatgggagtggtctgatagaactcctgtaagtcttttcaaactggagaaaagggatggattcaaaacaagtgggcctgggaccacttggtaaaccaaccaagagaacctagaaatgatggccagagctcccatgacaaaactgcaccagaccttagtaccaggagaattatttggcaaggtcctgagaaatctttgctagccatattgttctgaggccattgtacaatttcagcctgaaaaagtatcaaaaacctccaaaaagtccccccaaaccatctcccatatgaagtctctctggcagagaagcagctattctttaaaataacacaagactccctttaccctatacctccctatcctgcatatcacctgattatctgagtatgggaaccttgtccatgtcataatgaaatgaagattattttggagaatgatttttcatttatctcactctgaaaggacagtaatgcaagttttagaaatatcaccttctagagcaagttattccagaaggaaaaaaaaagtcttggttttcattcattcccatacttgcaaacctctatgaaggacacagagaactcactattgtatttttttccagttgcaatgggtaattctcacatttttctcaaaatgacagggaaaaaactgaagtagtatcctagattgaagtgggatccatcctacggcacatgaaaaatcacattattcactttcacctgtgaaatggggagactcctaagagcctgcagtgagaatttaatgcaactgctgtttattgagtccttatactgttccaagcgctgagctgaatgcactcctacatgatctcatttcatccttacaataactcagtgccatgggtattagaatgattaagtggcttgcctaaaatatataggagagccaggatttgcacacaggttgtctgactccaaagtcacaatgttataatatctcatgattagcaaaatatcagtagccaaactttgaagtagtaaagaacaatagagaaagccccgtaccaagatggttttcaaatttatgtcaaggaagaggtttatagaagagagtaggaagagattttaaaggtcattcagccccactaatccatttttctgataaagaaaccaaggctcagaaaacagaaaaggcatagcagggtcaacttactccataaatggcagccactacatgagacagctgggtggttcaagtcaatgtagcactcgaaaaagaaatgtgacacatagaagttgagaacactttcttttgttttagtataacaaactcattagtaataggagaggaacagacaatctgggtcagaataaattagataaggccatgaagcagtggccgagcttctcactaatatctgctggacaaaatgaattcaaatcacaccattttctgaacctgaggctatatatattttagatagatgaattattacgtgacagtgtacatgtttgaggaggaatataaaggattttaaaacatcctttttttccccaaatttttaccccaattttacttgtggtacatccattcttctgtgagatagtcattaaataattgagaaggttgattctttaatacccccgtaatgtgaattatatgagttatgtggtcactcatggaaagtgacctgatagattcctgattaaagctagctatagcttagaatttagttattagagacaaaaaacttagcatatgttcaaagtaatcaaaatcaaagttaataccaagatctggcacacccttgagtccctaagtttacccaggattccaaggctagaaaattttcccagttagaaaaatgtgcaaattcagaccaaagcttgcatttgatttgttccttctggagaaaggaatagcatacctttttttaatttttattttatttatttattttttttgagacggagtcttgctctgtcacccaggctggagtgcagtggtgggatttcggctcactgcaagctctgcttcctgggtccacgccattctcccgagtagctgggactacaggtgcccaccaccacaaccagctaattttttgtttttgtatttttagtagagatggggtttcaccgtgttagccaggatggtctcaatctcctgagcttgtgatctgcccaccttggcctcccaaagtgctgggattacaggcatgagccaccgtgcctggccttttgttttcttgtttttgtttttgttttttaaaaaggcatctttaagaaaaaaatgctaaatattgattagcttgttcttcacaaatgtgaaacaaccttcaactagaatgacatccagacatttctgaagcttcctggagtagcctataatgcttatgtacagggatgccctttttgatcttttgaaactttgtggggggatcatcattaaggaataatgaacttcatctgctgcaggttgtctcttcgtttttagacaacacttattttggagaagatgcaagaaactgtgctgtttataaggcaaacaaaacattgctgcccttacactgtggttccaaacgtgaatggatatgcaaaatcccaagaggtaaaaatagtagtaagatctttgctatatgtttgatttctaataatctctagtactttcccaatttaaacaccccaaaccacaatatcaacaaattgcatgataaaataaattacactactttagcaaaaaatgtttctataggaaatgggaaaaggcgacaccaatgcaggatgccaagttagttcattgggaactaaggtaaccagctaatattgcagaatatttatagtgcaagtatagtcggggaaaaatgtcactttgacattacagagcaaatggaattacttgcacaatgagtaagtggaaacacctgggacagtgtgtggcacacagtggcctcagcaagtgctcatgtccttccttctttaattagaagcctctctggagcttcctcttcaagtgtgagaactcaccatatattccaaacagcacaatgtacctgttttaaagtgatgttttaaaagatgaaggacaaaatagtgtgtttagagctgaagtaattcacagacaatgcacttgagaagcaagatcagtcaaagtgatttgctttcactttgcagatgtgaaacccaagattccgttctggtaccagtacggtaagaacgactctggcagctcttgaatttctaattattaatatataccatataagtgctattatataccattaatgtgttgttacatttctcaaatcgagcctctcttttcttgtgtcaacctagagctaatttgttcaaattaataattaataaatgtagtcatttaatatgattaaggactagtatcatcaatcattttcatgacatgcgattttagaatatgtacctatccccgaccttttaatactagtgaaggtatcttgtaagagatagaccaaagaaaaaaagcaagttatatatctatttatgtgcatatgtgtctgtgtgtgtgtgttcaaattcctgtgtgtgtgtatacaattatttttaatgttgagtgaccaaatctcaaatttggggtcaatcctagcatacctatttatcatttcagcattattttcactgtttctttttcagatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcggtacttgaacataactcaccacgaaaaattcagagtttagcaccttcttttgcccttgggagggagggagggatagttttttcgatttgacttcggatatttatttaaacttcagtaaaagccatagatttcagtaaagccatagatttttgagaatttttttcctattatagagattaagagaaaataatggaggtacaggtttactgtattgctcagtcatttcccttctcttcattctttgttagcaacaatggtgagcacgtcgagattgtttcatgaggttcattcgatcatttaatcactggtagaactggggttttaccagtgattaaaaaagacccaaattcctatcttcatggagtttatattctcgtctgggaagaaagaccataatcaattcgagtaaatagaattatataatatattagaaaaaataagtggataaatgccacagaggaaaattaagctcaaatgagggatgaggaatacctgggggggtgcctggcagttttaaactttcaaatcttacaagagtacattatttttaagtttgtaaagactaatatacagaaaatagtaaggagtagttttctatttcaacttaaagtagagaaaggctacttaattccttgcagaactaagctagtaagaaagaaacatgtaagacctattaaataataaactggcaaagaatagtgtactttttcagtgtgttccttcaataagcattcattatcaagtatgtgccaggcactgggatatttgtcaaagatgcaaaaatgtatgagatacagtctctgtttttaaaaaggctagatatatatactttaaaacatcatgttgtatacaataaatacatacaattttatttttcaatttttaaaacataaatttaaaaactaaagctggaagtgatatgatgtagtaaatagaaagggcacagaaagtgcaaattacaatgggggcatgaaggcgggaaatcctcactcccctttcccttggaagctttgaaagcaagaaaaagccattttcttttcctgtaatttaatcatatttcatgatcttcaggaatcctttctaactctatcatctttttatatctctgtaagttgactataaaatgaagccctgtattaaagcatcctaggcttgagaaagaaatgtctttcctcacagttcatggggatttactgtctctatatcttgtctgttgcacatacagcccatgaggtacaagcaggtcaggactcctgctacattctgatgaagaagccgagaaaaagagaagttagatgacaatcacatggtcccacagacactcagttgcagaacaaccactagatgtggaattttccccatcataaatttgtacactattttgtcacccttccactcttacgaatggaacactcaagccaaaaccataatgttcaatatgagcatgttcaattctataccatgatgtcggaaaatacacatttctttagccagacaccatactcctcacctcagagggcaataacaagagaccagatgaatggctgaaaactaatccatacgcatgcaaagtatacaacccaaaaagagctgatatttggctatacttaccataactgtttcaggtactatgataagtactaaaatgtaatcttcccaagaaccccctgtgggaagtctattattagtacatttttacaggtgagtaggctaagacttcaaagaggttaagcaacttggttacacagcagctaagtggtggaatttggaaagaaacccaggccatcttatttatccagtcatttaaaaaccctacacggtgctgcctgtgacagtggaacagcagtgtcagggcatgtaagagcacaacgtcttcattacatcaaaagctagttccaaaatcctccccaaaacatggctgccagcttcgtctcagacatgaacaatgaagggcttctttgatctttccaacagagcttagctctgctgggaacttctgtagatcttctgtcttcacctttcctcttaattcatctcctaatctttggaagttgggaagccaatggggatggcgtagataatgcctcccatggaagggaagggcgaaaccccacaggctgagcagtttgagtcatcatagccactgccatgatctagttgaggattctgacctcaaatcagacaaactttatggtgccttatatggcaaaattgtcacctggcctatgaccacgttgatgtagaatgccccatcagtttcatgggtaaggtgctaactaatctccccactgtgctgcaaaagaaagttatgggaaggtataggatttgaatactgagaacagggccaggggactgtcctagtcttttcaggctgctataaaaaaacactatagactacgcagcttacaaacaacagaaaattattgctcacagtcctggaggctggaaactcaagatctaggcattggcagatttgatgtctggtgaatgcccacttcctggttcatatgtatccttacatagtggaagaggcaaaggagctctccaaggtccccttttaagggcactaatcccattcatgagacacccccaccccccaccctcatgaccttatcatctgccatctgccttgtaatatatcaccttgagagttaggatttcaacaatgtaaattttagggggacacaaacatttagtctgtagtggggtccaaggggaaaggatatcaaattagaaagaagaaagctgttgctttccaaaaaattcttatttctgcataatttgtgcctaccttgggcacttattgttggtggtggtgatagtggtgttcacattttgtaagaaagaaaccccacacctaagaacgtcctgctggaatgggtcaatccagaagttacttcattccaggatgaggagcaagatgtgtagaggtgattccactcacttctgtctcacatttatcttataaatgtaggaagagtacaaataagtaattaaatatttttaaaattacgtatgtgctttgtgtagcttccctaagaagagcagtgattagaattgtgaaaaacaaaaatagcagttagttgcagtgtcaaaaaaattaattatgaacaagcaagctagatacagtttaaaaatctgaagcaaataaaaattttaataaaatgtttccatcttggaaaaagaatgtcaatattttctctcccactctttgagtaacagaagaccataaagcatgattagagtgaatttattttttgagccatcttgataatcacattaatgctgaaaaaacgctgcaagcactttaggagttgtttgacacaaactactagctaattagtctgcttatctgacatttttacactgttatgcagtattgtcattttgaaatggcaatttaccattattattaaatttttatttctaaatgcttctcaaaatacatatcaaatctattagtcctcctccaaaatatcatttgtcatccttgatgggaacattttaaaagatgacaggttgttcttccttatattgctttatggattaatgtagtgactgtcactgtggggttttgtttgtttttggtaaatgctgtttccatatgatgctaactataatggctgtttgtaaataccaaaacatagttgatgttataaaatgcatgttcatatgacattttttaagccctgagcttacttctctatcacatttctttatgcaaacacatgttaataagtcttctattgttgtggccttcttaagctaaaatttcaaacatccattttcacattggatgttccattctgggtatcttctagcatctcctatgaagttcagttctgtgccatatcacaacaggttgtgatgtgccatgtggaggttaccacgccataattgaggtggtaataaatatgccacttaggatgcagcagttataatttctctttagaggtccttaattggggcagtgaacaatccaggccatgatttccagtcccgtggcacatgaaacctctttagattgaatgaaattgttgtggttcccccactgagttaacagccagtctcagtggacccattccaacgtctgacaatgggaatctgaattcagcctgtaagaacatgtccacgaaacaacacctcagggatacaaaattacagttgttccatcttgcattattctcaaattgctgatatgacaaatagccatgctgtttacagaataaaaatacctgtttataaattagattgttagagggctattgggttctgttgtatggagagctgaaattcctatggaaaaataatgtatcttaaaatttcttctgaagtctttacagaagaaacgagagtacaaatttaaatatataatgccttcaaattaacaggattttagcatataaaaattaacttacagttcagcacacaacacacacacacacacccccattaagtatactgatttacaggtcttagaaaaacccttacttcctcttcctcttttatagttaaagagggaatttcaatttcctgggtcataagtcagtacatctgccctaatgtgtgtgtgtgtgtatgtgtgtgtgtgtgcacgcacacacgtgtgcacatgcatgcacatagtgctttaattttatactttattgtacttaggtccaagtgattaatagtggtataaaattagtaaaatgtaaaaggataattttctttttgttgttgttgttcaagtcttctatttccttactaatttttactacctttattctgaacactacaacattactaatacaatcttagattaagtggtttttttattggtgataactatatcactctgttaacatagaatttataatctactaaaattccaattttttgttatacagtttaattttatattaaaaagtacatattttgaaatgtgtccatgttgacacatataaatctggttcctttttttattattatactttaagttctgggatacatgtgcagaacatgcaggtttgttacataggtatacatatgccatggtagtttgctgtacccatcaacctgtcatctacgttaggtatttcccctaatgctatccctcccccagccccccaccccccgacaggccccagtgtgtgatgttcccctccctgtgtccatgtgttctcattgttcagctcccacttatgagtgagaacatgcggtgtttggttttctgttcatgtgttagtttgctgagattgatggtttccagcttcatccatgtccctgcaaaggacatgaactcatcaaaaggataattttctagttgtcaaacactgggcactctgtagtattcttttgtcctatattgtgtctctctatttgaatgggaaggaaagcttatactgcttaaagcttagcaatcagactaatacctaaaatcagtatctttatactaatgatgccttgataccttgaattgtttttcaaatacatgtgacatatgcaatgaattataaatcactgagagggtaaataactgagaggatgagccaataattttttgtcagaaaatgaattcattttctaatattactttttaaaaccttcttagagagttagaaacattacttttcaagttgtatgaaactaaaattattttccatgtttgattccagtttttcttcgtaatggggggaatattttaggataatgaagtttcaggttttctcaagatgctaggccttagtgtattcttccttagataattgggtaaaatactgaagaatagaaagctattagcagcaaccccattactcttaatagtgaaaaaggaaaacaagtagaataaatgctgactttttttctttcaatagctatcaaagtatggtgcaagttggtggattggacttcaagaagaaagagccaatgatgaatttcggtatgaacctagattcatttgcatttaattttgtttgacaggttttatttgcagaatgattagattcaattttagtgatcaatttgttgaatacccttcaaacattaacttataaattttcacttctctaaccaaagacatgagtgttttttaaagaatatgcttatgaaaccatcccgacaatctagccataaacatatccatcacctccaaaagctttctttcctgctctattcatttatttatttattcactaattcattcatttttgtgatgagaactcttaacataaaatctaccctcttagctgggcgcggtggttcacacctgtaatcccagtactttgggaggccaaggagggcggatcgcctgaggtcaggagttcaagaccagcctggccaacatggagaaactctctctctactaaaaatacaaaaattagctgggcgtggtggtgcgcacctgtagacccagctacttgggggggctaaggtaggagaatcacttgaacccgtgaggcagaggctgccgtgagccgagatcgtgccactgtactcagcctgggtgacagagagagactccatctcaaaaaaaatctaccaccttagaaaaattttaagtatatgatacaatattgttaactataggtactatgctacatatgagtatattttttaaatttaatagaatattatatcttcaatccctacctcagaactctaagaatgatgttggagactggacatgcagaatgagagaagaccttaacatttttaatcttcccacagctggagagatggaacaccagtgatataccagaactgggacacaggaagagaaagaactgtgaataatcagagccagagatgtggctttatttcttctataacaggttattttacttacccatttttgggtttataatacaaactgataattttcaggaggcttaaagtcttttccttgcatcatttccatgagaagtttctgtttatttctcttttcagttgacgtgttcagttttgtctgccataaggcttaaggatggccatttttttctgttcaatccatgcattcatgttcttggaaataatttacatctgaataagtccttcctcataaatcaagacagcaccagaaatgggcccaatgaaactttaaagaaatatatgcctgacaaatacttttttctatggtatttcaatggaagcactttttaaaaaaatctattcctatatccaatttataatgggccagaactttaacctctgtgaaatttacttccattttcctatttaataaatgttttgattcaagtcagtattcttttttcttttactacctgtcatcaattgctgcttgctttagaatggcaactgtttgcaagttggatttagaagcacatttaggttgaagattggttttttaaattctcctcatcagtgcagtgtagttaggttgattgtccactcattcctcttctttctaaccaataaaagataatgatacccattactctaacagattcataactaacctgtgccccaggccaggagagggataaacacagaaaataattttgggtgtgagggcctctgcagagagttaggaaaggaaaatccgtgtggttaatcagcctgcttttaccagcaggtgtcacaacagcctacagaaaggactgttttgagcgtctgggagaatagcagctaatctgcattgaaaatagcattccagcccttccttcaaaatgccaacatcttttgggctcatattcctgatctagaaaactgagcctgcccttgcaattggcatgcattctgccctgttctggaatttatgacttggatgccaataaaatgcattctataatccttattctgaaaatatagctcttctaaattaaaaaaaaaaaaaagcagttagtttgtcggaggctaaggatttgaggatatttcttactgaagacatgtctatatgtgagtctggtttacttaaggatcagtattaaatgctgttttcttggaagttcttgagttaatttttctaaattattatattttctaaagaattataaagtagaaattatctactgttttagaatctttttcctctctgtacattgaaattgaacattttaaaatgaaattgttaccctacaaagtattcttttgctacacaagtcaaatattcttaagattttaatcagttctatgattcaaattgcagtatttatttagatttttttaatttgcaaaatttttacattcttaaattaaaattactgagttggccttgcccagttagctgttgtccctagagaaatctaagatcagtagtttagttcagtttctagattttaaaaaataaattatgaaaaaccatagcctcataaaaatagtgatcaatagagaatgccttcaaagaatcgccattgttcctaagccatttctaacccattttctcctccaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataaggtaagcttgtttttcaaaagttgcctttgtttctcttttgtagacactaattttggaaagtgttcaaaaagtgaaagtggcttttgaaagctgtgagttgtccataggacctggaatttttttgtcacaactttcaagaaatttgagttttccatttagtaacaaatcttttggaacaaaagatttttgtcaaaaacagcctggacactgcccctcgtttctatactcagttttactgttggcatagtcatttattgtgctgtatgaatgtttcattaggtgtaacatatgtatgtatatgtatgtatgcatgtgtgtgtgcatatgcatgtgtgtgtgtgctcatgtgcgtgcgtgtgtgtgcacgtgtatgtatgtgcctgcatgcctgtgtgtctaggttctgctcccaaataagctgtaaatttcagaggacccagactccatctcctactcttgtgttttccctgcctggagccggcatagagctctgcccactagtgaattgagggactaataacttagcttggtcaatgtcatcttaagcctcataaagctggtgcttccatgcagatttgaattaagaaaaaaaaaattgccagtggggatattttaaaccagatttattatttctgatgctgccttcaattaaggcctagtctccctccactcttcatattttataataaaataactttataggccttaggtggaagtaattaaaatgcatcccaaattataattgtttaactcttagaaaattaaaaaacccaaactgtgtcatcatttcatatgctaatatgaaattcctcttcaattgtggacagccaatttttaatctaagtgttcagttatattggcagggctttctctcctttgtgatcttcctcccattgttaatttgagaaatgaggccacttggatttttcacacattcattgagtacccaccagacatttggcactgacttttaaatttttttaatatctggtaaatacacacaatatagaattcaccattctagccatttttgtctactgtttactagtgttaagtatcacatactcacactgtcattcaacaaatctccagaccttttccatcttgcaaaactgaaactgtacccattaaacgactccctgttcttcctactctgaaccccttggcaactgctgttctactttctgtgtctttgaaattgactaatttagatacctcatgtaagtggaatcagacagtatttgcctttttgtgactggcttatttcagttagcataatgtcctcaaggttcacccacactggcatgcgacaggacttccttttgacggttggacaatattccattgtatggatatactacattttgtttatccagtcatccattggtggacatttgagttacgtccccccttagctaattgattgtatgtttatttcttatatcactgaattttaaaaatatatagaattactatcctcattttacatatgagaagacagatgctaacaaaattgtgtgacttttctgaaacttcacagtgaatacgcatcaggccaagacgcactttttgttttctgaccctgagtctggtggtcttgcccctttcctatgcctgccacttcacgttggcacttaaggactgccactccagaaatgcaaattaaaacaacaatgagtgatttgccactgcacagctactagaacggcccaaatccagagcactgacaacactacatgctggcaaggaggccgaacaacaggagctctcattcactcctggtgggaatgcagaatggtacggccactgtgggagacagtttggcagtttcttacaaaactaaacatacttttaccatttgatccagcaatcacactccttggtatttacccaaaggagttgaaaacttatgtatatgtaaaaacctgtccatgaatatttataacatctttattcttaattgccaaaacttggaagcaatcaagatgtccctagtaggtgaataaataaactggtacaaccacacaatggaatattactcagtgctaaaaagaaattagctatcaagcctttaaaacacatggaggaaacttaaattcatattactaagtgaaagaagccaatctgaaaagcctacaatactgtatgattccaactatatgacattctggaaaagacaaaactagagagacagtaaaaagatcagtggttgccaggtgttgcagggagggaaggatgaagttgtggaagattcttagggcagtgaaaattctctgtatgatagcacaatggtggatgcatgtcactagacatttgtacaaactcatagaatgtacaacacaaagagtgaaccctaatgtaaactatggactttgggtggttatgatgtgttaatgcaggttcatcgattgtaacagatgtaccattctggggtgatggggcatgtgataatgcgggaggctgtgtatgtgtggatcaggtgggaaatctctgtaccttcctggttttttttgagatggactctcagtctgtcactcaggctgaagtgcagtgacatgatctcccctcactgcaacctttatctcccaggttcaagtgattctcttgcctcagcctcccaggtagctggggttacaggtgcctgccaccacgcctgactaatttttgtatttttagtagaaacggggtttcatcatgccaggctggtctcaaactcctgacctcaggtgatccgcccgccttggtctcccaaagttgtaccttcctcttaactttgctgtgaacctaaaactgctctttaaaaaatgaagtatttaataatttttttttaaaaaaaagggttgccatgtcagcttagccctatgacacagtgagctcagtggcaccatgagatattttctagaatagtataatttactctaaaactttactatagtaatgaggtacactattttttaatcattgatactttctgtatacttcctattttctcaaactataaaatctttctaccaggtataaattattttcacattttagtatgagaaacttgtagctaatattcaataagacactgagtgttactaagtcttttattaaaacctttggcaattagttttttaaagcatctttatggtcctaaataatgtaacataacatttgccattttaaccattattgagtgtacaattcaatggcattaattacatgcacaatgttatacaaccatcatctctatttccaaaacattctcactatcccaaacagaaactctgtaaccattaagcactaacttcctgttccccatcccctggtaacctctaatctattctctatccctgtgaatgtgcctattctagatatttcatattagcgaactcatacaatatttgtccttgtgtctggcctattcgcatgatgttttcaaggttcatttgtgctttagcatataacaaaattgccttccttcttgtggctgaataatattcctgtgtggcacgggcgtgtgtgtgtgtgtgaatattgcatattttgtttattcattcatctgttgatgcgcacttgggttgttttcaccttttgactattgtgaataatgcttcaatgagcattggtgtgtaagtctctgtttgagtccctgttttcaattcttttgaatgtatacctacgaatagaattgctgggtcatatggtaactcagtagttagctttttgaggaactgacaaatgttcttccacagcgaccaaaccattttacaatcctgctagccgtgtgtgagggtttcaatttctccacatctttgccaactctggctattatatagccatcctagaacacgttaggtgttatttcattgtgatttcgatttgcatttctctattatctgatgaagttgagcatcgtttcatgtgcttgttagccatttgtttatcttctttggaaaaatgtctattaaagtcctttgtccatttttaaattggatcatttgcctttttattgttgagttataggaattccttatatattctaaatattaaaccccatccaatatgtgatttataaatattttcagtcattctgtaggttgtcttttaactttcttgataatgtcctttgatgcacaaaagtttttaattttgatgaaacccagttatctactttttcttccgtcacttgtgcttttggtatcatacttaagaattcactgccaaatccaaggtaatgaagatttgcccctgtgtgttcgtctaagagcttcatggttttagcatttatatttaggttgttgatacattttgaattcactccagtatgtgacaattagtttttcacaactgttagaacaagtttatcctggcatggtctctagggaacaggcataaaggaatgcctagctaatctccaaatcacatttctggtacagatagtgaacaacccaaaagcatgaacacaactgtcctagttactaactcatgcctcctctcatgtgtaaaagaggatttttttatatactttaagttctggggtacatgtgtagaacatgcaattttgttacatagatatacacgtgccatggtggtttgctgcacccatcaacccgtcacctacattaggtattgctcctaatgttatccctcccctaggcccccagtccccaacaggccctggtgtgtgatgttcccctccctatgtccatgtgttctcattgttagctcccacttatgagtgagaacatgtggtgtttggttttctgttcctgtgttagtttgctgagaatgatggtttccagcttcatccatgtccctgcaaaggacatgaactcatccttttttatggctgcatagtattccatggtgtttatgtgccacattttctttatccagtctatcattgatggacatttgggttggttccaagtctttgctattgtgaatagtgctgcaataaacaaacatgtgcatgtgtctttatagcagcatgatttataatcctttgggtatatacccagtaatgggattgctgggtcaaatggtatttctagttctagatccttggggaatcaccacactgtgttccacaatggtttaactaatttacactcccaccaacagtgtaaaagtgttcatatttctccacatactctccagcatctgttgtttcctgactttttaatgatcgccattctaactggcctgatgtggtatctcattgtgggtttgatttgcatttctctaatgacaagtgatgatgagtattttttcatatttctgttgactgcataatgtcttcttttgagaagtgtctgttcatctccttggcccactttttgatggggttgtttgtttttttcttgtaaatttgtttaagttctttgtagattctggatattagacctttgtcagatggatagattgcaaaaattttctcccattctgtaggttgcctgtttattctgatgatagtttcttttgctgtgcagaagctctttaatttaattagatcccatttgtctattttggcttttgttgccattgcttttggtgttttaggcatgaagtctttgctcatgcctatgtcctgaatggtattgcccaggttttcttctaggattaaaagaggatattttaaggaaattaatgacaagtcaaatccttagcatttgataaataattcttagaaacctggaatagttgtttctggttcagccttttgctattatccttcccccaaacttgatttttacccacacagttcacctccatcccatgtgtcctcctgtacacacgtagagagtgtgtatctatgggaatggtggcagtgatggtggagcagacccagggcaaaagagcaagtgaatgcttcccatgaaaggaatagagaggggaataaatatgtgcatgagaatggcggggaggggaggcgccttctgaagctagccctggggcatgattaaaacaccctcatgtagctcagagttataaaaaaaaattattgataactaacagctagatcagtagttttcagccctggtcaaatatttagaatcagcaggtgagctttttaaaaacatcaaagtgcaggagacgtcctgaagattctgatttagctgatctgcatgggatccaggcatccgtatttttttaaagctccctcagttattctaatgtgtggccaatatttacccagcaattcaacagtcatagttccacaactctttcttcaaggcattaggagcatttgattacaaaggatatcatcacagcaggcttcataagtaggtggcaattcacctggcacaatgtcagagtcaccatgcatgtctccccacccacagtgccttctcctgcgcattaatgcctaaaattccaccactggagtttctctcctttgtctcaacactttcctttatttttaaaagggaaatatttttgagattgcctcatctgtcatcaacatcttgaaacaagtaagtttatcagattattagaaaaactgttaataggagagttgatagctgagagcggtgggatggtttttccctattaacaaataaagctacagaaggaaaactgggagataacaatgatggaccttctttacttcacaattctgaaatgagttccaatatattatgtcccattaaactttgcttattgtttgtgaatttcctaggactaatttttattggttatttctaaggaaaaaaatcccactttgttggcaaattaagtgggttttaaaactgagatacacagaaattaagcatcttttctaatgtctcataaatagttttctctgtgtttgacaatgtaacagaggtttgaccaggggtttacccaggaagaatgagtcatctaagatacttgtcccagcagatctgtgggaggaagaaattctaagtgtgtgtgtgtgattaactcttgtgcttctacttacatatttttattcaagacctggattgagtggtaatggctgctttgcactgtctagtttgggattagtcaatatttgattttgtgcataacatagttttttcttaaaaatactctcacctctttttggaatttattcaaattggagcacttcattcattcattcatttactatctcgatgtcgggaattcagtggtgaggaaaaacagacacagccccttctcttttggtgcttacacactagagggagaacaaacattagtaaatcgatcaggaaaatggctgtgtaatttaaaactgtgctgtacgtgatgaaggaaagttatgtggttctagaaaagtgtatagccagaggacctgactgaagtggtcagaaaggcagggaacattaaaaatagggggagctgcatgtgctaaggtcctgcagcaaggtgggagtatgacatttaagaaactaaaggaaacatagagaactagagtggccaaaggtgagacaaaagaagtggaaagggtgataccgtgttggacttctggcctctatcctaagagcagtgggaaacccttgatgggtttaaaactaaagaaggacgtgaccaggaccaaattttaaaaagttactctagatgtagtgccaaggatatatggaagaagggcaagggtgagaaaggtaagagcagttaggaagctattgctgtagtgcaggcaagagactggtaggttgggctaagatagtggtggcagagaccatgaggcagtgggaatggggatgggtgagggggctttttgggaaatgagatgtccaaatggtatggctgttggggagatggagtgggaaggtaaggatgcctctgaggtttcaggcttattgtatgtgtataagtgcatgcagaccgtgccattcattgtgagtaggaacactgggaaaggaccaagtttggagggaactgaatttcatttccaaatattgagctagaaatgattttgagacaaaaaagaattttatattgaaaacccatttagaatacagtaggaccccattaattcacagtaataatcagagatgcattaaacttgatcacattttgcaaattagtaagtaaacaattttaaattaaggatgctgtacttcatcttgctgctttgccttaattattaatgacacaatttcggagtgtgttagtaaatatgttatatttttagaaacaatgaagtcgtggtaattgcaggccacacttccgtagtcaagctagtaaatcctggctgaggcaaacatagaggaagcagaggagatgtttttctggagagatttattgagctaactgaaccaatgaggttcattggtatttatgaatggttcattagtgtaactatctgaacacaaggtgaattcacattaaatgataagacttcccaataattaatatgtgccactctttagaatttgtaattagaggaaagaggcaaaatgaaaggaaatagataaaaggatagttgttataaaattaaactccttgaaagccaattcagtttatttgtgaagcaaacaagacaaaaaggaccagaagaattgaaaatgtattttctctcttagttggcaactcaacctcaagctagttcagtgtttctggtttttatcctaagagtagtggaaaattcctgaagggtttaaactaaagggtgacatgatcaggactgagttttaaaaagaattaccttacactattgacatttggggtcagataattctttcttttgaaagactgacctgacctgtgctttgcaaatggttagcagcatctttgtctctacccattagttgccaatagcaatcccctccccaactgtaacagtgaaaaatatctgcaggcattatcaaaatataccctgaggggcaaaattgtcctgttggagaaccactgagctaaatttagaatgactgacaatgtcatttgacaaccattttagggtctgttgtcttttattttgcttaataaatgtttactaggggccttctctggtgtgatgttcaaagaggagtaagacttagtctctctgcttttaaggggtgtatgatggtggggaaggggtggagaactgaaaaatttggaaattaaagaatgatggggaaagatattgtattagaccagtcttgcatttctataaaggaatacctgagactgggtaactgatgaagaaaataggtttattttgacttacagttctgcaggctgtacaagaagcatggtgccggcacctgctactggtgagggcctcagggagcttacaatcatggcagaagataacagggaaccagcatgtcacatggcaagagcaagcacaagagggtgaggtgagaggaggttccagacttttaaacaatcagatctcgcatgaactgagaactcattgatcacctaggggatggtcctaagccttcaagagggatctgccccatgatccaatcacctcccaccaggcctcaccttcaacactgggaattacatttcaacatgagagttggagggaacagacatccaaactatatcagatatcatttcaaaataaggtaggaaaggatgctttttcaagtgtaggtttccacgctaacctagaattatcctgtagtggcgagatcttaggatctgatctatcaatgactagggttatctgtgttcattgatgagagaattgattatgagagaagaatccccagcaagttccagatgaaacatcctttgcataaagtttctcctgacctctctggaattttgcctgatccattataacctttctcttctatcttttcctctcaccaaactccatctgttcctaccaacattcttaaatttcatcgaactttcagggaaaaacaaacaaacttatcttcaaccctgcctgtcctgccaagtatgtatcattccatttctcatcccataagaaagaaacctctgtggcagggcgcagtggctcacacctgtaatcccaactctttgggaggccaaggcagatggatcacaaggtcaagagatcaagaccatcctggccaacatggtgaaaccccatctctactaaaaatacaaaaattagccaggcatggtggtgcgcacctgtagtcccagttactcaggagactgaggtaggagaatcacttgaacccaggaggcagaggttgcagtgagccgagatctgaccactgcactccagcctgggcaacagagcaagactccatctcaaaaaaaatttaaaaagaaaagaaaagaaacctctgccatgatgcagacatgattctctcttgcataacactcaacttttattgccaaattccacaaccttttctgtgttccctctaacattgatggccaaccttccccttcatttctacttcttcccaggtttctttggtcatacccttgctttctgtcccactgggatcatttatttttcttctctggctcttcccaatagacttagtgaccaaatggctgactcaagtatttagtgaatttaaacacctgatgtgtttgactccccattatttctctctcacttaaagtaaggaagtgtgtttgtaaataaaattgaactaagctgttcattgccacccccagaatgtttttgtttttttttttttagattaaatgtgcccatgtaaactttgcaatcagagtggctcctttttaggaagaatactacttttcattgtgctgaaggcactgttctgacatttcacaagacaaaacgcatccctgcttctgttcctgcctgctgcaaatgcaggcaagtcattaactcaccctaaaagctgctcctctttgttttactgtaacacctttggaggaggtgaaagaaaaatgagttctttctgcccaagaaaattataaagaattttcaaagctgatattcagtgtctttgggaaatttttaattcacttagaaagatacagaaatgaatgttttgttttgacattttttgatagtgccttctgctgaatatccccaaagacccaagcagttggaagaactggacgcatgctcaacatttctgtgctgaagaaggggggaccctggtcgccattgaaagtgaggtggagcaaggtagagtactcaagatccaaccaggccaagataaccatttttattcaagtatttattaaaatatcccccccacctatactaacattcccaaatcaacatttaaaatactgtgttgctgatgatacacgagtttgcagtttgacccataggttttatttcatgatatctgtaaaagttagtgtactgcattgcttataaactgctgggttttggagccttgtctctcaccagtagcagtggaaagaataaggacatattcatggcctatatttcaaaatggctaaaaagtatgatctacatgtaattgcatggtatgatttttagatccctttacatttacctacatgcttttatttgatatttaatcaattatatacttcagtttaaatatagcagataaatcctcttttgtttagaaaggtaattaatgaacactggaaattgttttgttaatgatatgatgaaatctcaggttatccagctaatttctgtcaatttaaactaaaacaaaagtgaaagaaactgcattaccttaacaaggataaagtaacaaattcctataaatgattcataattatgttttgctggcatttaaatataatcatagctataaataggatgcagtgattacccaaatgctttctacagtattaaattagataatgtattcctgtttttcagctttcattactatgaatctttttggccagaccaccagtgtgtggataggtttacaaaatgatgattatgaaacatggctaaatggaaagcctgtggtatattctaactggtctccatttgatataataaatgtaagttttaagatttattttttggagatcactttggcaagatattttattcaagatttgtttactaaagctttttttatttcctatattttgtaggtataaatttatattagttttttattaatatattaatttttaatgtaattttatgtgttccattaatataattactttactcatcacaataattgtttattttgtaggttatgaaatgacttgtgaataagtttattaaatgcgaataaaggaataatggtgtcttaattttaaaaataatgtcttaataaaaattttaatgttataataatgctatatgttatcatacttttgataacgtgtattattttaaagattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaaggtaagaaatatttgggtttttattcctttcatttccaaagtccatccttctctttcatgttggttttacacagctgtgtagctaatgtagctaacagtttcctggctaacagtgtcaggcacttcttctttggctttacataagtttagttatttaatctcctctaccctaggcttatgccctttagtgggattctaaggactgccgaggccacttgagtgatgaccaaatttatgtatctatcttagtcatattaaatggctttactgcttcattctgggattatgtatctgttcaggtgatttttaaaggtcactgagaaaatgttgggaaagaatcaaggaaataaaccaactcatatttgctccttttttggaaccctgaaaatggtctctgtggctaaatgtggcatgcagcaatcttctagatctgatgggcagaacccccaaatggtttctgtgtgaaatgccaaagccacactattacaaatagccaacagggtcaatgaatagtgtgaatgcactataactgaccttgagtactataaataaaaacaacaacagctcatgcttttactgaatgctgggtatccctgtccacaccacccaagaaagccatagttggtgtctagagctgtatggaactctgggcagcctagcatatatttatatatatatatatatatacttatttggaataggaattttacttcttaatgtggcatacgtgtgaagtctctaatgttactatcaactcatcctcaaaaaagcagtgccagagaagctccatttctggttctcagttaccacttaaacattatagtggtcaggaactgaaaaaatgatactagatctgtaacagcaagagtaatatgggaacagcagagccttgtagggaaagaaataatatgagcatgccaggtacttacacacttatgagtacctgaccctgtgccttgagtgtatgcgcggtatgccacaaaatcctcaagacagttctatgaagtaggtaaaagtctcccattttacagatgaggaacttgaggcttaaaaacataagtcatccttgctaggcacggtggctcacgccagtaatcctagcctttgggggaccaaggcgggtggattgactgagctcaggagttcaagaccagcctgagcaacatggtgaaaccccgtctctactaaaatacaaaaaattagccgggcgtggtggcaggtgcctgtagtcctagttactagggaggctgaggcatgagaatcgcttgaacccgggaggcggaggttgcagtgagccgagatcgcaccactgcattccagcctgggctacagagtgagactctgtctccaggaaaacaaaacaaaacaaaacaaaaataacacactcaaggtgtctcagttaaacacaatgattctattccactaccttgatgttgatttattcttggaatgtgccctctgatcactttctctctttggtatttttgggactaacagtgtagattttcctttagagatagtacagaatagtggtgattgagagcataggcaccggagtgcctaccacacatgggttcccacccttctttgtagataagcttcagtcaaggttacttatcttctgtgatcatgatttctgcatctgcaaaatgtggtaatagccatctcacacactttatgtatgtataacacttagcatacttctagcatatatttaacaaacgatatagttttttctattatttccagaaagtattgttcaactacactagttattgtagccaacaataaatattcaagttctgctcctcttctctgtttgtcagatacatatgtgcttacattgggcttgagcccaaagtcttttatctgccaaaaaaattaagaaactgaataagaagagacacaagggcaaagcaagactccccagtttagaacttggtttccaatagatctttctttttcagggcaatgggtggcaaaaccatgctgctcaaaatcacttgttttgaaacttaatggaatcaattacatatggagaaatttatatatgtaaaaatacagacatataactcagtggggaaaaaacagtcaaattggcatttgggtaacatatacaaagaatgtcatttaatgttatgaattgttagcattttaaaatagctactttgatattattttgattttgtatgaataaccattacactgggcacgtaggctgggcacagactaatagcaaagaataaaaatatgataaaagtgtgatccatcacaatttacagaaattaaagagattcattttactttggtttttccatatgtacagctgctgtattgaggtaatggtttcagataaaggtcagtttcccactttgccatttttactggggggagtatgaccggaggaggagagtggagcaagaagcaacattcataggatgctttctgtgtctccatacaatagtgtgtgccttgtgtggatatctcgttcaattccatccacacccctccaagggagaccctcatcatctcttgtagaccataaatttgaggtttagaaaggttaatttgcccaagagctcttagccagttagggccaggaataggattaagtcccagcctcatgacctatccacacctcacatgcttctttccaacaccaaatgtagtaaaaccagtacacagaaattcaagtcactttggatcagaaggtacaaaaactcttaccttgtttttgtcctttaggttttctaaacctttagtctatcctagtacataacatacagaacatatgttctatacatatcctaacatatgttctatacatatcctagtacatatagaacatatgttctatgtaaacagaaaggcaaatgcacatattagagaggaaacacgtgttcataaacacaggcttggttttcacatgatcacagccactcacagactctcaagcaccaatgcttgacaacgtgtgggaaaaccttgccttttaatttataaactttgactctgacaggtgacatattaatagtaactgtttataagaacagtgtgtatttctaagaatttattaactttattttttaaaattccttttagaatttatacatgcaaacattaagcataatagtgactatcagtctcaaaagtgtaatcgagtattttacctgataatatgcacctgtaatattaggtttgcaatgcaatatatgactatgtaacatgtgcctttctgctattaataagcattaagttctgccacagcagtgtggattaagccaagtgtagttagtggagtgaaacccacctaagaagatcaccatcagttccaccaaaaagcagtcaatttgataaaggatggtcaaaactgggaaatcttctagaaatggttcaatctatgtttatgtttttgaaaaacaattcattaaatttcctgagtgttctcattttttcgcatcacttacactttcagatagtgttcttgttttgaaacagtcaattccagaagaaagcactctgatcaacatggatcatagtgacaaggatctatgctaagctttgcctcttcctttgtcatccagatgctgcaaatgacttttgttgctgttcttgttctagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagatgtaggtatcctaactcccttgagacatccttgaataattaagtttagcatctacctccttcatgatctggccactgaaattagcactgaaaaaaagatcccaaaaataataataaatataacacttaaataattggtttatgcaattacctgaccaaccttatgaacagcctatgactacaaaataagagtgcacacctctttagggtaaacatccacttgcctaatgtctggaaattaataccattcaaaggttctctgaaaatttccaagtaccccgatactgccttgcatgtgcactggaacacagctgaaactcaagcactgcatttgggaatttgcggcatttaatgaatccccaagaaaaaacgaatcatgcttcttgtctagaaatgtgattattaattagtttagtaccccttataattaagcacttgaggttttattttcctctagggatgtggtttagagaatacgttattttcatttttttaaataaaatattgtacactcaaagtagtgaaaagtaaactagtctatcctgacccctagttctactccctaatgttagtaattgtgaacactgtcttgtgtgccatctagaaattttccatgtatacacatacatattcatgtaatggaagaatatgtacattgtttttcaagcacaaatgagatcctattctacatgctgtctttaaacttgctttttaatttaatatatctttaacaacttcacatgtcagcacataaaaatctcatgaattctttagaacgcagcatgtaaggatataccacaacttattaaaccattctcctgtgaatagacatttgggttcttctcagtttttcacagttataaacaatgcacaacaaatatccttgtgccagtaggataattttttagaagtaaaattgctgcgtacacttaaaattttgacaagtactaccaaattgccctccaagagtttgcaccaatttacatgccaacaacagtatgtgataatgtctagttttttcacatccttgtcaacaccaggtattctcaaaattttaatccttgccagtgggagagataaatgaatgatatttcatgattatttattgcatcatgtagtacagaatgttttaacttcatgtagtcagttttgctttatagcctctggattttctatgacttggaaaggttttccccacaccaacagtataaaaaaatttaaccaggttttctttaacatgtttatgttttcaattttatgtttgaataattgatcaatctgaaatgtatttcactgtaaaagacaaggtactggtccaatttcacgccgattgctcactagaaaatcattgtggcagggagccaagaattcctaaaaatcaaaaaagatctcatttgtggcagatattcctgtttgtcaagctgtattcacagatgtcctagcccctctttaaaaaggtgtgcagaaatagcaatcgatgtgggaattgtagcatgctcagataacactgggtgatgctgccagccgtcgtggcaaggaaatgatggctcagttttcctccacagaatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctggtaggttcaattctattcaactcaaaaatataccttatttaactactgtatgcaagacactgtgctaagcaaaggatatgaagatgagtatagtaagaactctctcttcaagaagcctctggtctggttggtgatgtaaagaataacagaactacaaaatgatataagagaggtagcaaatgttatgggggttatcaagaaaaagaatgcattgtattcatttggagaaaggtagaaaggcttcttgaaggacatggcagtgcagatgggccttgataaataggtgggtgtagatgggtaataatgggacatggaaaggcattctgaggagaaaagctggatgaaaatggggaaggaagacaggacgaggcttacgtaagacaaagccgatgttgggatttgcctgaatgcaggttaggcgtaagggagaggtgggaaattagatgagaaacatgggcttcaagcatgtgtggaggactttgaggattcatgtttaaataaaagattgataggattccagagctacaataatgatgatggtgatattgtttggatatttactagatatctggctctgcactttacataatatctcatttacacttaaagttcacctggcctaacccctttattaaaaatgaaatgtaaactcagagcattaaatagtttcctaagtgtctcacagctgtccatcaccagtaccaagagtagaaatcaagtttcctgcatagaattcactaacacaagctggcctccttttaaatctctcatttagtaaaagtgcatgtatttacttacattctgggtactgtatcaaataacatacaaattatatatttttagatcaaaacaattcaggattaaatgtaaatgatagccacatatatcttggaaaagctaattctacttctaaaactccataaaagctgtccttcccttttctccttttttttttttttttttttgttagcacttgccttttcttggaatcttgtcctttcaataacaatgcatttattgaatgcttaagaagtgtcaggctctaactcattgaaacttctcaacttgtaaggaaggtggctgtgtggctcacaccagtaatcccagcactttgggaggcagaagcaggaggacctcttcaggccaggagtttgagaccagcttggttaacacagtgagactcgttaaaaaaaaaaaaaaattcaattatctgggcttggtggtacgtgcctatagtcctagctacttgggaggctgaggctggaggatcacttgagcccaggagtttgaggctgcagtgagctgtgattgtgccactgcacttcagcctaggtgacagagtgagactttgtcttttaaaaagttttttgtaattaaaaaaaatatttttaaaggttttgttgttagctctcttttatagataaagaaaccaagtgcaaggtaacatgcccatggtcacgcagctagtaagtggtggagccgggatctcagcatggatgtgtctaactctcatgcttgctctctgaaataaagtccctctggagttcccttatttattttatgttatgctatgttatgatactttattgaatgcattattttctttcacaggtttattagtgggtaaggacttttcaaatctgtgatacacagcactgcatgaaatgcatacatttggaaatctcttttaccagcatcagtcagctgccactctctctgggagtcatagcccctgcttgttccaacctttaggatgctaattgtaaacatgaaagagccaccctcacccaggcagcacccaaactaagcctacaaagctgtgccttaacatatcttgttatgtttaggtaaagattatttctgtcagaaatgctataaactggtcctagttttataatcatttacatgaaacccaatctttcagagtattaccatgaaaatcttgttacatatatttatcttgatcttttatagaatgtaatgtaatatttatctcaataaataaacccagtcaccaccctgaaatcataactggcttttcttcacagaaacaagacaatctgaacacccagagttgtgctcagaaacatctattccctggataaaatttaaaagtaattgctacagtttttctacagtcctagacagtatgagttttgaggctgctcatgaattttgcaaaaaggaaggtaattgtttttgtgatggtaaaaatgctttcatgtgctccttcttgccatttcagtaaacaatgtggatttctttattcatcccattatttagtgactttaggagcaacaaaaactaaactattgaaaaaataaatactattgaaattgcttgtttggaggacagctactatatgaaacaatgtccagtgtagaatttggaaacctaagatgatgtctcagcatactgcactttctgaagaaaacgttccttttgcatgcatttgcattatgaattttgaatgttccctaaaattaatattctatgccttaacttctgacgtgcaagcttgtatcttttaaaaaatgtggttttacttttttaatttaaagtctcttctttataatggaaattttcacttttcaaaacctgagctttacaattaatagtataggaaacattttttaaagtatatttatgtgtaaacacaaatattcctttgctacttgtctctcttataggttctaatcttttaacaatcaaggatgaggctgaaaatgcatttctcctagaagagctgtttgcttttggttcttctgtccagatggtttggttgaatgctcaatttgatggtaacagtaagtgatttgggtagaggagaggacataaataaatacatggttgttaaagctgatgataatggcatctgtgagccagaaaactctccttggatacgttttctgagaaaaaatagcatgaagcctaaagccatttcttccaaaaacaacattgcaacccttttctttacccttttgtcttttaaaataatcccagaacaccaaaaataaaaacaaacaataacatgtttatctttacccttagcaggaagatgcttggctggaactttgtgttcacagacttagtcattgcataccaaaaccatatttactggaaaatatcccaggtttctaaatgttataaaagcacaatagagttatggaaatgtttccatgatgaactgtgctgttaggattcttatttgctactcataaaaaccagagtttgtaataaaatggaagcatggtattcttttctttatgtaattgatggttattgaaaggtacttgtgaagaaaattattttaattggtatggagagcttgttacagtggtgtaccaaggttgggggtgagcctaccctttcgaggaggagtattttaatcaccaacattgtttagaatttcaagcagatggtgataataaaaagcagaccaacttttagttagctgtattgttagttttaaattattttcagacaatacactattgcccacacatgggatggactctcctaccgcccctacccccttggtacatggctggcttggtattaaagaaattcactgtaaaatctttttagaaagtgagccattttgtaatgatgaagatgttaggacttcaaaggatttttctttactcgattagttttgtttatcaaatgatttctttaaatcgattatatatatatatggaatatttcaaaattcaaactgtcacattaagaaacatgataacctaaatgacctaaataagaacactgtacctaaaataaagaggcaactttattaatgcctaccttttgatgttgagtacatcactgtatttactgagttgaatgtattagttcaagagtctcattaaattcaggggctgccatcccattactgggtatatacccaaaggactataaatcatgctgctataaagacacatacacacgtatgtttattgcggcactattcacaatagcaaagacttggaaccaacccaaatgtccaacaatgatagactggattaagaaaatgtggcacatatataccatggaatactatgcagccataaaaaaatgatgagttcatgtcctttgtagggacatggataaaattgcaaatcatcattctcagtaattatcgcaagaacaaaaaaccaaacactgcatattctcactcataggtgggaattgaacaatgagaacacatggacacaggaaggggaacatcacactctggggactgttgtggggtggggggaggagggagggatagcattgggagatatacctaatgctggatgacgagttagtgggtgcagcgcaccagcatgtcacatgtatacatatgtaactaacctgcacattgtgcacatgtaccctaaaacttaaagtataataataaaaaaataaaaataaaaataaaaaaataaaaaaattcaggggctgctttttatggttaattccagtcttagtatgtttgataaccatgcacataattcataatgagtcagcaattttctcacagatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcaggtaggtaaagtcagagagtaattcttcattttgattctaccttaactaatgttgactgacttctttagcatttaaaggttttaaaatccaagttgagagagtattcagatagattctgacattattgttgtgttctgcaccaaacaagtcagagaatagttcagctccttctttctctgatatgagaaaaaaaatcattataagtcaactcaaagactatgatttttcttgtgtcacccaggttgatcacctaatgggcaaaaaatcattttccctcaagcaaatagaactaggaatgtaaaccagcaaccttcattctggtgactgctactcagaatttttaaggtttatgtttggcctcaggaaatataatctaggcttatgtatatttgctgtagacaagaagatgtgattccctgttgcaagcataatgtgtcataaaagtcacattttaacttaatcatcagtaacatacttagtgtttagtaattaaaaaaaacaataattttagaaatctaagctagaaaattctagtcactgatggtgggaaaatg

SEQ ID NO: 16320 - DNA, 103447 bp, Human
  misc_feature (1)...(103447): n = A,T,C or G
tcagccattcttctctccctgaataggaacctgagttttgcctcccaccctctaacttgggcttggagctgctcatcccactcctgccctggtcattataccctaacccttgccaatcctggcttagtaccagtttgcttcctcctctgaaggaatttctgcatttttgtcagccctagtcacttgatttacgactccaagagaaggaaaaaggtggggagtagggaaataggaaaaggaactactagagacgacaaaaattaaaacttccatctgcctcacatattttgcctagtctagaactggttagtggcataggttttaaatttcatgtactcagaatttcttcaaaaagcttctctaactgtagcttctctgttttggctgtaggaccctctctcaaacaatgccccaccagattgaggccagcataccctggagtagccagttctgcaggatcctgggtgtcagccaagctcaaatgccaaagtaaatagaggagggagggggcacaggatgaagagaccaaagaaaggggcatttcccagtctagacaggagcgctgctttttttaaaagctgtgtttttaaaactctgctcattcaaaactgtaaattcttaagaagtaagttttcctttcactagtggctatctcacttttttgttggtttgttttgctatatttacagcacgggataggttggttttatttttccattgcacacaatagcatttaatatttagcatttcatcagtaagatagttataaaacccatagttccaaaagaaatgtaatgcttcattgtatgttagatgagtacgtagaagcctttaatcataagtttattcagcattttagatacttttgaaattattttttatagaataatttcatcataagtagcaatatctcagatttatttaacatataatttaagagagggcagtgtttcaaagtggaaaacaaactagactaagaatcagaagttctaaattctagaccttttaataactgttgaagtttaggtaaagcctcagacttctcatctgtaaaatgcaggagctgaaaaaggagactgcttaattcagtttttatccagctcagtaactttatatgccaagagtgtagtgcagtaaaaaaaagaaatgcacttggattcaaaagactcacattttaatctaagcgctgcttctaactttacttgtgacattgagcatttaccttctcctgtttccctcatctgtaataaaaaggaaatggaacagatgttgtctaaggacatttccagctctaaaattttatatcaaagaaaaatgtctgtggtgcacatgctgtcttccgtttgcatgtaaaatgtgatgttttgctctaagcaacctaagagaaatacatgtatttgtaaagcatttcccgagtttgctggaacacacttttatcccacgaacagtgaaccttaagttctcaaggcagaaaagctgtcttaagagccttgtttgcttcacctctcttctgagtacctaagctcaggctctgcaattgagcttaaaccttattactacaaagcttcttccaagtgacttctgtaggccataaagacaactataatcaaatttggtttttacctcctgtttataaacatgcttcttaggtcaaaaagcgacttcttaaaggttaaaaagccacttatcaaataaactgaacttttaaattttcttacataaaatgcttaatccaaaagtatttttgtgtttacaattcctggggtttttgttgttgttgttgttgttaaaatgccttaactattcacataaagtatcttgcttcaaaaggaagtcagagctacagtcacgagtggtttacagaatattttctgatagtctttgcttcatttcagtatcgtgccatgattggctgttgctagctacaaataaggaagtcttcaagttgggggatttctcagtggaagttcccacttcaacataagggagagctctggacagtttgagcagcattgttagagcctgtggaaaacactttacaactgtgtaactgtcttcatctttacagaggaatagtctacaaaggaagacttgtaacctggagaagaggtaatctaatttcaatagttcctactgattcttaacctaggaaaggggcctggatgtcttaaactgaagtgttgcagatgtgttaccctcttactcttgctatgtgagtaatttatgacatgattcaataatgcctttgtagttaacgtcatagttagaaatttggcctttaaaaaatggctggacgtggtgggtcatgcctataatcctagcactttgggaggccaaggtaagaggatcacttgagcccaggagtttgaggccagcctgggcaacatagtgagaccccatctctatttaataaataaataagtaaataatggggtccctagccaagaccaaggaaaattttaaattttttttaattttctttctaacttttaagatagaatttatgtctctacctcaatgatttttttaagtttatatctggaatgagagccttctccaatgaatgatttttataacataatgttgacattatgctgaaagatatttggcttaagttgttcataacttactaggctgaaaagtaaattaaagtaaaaatgtattcatacttttttggttatatttttaaaaatcgatcctggcctgatccagtgtgtctatacaaacattaactcaaggctgggcatggtggctcactcctgtaatcccagcactttgggaggctgaggccggcagatcacctgagatcagtagttggagaccagcctgaccaacatgatgaaaccccgtctctactaaaaatacaaaaattagccgggcatggtggtacatgtctgtaatcccagctacttaggaggctgaggcaggagaatcacttgaacccaggaggcagaggttgcaatgagccaagacagcactattgcctaggcaacaagagcaaaactccgtctcaaaaaaaaaataataataatgattaactcaagtttagtatttttctcatctcataaaaagcacatgatagtgaatatttcattacactaaagtgttaatcttatagacaatgctgcatctccttggaccatttaaacttacacagttatagtaaactagtcttattctattatcaattagccctcatattttcacaaccaaaaatgaacattaaataccatgtaatatttcattaagttattttcttaagaataatcataggaaaaatgacagctcaaaaagattaaaagtcaagaattattatcactattgttacattattataatagctgtcatattcaagcttgtaagtggcagaaccagggcttaaacataaattcatatcacctctttatccagggctttctgttactactgccctgcattcttataatgttaaaataatatttgagagatgtcatatcccaaaagatggagattcttatgatagaaaaaggaagatgacttggccatgttcacgcagcaaccaagtcatttttagaagctaggtctttcttctcactcacccactcccatctcttcactccctccaggatacacttccacatgcatacaggtgggcacactagtgtgcctccaagcagttagcttcagagccggaagaagatgtggggttgtatacccagtctaacctgccttcaggttctgcccagcagccaactggggacctagagcaatgtctagttacttcttttaaacacttatgacattgagtcatagagataactaactagatgattaaaaataaataaagctcccctgaaaaagttctgattagaatttcatgaaacttatgcactaatttgaggaaagtgatcatccttatagcatagaaacttcctgcctgaatattctattaatatgtctttaatgtattaaggcctcagtagacatagaagttctttatttatcattaaatgtattccaatatattttgttttgtcttcttgtgtgtgtagtaaaggtacttgatagggatattctttccactatattttctaactaattattgctggcttcttaatttcacaaatttatctttcatctagcaattttattgatccctcattttttctaaattactttaggtaattaacatgtgatgcctagacagaaaaaaatacaattatgtattatccctttttttcctcaccacattggccagaatttctggaacagtgtttaataacagagaagagagcagtcaaccttgtcttgtttctgatctcagtgggaatttccctagtggttaacattaagaatgaggttggctgttggtttgagataagtacatttatcataaaaaccaaataattgccaagtaccttgtttactagaggcttatttaaataaaaacaaaatagagacttcatgttaaactgtactcaatgtctttttgatatcattagagacaactgtatggtttttctacttcaaactgtgtagtggtctgctgttacacaagagagtcattgcatttttaaaaagtccatgtcatcaaatattgtgatatgaaaatgattgctttggtaataaaggtagatttatagttatgagctatgatttattgttgctccaattaaaataataaattggtagttcaaaataaaccaaccaaacctacacgtttcctctttttctctccaatccacatgcttagacacctcttctctattattttggcttcataattctgttcccaactcaaactaacagaaaaagaatgaaaacaatgtgacataagccaagtaaccctatccaggcatagcagccaaataaacaaagcagctattcctacgctttgtgcaaaaagccttcttcctattatgacagtgctagctgcagaccgcaatttagttacaactgtggtaagcaaaatgtgtgtccaaattgattaatcttatatccaacttatattaagaaaatgtatgctaaagagaaatgtttgaaatttgctaagaatttttaatattcatattcaaaactagaaggttagtatttttgtttttatattcataagtctgtaaaaattagtctatatttttattttctagaacatatcactgataggtttcagttttaaaatgagactagcttaataaagtaaaatgataaaaataccaaaatgttccaagttctaaagaaaattcaataggagttatctgttccttgaaatgtttaaagaagaatccataatactgttgggccttggcatccccttttgaaaataattctttaaatgcttacaatgtcttccattgttattgatctatttggggtttatgctatttttcatgcagcttagtttacttgcttttgcttagaaattactctttttaaaaatttttcaaatatattggcatacatggtattcccttgaactttttaaaatcatctccataactatgtggataaccctttttcatgatgcattttgtccatttgtcttttctttttttttctgattggatgtcacagaactaatttcttggatctatttcttctatagttagctctttgtaaaattgtttttgctttatctttgttaatattttctcaatgccttttttagactattttagttttctaagtttgtgagttgaattattagttcatgtattgttattctttcttcttttataatgaaaatatttaaggctaggagttttttagtactattttaacatcttacaacttctgatacattgctttcacatttcactgtcttaaagtttttaattgaagttttatttcctctttgatcagatttatttaggatagtaagggtttttttttaatgaatagtctgtcttttttaaaaccattttagatttagagaaaaattcagcgaacactgcagagaattcacatataccacccttcctacccccaccactcacagcatcccctattattaacaacttgcattagtatggcacatttgtaacaatttatgaaccaatatgggtacattattattaactcaagtccatagtttattcgggttttcttattttttccctttttaaaattgaggtgaaattcatataacacaaaactaatcattttaaaatgaacaattcagtggcattcagtacactgacaatgttgtgtaagcaccacctctatctagtttcaaaacatttttaccacctcaaaaggaaacagtgtactattaagcagttgttctgcatttctgactcccctcagcccctggcaaccacaaatccgcattctgtctctggatgcatatattctgaatgtttcatataagtgaaaccagacagtgtgactttcttttttattattattttactttaagttctgggatacaagtgcagaacatgtaggtttgttacatacatatacgtgtgccatggtgttttgttgcacctatcaacctgtcatctaggttttaagtgctgcatgcattagctatttatccctccttcctcttgcccctcaaccctgactggccccaatgtatgttgttcccctccctgtgtccatgtgttctcattgttcaactcacgcttatgagttagaacatgcgatgtttggttttctgttcctgtgttagtttgctgaggatgatggcttccagcttcatccatgacactgcaaaggacatgatctcattcttttttatggctgcatagtattccaggtgtataagtacacattttctttatcctgtctatcactgatgggcatttggattggttccatgtctttgctattgtaaatagtgctgcacgaaacatatgtgtgcatgtgtctttatagtataatgatgtatattcctttgggtatatacccattaataggattgctgggtcaaatggtatttctggttctagatccttgaggaattgccacactgtcttccacaatagttgaacgaatttacatttccaccaacagtgtaaaagcattcctatttctccaaagcctcgtcagcatctattgcttcttgtttgtaataatcacctttctgactggcatgagatggtatctcattgtgggtttgatttgcatttctctaatgatcaatgatgttgagcttttttccatatgtttgttggctgcataaatgtcttcttttgagaagtgtctattcatatcctgtgcccactctttgatggggttgtttttttcttgtaaatttgtttaagttccttgtagattctggatattagacctttttcagatgggtagattgcaaaaattttctcccattctgtaggctgatgctcactctaatgataatttcttttgctgtgcagaaactctagtttaattagatctgatttgtcaattttggcttttgttgcattgcttttggcattttcgtcatgaaatctttgcccatgcctatgtcctgaatggtcttacctaggttttcttccaaggattttatggttttaggtcttatgtttaagtctttaatccatcttgagttaatttttgtataaggtgtaaggaaggggtgcagtttcagttttctgcatatggctagccacttttcccgacaccatttattaaatggggaatcctttccccattgcttgtttttgtcccatttgtcaaagatcagatggttgtagatgtgtggtgttatttctgaggtctctgttctgctccattggtctatatgtctgttttggtaccagtaccatgctcttttggttactgtagccttatagtatattttgaagtcaggtagcgtgatgcctccaggttgttctttttgcttaggattgtcttggctatatggactcttttggggtttccatatgaaatataaagtagttttttttctaattctgtgaaaaatgtcagtggtagtttgatggaaatagcattgagtctataaattactttaggcggtatggccattttcatgatgttgattcttcctatccatgagcatggaatgtttttccatttgtttggatcctctcttatttccttgagcagtagtttatagttctctgaagaggtccttcacatccctagttaactgtattcctaggtattttattctctttgtagcaattgtgaatgagacttcattcatgctttggctctctgcttgtctattattggtgtataggaatgcttgtgatttttgcacactgattttgtatcctgagactttgctgaagttgcttattagcttaaggaggtttggggctgagattatggggttttctaaatatagactcatatcatctgcaaacagagacaatttgacttcttctcttcctatctgaatacgctttatttctttctcttgcctgattgccctggccagaacttccaatactatgttgaataggagtggtgagagagggcatccttgtcttgtgatggttttcaaaggaaatgcttacagcttttgcccatttagtatgatattagctgtcataaatagctctttttattttgagatatgttccatcaatgcctagtttattgagagattttaacatgaagggatgttgaattttattgaaggcctattctgcttctattgagataaccatgtggtttttgtcattggttctgtttatgtgatggattatgtttattgatttgtgtatgttgaaccaaccttgcgtcccagggatgaagctgacttgatcttggtggataagctttttgatgtgcttttggattcggtttgccagtactttattgaggatttttgcattgatgttcatcacagatattggcctgaagtttctttttttgttgtgtctctgccaggttttggtatcaggatgatgctggcctcataaaatgagttagggaggagtccctccttttcaattgtttgaatagtttcagaaggaatggtacaagctcctctttgtacctctggtagaattcatccatgaatccatctggtcctgggcttttgttggttggtagggtattaattactgccccaatttcagaacttgttattggtctattcaagtatcacttctttctggtttagtcttgggagggtgtatgtgtccaggaatttaaccatttcttctagattttctagcttatttgcatagaggtgtttatagtatttgctgatagtagtttgtatttctgtgaggtcagaggtgatattccctttatcatttttattgtgtctatttgagtcttctctcgtttcttttttattagtctaggtagtcatctattttgtaaactttttcaaaaaaacagctcctggattcattgagtttttgaagggttttttggtgtctctatctccttcagttctgttctgaacttagttatttcttgtcttctgctaggttttggatttgtttgctcttgcttctctagctcttttaattgtgatgttaggttgtcaatttcagttctagctttctgatgtgggcatttagtgctataaacttccctcttaacactgctttagctgtgtcccagagattctggtacatcatctcgttttcattagtttcaaagaacttcttgatttctgccttaatttcattatttacctaggagtcattcaggagcacattgttcaatttccatgtagttgtgtcattttgagtgagtttcttaatcctgatttctaatttgattgcactctggtctgagagactgttataatttcagttcttttgcatttgctgaggagtgttttacttccaattatgtggtctattttagagtaagtgccatgtggtactaagaagaatgtatattctgttgatttggggtggacagttttgtagatttctattaggtccacttgatccagagctgagttcaaatcctgaatatccttgttaattttctatctcgttgatctgtctaatattgacagtagggtgttaaagtctcccactattattgtgtgggagtctaagtcactttgtaggtctctaagaacttgctttatgaatctgggtgctcctgtattgggtgcatatatatttaggatggttagctcttcttgttgcattgatccctttaccattatgtaatgctcttctttgtcttttttgatctttgttggtttaatgtctgttttgttaaagactaggagactaggactgcaacccctgctttttttttttttttttttttttttgctttccatttgcttggtaaatgttcctccatccctttattttgagcctatgtgtgtctttgcatgtgagataggtctcccaaatacagcacactgatgagtcttgactctttatccaatttgccagtctgtgtcttttagttggggcatttagcccatttacatttaaggttaataatgttatatgtgaatttgatcctgtcatcgtgatgctatctggttattttgcacactagttgatgcagttttttcatagtgtcattggtctttgttgatgttgatattttggtgtgtttttgcagtggctggtaccagtttttcctttccatagttagtgcttccttcaggaactcttgcaagacaggccaggtagtgatgaaatccctcagcatttggttgtctggaaaggattttatttctccttctcttatgtagtttggctggatatgaaattttgggttgaaaattattttctttaaaatattggcccccactctcttctggcttgtagagtttctgctgagaggttcactgttagtctgatgggcttccctttgtagtttacctggccttactccccagctgcccttaacattttttccttcatttcaaccttggagaatctgatgattatgtgtcttgggtttgatcttctagtggagtatcttagtggtgttctctgtatttcctgaatttgaatgttggcctgtcttgctaggttggggaagttctcctggataatatcctgaagtgtgttttccaacttggttccattctccctgtctttttcaggtactccaatcaatcgtaggttaggtctttttacatagtcccatatttctcagaggtgttgttcattccttttcattctttgttctctaatcttgtcttcatgcctgatttcagcaagatgatcttcaaactctgatatactttattctgcttggtcaattcggctattgatacttgtgtatgcttcacgaagttctcgtgctgtgtttttcagctccatcaggtaatttttgttcctctctaaactggttattccatttagtagctcctatagccttttatcaagcttcttagcttctttgcattgggttagaacatgctcctttagctcagtggagtttattacccaccttctgaagcctacttctgtcaatttgtccatctcatcctccattcagttctgcatccttgctggaaaggcattgtgatcatttggagaagagacactctgaccttttgggttttcagagtttttttgttctttctcatcttcacaagtttgtctagttttgatctttgaggttgctgacccttggatggggtttttgtggggaatttttttgttgatgctgttgttgttgctgtctgtttgtttgtttttctttcaaaggtcaggtctctcttctgtaggactgctgaggtttgctagggattcactacaggccttattcatctggtgtttgctcttgcacctggagacatcactcaaggaggctggagaacagaaaagatggatgcctgctccttcctctgggatctctgaccttgaggggcaccaaccagatggcagtaggaatgctcctatatagggtgtctgatgacccctgttggagggtctcacccagttgggtggcatggggagcaagacttgtttaatgaaacactttgactatcccttggtggagggggtgtgctttgctggggggaacccactcatctgggctgcctagattcctcagaactagcagaaggaaagactaagtctgctggtccatggagaccgcagcacccctccccctaggggctcagccccagggggatcagagttctgtccctgagtccctggctggagttgttggagttcctgcagggaggccccgcccaataaggagggatgagtcagggtcaggcttgaagagggtctggccgcagtttgccacagctggtgtgttggggtgggggtgtgggagttactgcttgggaccaagccatccagcctccctggctccagcagggaaaaagcgcagcctggagctatagagatggctgttcccttcccccaccctgggaacttagtgtgttaggtggctatcagtcccagtgttggctaccatctctccccccaaggagctcaaacagcttggacagcagagagctgcagctgtggtgctgactgcccctgcccctgggaacttagcaggcttaagcagattctagctgagtggctgttgagaatcagtgcaactccgtgcttgggaggctaggccctggtggtgtgggctcactagtgggatcttctgacctgtgggttgcacagttccatgaaaaaagcatggtttcccaggctgggtagcacactcactcactgcctcccttggctgtgggctgggggcttccctgccccatgtggctctcaggtgggccaccgcaccataatggtcttccttcctctccgagggtcacgccagctgcctggtcagttctgatgacagaacctggatacctccgttgccagtgaaggatttgcgtgctgttatagtcctttttgatgggagcctccaatcgctgctccttctagtcggccatcatgtcctcacctgtgactttcttaaactgtctttttttacttagcacaatggttttgagtttcatccatgttgtagcatgtatcagtacttcatttctttttgtggctgaataatattctattatatgtatataccactaattatttatccattcgtctgttgatggatagggtatttggtctgtcttcacttttggactattgtaaatcatgctgttatgaacatgtatttacatgtatttgtttcagtacctgttttcagttcttttgggtatatacctatcagtagaattctggggtcatttggtaattctatgtttagcattttaaggaactggcaaattattttccacagtggttgaactattttacactccaaccagcactatataaggcttccaatttttccacatcctcctccacacttgttattttctatttgggttcttattacagccatcctagtgaatgtgaagtggtaattcattgtagtcctgatttgcatttccctgaagactaataatgtcaagcattttttcatgtgtttgttgaccatgtgtagatcctctttagataaatgtctattcaagtcagttacccacgttttaattggattgtttgtctttttgttgttgagtcatgagttttttatatattctagattctagccccttatcagatatgtgatttgcaaatattttctccttttctatagactgtcttttcagtgtcttgacatctttcaatgtttaaagttttaaaaaattattaagtcaaattggtttgttttcttgtttgttattttggtatcatatctaaaatccattgccaaatccaatgtcatgatgacttacccacttgtgtttgtctaagtgtgctattatggttttatctcttatatttaggtaattgatcgattgggagttaatttttgtatgtggtgtgaggtaggggtccaccttctttcttttgcatgtggttatcacttgtcccagcatcatttgttgaagagactattttttctccattaaatggtcttggcacccttataagtgtttatttttgtactctcagttctattcctttggtccatatgtgtatctttatgctagtgccatgctgttttgattactgtagctttgtagtcagtgttgaaattgggaagcgtgagtcttccaactttgtttttcctttgcaatattcttctggctacacttgcaatttaatatgaatttcagaatcagcttttcaatttctacaaaaaaaaataggctattgaaatttcaatagcaattgcattgaatctggagatcaatttgtggagtactgccatcttaataatattaagtcttccaatccatggacataggatgtctttctacttacttaggtattctataatttctttcagaaatgttttgtagttttcagtctataactattttacctctttggttaagtttattcctaggcattttcttttttggatgccactgtaaatagaattttcttaatttccttttaagagggttcattggcaatgtatagaaaaaactgatttttgagtgtttatatcataccctgtaactttgctaaattcatttattagctctagtagctttcttgtgaatactttgggagttttcatatataggataatatcatctaaggatagaaatagttttacctcttcctttccaatttggatggcttttatttctttttcttgtctaattgcactggctactgtttcctggacagtgttaaatagcagtggtgaaagaaagtgtccttgtcttgttcctaatcctagggagaaagcttttagtatttcaccatttgatatgttgttacctgagggtttttcataaatgctctttattatgttaaggaagttcccttctaatcctagttttctgaggaatcatggaagggtgttggtttttttcaaatgcctttttgcgtcagtggagataatcatgtgggtttttttttttttccatttttctatgatgtggtgcattgcccgaagtgattttcttatgttgaaccacccttgcgttacagggataaatcacacttgatcatgatgtataatacacttaataggctgttggatttagtttgctagtattttgtggagaatttttgcatctatattcacaaggaatattggtttttagctttcttttttatcacgtctctgtctggcttcagtataaagtcaaggctagccccatagaacgagttagtaagcatcctttccacccattttttttctagcagtttgaaaatttggtgttatttaagtgcatggtagaattcaccagtgaagctatctggtcctgatggcttctttgtggggagatttttggttattgattcaatctctgtattattatcagtctgttcagatttcctatttcctctttacttagatttagtagtctatgtgtttttaggaatttgtacagttcatctaggttatctaattggttgatctacaactgttccataacataatatttataatactttgtatttctatttggttggtggtaatgtcctcactttcatttttgattttagttatttatttcttcttcctctttttcttatcgatttaaagttttgtcaattttcttgatcttttccaagaaccaacttctagtttcattgattctctcaactgtgtttctactctctgtttcatttatctcttctctaatctttattagtttcatccttgctagctttcaatttagtttgctcttccttttccagttccttgaggtataaagttagattattgatttcaaatcttcttcttcttttttttttttttttttttcttttgagatggagtcttactctgtctcccaggctggtgcaatcttggctcactgcaatctctgcctgccaggttcaagcgattctcctgcctcagcctcccaaatagccgggattacaggcacacgcataccaccacaccgagctaatttttgtatttttagtagagccaaggtttcaccatgttggccaggctggtctcaaactcctgacctcaagtgatctgcttgtctcaacctcccaaagtcctgggattacaggcgtgagccagcatgcccaactctcacatcttttttaatatgaacatttactgctattaattttcctctgagcactgtttttactgcatcccatatattttgatacattgcaattttgtttttattcttctccaagtaaatctaattttcctgtgatttatccttgtgactcattggttaagaatgtgttgcttaatttgcacatatttgtaaattttttagttttccttgtattaacttctagtttcattccattttggttggagaagatactttgtatgatttcaatctttttaaatatattaagactttttgtggcctaacatttgatctatcctggagaagatttcatatccacttgagaagaatgtatattcagcttttttggggtggaatgctctacatgtctgctaggtctagttggtttatactatttttcaagttgtctattttcttttggatcttctgtttttctatttattattaaaagtgacataatgtagtctccagtgactattgtagtactgtctatttttcccttcaagtctgccaatgtctcgttcatatatttttgggccctgttatttgatggatatatgtgtataattgctatatcttcttgatgaattatctttttgtcaatacataatatccttctttgtctcctgtaacagttttttactaaaagtctatttatctaatattagtttagccacgccatctctcttttggttactgtttgcatgaaaaatcttcttccataatttcactttaatctattggtctttgcatctaaattaagtcctttgcagataacatatgatttgatcatttgatcatgttgtattatccattctgccaagctctgcctcttgattgaagaggttaatccatctacatttaaagtaattattgataaggaaggtcttacggctgccattttgctatttgatttctgtatgttctataccatttttctatttctcacttcttccaatactgtcttattttgtattttagcttattcttagtggtataccattttattcccttctcattttcttttgtgatttttaaaaaatattttcttagtcattaccatgtgagttacaattaacaacctaaatttataacaacctaattttaacttataccaacttagtttcagtaacatacaaacactccactactaagcagcttaatcaccccttacgtgttgttgtcacaaattatatctttataagttgtgtgccagattgataattatttttaaggatttgtcttttaaatcatataggaaataaaaagaggagttacaaaccaaaatacaattatcctagctttaatatatttacctatgtagttgtctttactgaagttctttatttctttgtatggcctcaaattatctcctagtagtcagcctgaagtactccctttatcatttctttagggtaagtctactaacaccaagctccttctgctttcatttatctcaaaatgtcttaatttcttctttatttttgaaggatagtcttgccatttatagaattgttggtttacacttttttctagcactttatatatgtcattctactattttctggccttcatagtttcaaagcaaaattggctgttaatcttattgatgatcccttgcacataatgtgtcacttctttcttgctgctttcaatattctctctttgtcctcagttcaaaaattgcctcaaaaattgagagtatctgtacaatgaaataatatatgaacaggacctggcctacagaaggaactcaataaatactgggtaatataaatgattcctgttatttagtgggtgattctacatgcatttgatttttaatttaaataattagccataattataacttaaaatgtctaaaaattcacactgagaaggtctagatattggacttactagaaaaagactttcagtcaattgtcttaaatatgcccaaagagctaaaggataatttgattataatgcctcagtgtggatttttttgagtctattctacttagagttcattgagcaacttgaataagctggttcagacttttagcaaattgggaagttttcagccattatttcttgaaatattttttctgcttcatttctctcatttctccttcaagactcccacaatgcatagaaggtaagcttgatgttaactatcttatcacattctctgactctttcttctgcttgctgaaatctgctattgaacccctataattaattttccatttgttattgtgccattcagctccagaattactatttggttctgttttataatttatatcatgtttttatattctccttttgttcataaatcattttcctgatttcttttagttctttgtccatggttttctttagttcttcgggcatatttaaggcaactgattgaaagtctttttctattaagtccaatatagaggccttctcagtatgaacttttaaagacattttaagtgataattatgactttttatttaaattaaaaatcaggctgggtgtgatccctattcacacctgtaatcccagcactttgggaagcagaggcagatggatctcttgagctcaggagtttaataccagcctgggcaacatggtgaaaccctgtctctacaaaaaatacaaaaattagccaggcatgatggtgcacgtctgtagtcccagctactcaggagcataaggtggtagaatcacatgagcccaggaagtcaaggctgcaatgagccaagatcctgccctgcactccagcctgggtgacaacagtgaggccctgtctcaaaaaaaaaaaaaaaaaaaaaaaatcaactgcatgtagaaccacctactaagttacaggaattttctatattacccaatatttactgcagtcctcctgtaggccagatcttgttcatacattattttgttggacaagtacactcgacctttgacaggaaaagaaactgaggcacaggattagtaaagtcatatgattagtaaatggcaataccaacatatgaacgaggcaactttaacacagaactctcacttacaatcatcatgctttagcttctctcagctgtagtttgccttcgtgggggcaatgataacctaggactctgcctagtgagtataagtttctctaatatcagtcataatggccatcctaagcttaaaaacattcaaatatgtatcttgaaatttcaagcataatgcatgtcataaagaggaaaggacagggtaaaataggagcccacagctaagcccacagtcttaacctagaaaggaaatcaagtgtggcctagcttagaatcagatcattcagtagaggactcaacagaccaggtaaaatatgaggaaaacatgttctaggctgaggaaagcagcaaatacctgaaaaggacaaaagagtgatcacttaaggtattaaaagaagcccaaaatcaccaggaagaagcagcaggacataagtctggagagttaggaagatgccttattccaggattaagattttggattttattctaaaggtgaggggaagacatttaatagttgtaggtggtaaagaaacataacaacatagaatctgacaagggagaaagtgaggcaaacaattaggaggttagcattgaaactatgagttgatggtggcttgaacaacgggtaggaatggagatagatagtagcaatggggacatagagtgtaagcatgcaagaaatactgcagaggagtactcacatgatgtacctgattgggtgactgattgaatgttgggaattaagatatttaaatctttattatgtggacaatgttttaatttctttcttcctctattaacataaaaattaagcatacactttttttttttttttgagacagagtctcactctgttgcccaggctggagtacagtggtgccatctcaggtcactgcaacctccgcctcccaggtgcaaatgattcttgtgcctcagcttcctgagtagctgggattacagacgtgtaccacaacacctggctaatttttgtacttttagtagagatgaattttctccatgttggccaggctggtctcgaactcctggcctcaagtgatctgcctgccttggcctctcaaagtgatgggattacaggtgtgagctacaatgtgcagccaaaaacaagcgtacacttttaaattctacttgtagttatttatcttcatattaaaaaaactaaaatgatacatcttcaattattagaatgagatcctgtaattttcttatttctatatatagattagaaaatgagtaaaatagcagaacacatttacttcctgccacctctctcccacccacttgcatatttgttgctgtaatcagaaagttgtgaccatattattattattaaattatttattaggtaataatttatatcttatgtgtcaaaaattacatttttccattgctttgtagttgcaacatgtttttaatttatgtttaaattatttcaaatgtttcctaatatttattttatatcaaaatttcacctttcttgagtttttaattttgactccttctcgaataagggaagcatatcttcaattgtttcagaaaatgggtggtatgatgtttgaaccttgaggtatctgagaatgtctttgttttccttttcttgaataaatgataacttgagtaggcagacactataggtcaaatctttcccaggcaactgtagatgttattctattcagcttttgaagtttactgctgaagacaagtttttcttcctttgcaattaattttttttccacctggattcttgtcgaactttttccataacttagataccagaagccttccttcaccctctcaaggctggatgatggactttccaatgtgttttcagagtaccatatattacccctaatgtaaaaatcataataccacattgtatagtaattgcctgattcttgtatgtatgtcacccagtatagacaccaagttctttaaaggtaggacagtgtcttagtgatctttctatccctaattcttagcacatagcaaatattcccaaaatattcactgattaaattaatgacttgatagggcatttaatattgaaatttttaacaagataggtcattaatatatttcaaaacacattgagtccttttcatttttacaaagtattgtattggttcaaagtattacttcagatagcttctgatatatctgtggttgccgtctctgttctatttaccccaatttcttcttcaggaagaagttggggcataatctttctaccatttcctttaatggttgtcacctatttgtactttccagtcatattttggaagagtttttcaagcttttactctaatcattgatttattattctgcaatactgattccatctttgattatgtccaaattatatgtgaattttgccattgcatgttgttctgtgtccttacagacttaacttatccaactttggttttatttcaccttgtctctagttccctccttatcttagtctaatagcttatcatgtatttcatctctttttgcatagaaaatacaaagcagattctctccatatacttctgcttctggtaaataattttccaaagtattcactttctttgtattttgaagactctctttcagacagcataatcttttcaaagggatgctttctcttgaattactcgttccaagccttgtgtcaaccttactacctgaatgtgtggattttggttcttggctcttctcattatctgtctgatgctattagttcttcagcatagatgttgaactggaagacatatagacatgcacagtcaacagctaactttttggtttgaagctgacatttatcaactttgtcactgcgggtgttgggctgaggtgagattccttacctttaatagctagttattttactataaagagaagaattcctggttaatcagaaacaatgatttgtctttttcttgataagaaccatatatgaaaaagtaaacccccagagaaacaaacacccagttctgtctgcccaacccctttcattattagtttcctaagcttggacacagagcattacacctatccactccctttgggttattgctggtattctctaggccgtagctccaaaatgggtcatagagtggagaaactaatgggagagattagggcaaagaggtgtaaaatacttcttagccatcacacatagtagtggaattactagtaggggccgtgaggcaggtagcttccttactatccttccataccaacacctttgattgccttccaacaaaaaagtacatgtccatttcagcttcacagttcttgcaataagtccagtatcctatcaaattctggaactagggtgcttgtcaacagggttatagctgctcttatggtacttttctgtgagttagaaaaagcacctctctgagaagacacaggctgaaggaggcaaggctttgcaactgagcacagcctgctcaaccatacacagtggccctggttgtcagtctgccttccaaggccattgtgagttctcatgtttttctgatttttcatagccattttagttggagagtctgcaatataatcagccagtccagatgtcatcgtaaatcagaagtcaaccagattccattaatagtgatattgcacatcaaagatttgactgagaacataactgacattccaagtcatagtaactgtttatattgccaggtttccttgtccttaggtttatattcagaagtctcaataaattattaagcagttttaaaactaggattcaaaatatttttgagacagagtctctctctgttgcccaggctggagtgcagtggcgtgatcttggctcactgaaatttctgccttccgggttcaagtgatcctcctgcctcagcctcccatatagctgggattacaggtgtgcaccaccaaacctggctaatttttgtattttcagcagaaacgggttttcaccatgttggccaggctggtctcaaactcctgacctcaagtgatcagcccgccttggcctcccgaagtgctgggattacaggcgtgagccactgcacccgtccaggttccaaaatatcttttaaaggcctgcaattccctcattttcttttaataataattcattaattaatattattaaatagagacgtggtctcactatgttgcccaggctggtctgaaactcctgtgctcaagtgatcctctgcccttggcctcccaaagtgttaggattatatgtgtgagcaccacacctggtcagttccccattttcatgccaccatacccaacctccaaagccacatcactgctcactaacttgaggtatataataatatgagtgaaggaaaattggaataaaattatgtcattattttaaaagattattcctcaaataaatgtcaactcaatttctaacctttgtaaaacatactgtatgtgaattcttaaaaaatcatcattataggaaaaggaaaatgtttgatgccattttagcattgattacaaaataattctaccagcatttatgcatatttcacatacaggggaattatgcagccacttctcttcaagactacaacatcatggaagtggaaagagaaaaatacgcatttaagaaatgtgtatatctagctatttccttattcaaagtttttagcacctccatatttcaaaatgcctatgcattcagctttagactctgagtatattactaaattccactatttcaatcagaaatcttcaaatcagcttatttaatttgctcaagcagtgctgaataaactggacttcatcaaaattaagaatttctgctttgcaatagatattgtcaagagagtaaaaagacaagccacagacaaggagaaaattttttgcaaaagacatatctgataaaggacttatcaaaaatacaaagaacacttaaaactcaacatttggaaaacaacctgattaaaaaatgggccaaaggcctttacctccccaaagaagttaaccagatggtaaataaatagccatatgaaaagatcctccacgtcatatgtcatcagggaaatgcaaattaaaacaacaataaaatatgacacacatctattagaatggccaaaatccagaacacttacaacaccaaatgctggcaaggatttggagcaacaggaactcttattcattcctggtgggaatgcaaaatggtagccactttggaagacaatttggcaattgcttacaaaactaaacattctcttaccttatgatccagcaatcatactacttggtatttatccaaaggagatgaaaacttatgtccgcacaaaaaaacctgcacacagatatttataacagctttttttcatcacactggggtgagggatgttgataatggggaagggctatgcttgtgtcggggcagaaagtatatggaaaatctctggacattcctttccattttgctgtgaatctaaaactgccctcaaaaaaagtttaaataatttttttaaagcagtactgtattgtgatgtttaactcaattacttattacaagaaaactattcaactggtcaaaacgttatatataagaagtttctgtttgttaaaaacattgtttcaaatatatttaggctttgacttttaaaagtatacagcaacattcaagataactagacagaatgcactgcaacttggcaggtttttaaatccttggacttactggcctaaggaaagatgtgtaaacatccatgattcagaaatacagggagaaattggggcagccagacctcatcctcttgccctaaagggaaaagatatctttcttgcggtatctaagatatgaatcttagataatattcatgcatggctaggaattggaataatgggaaagtcttaattcatgggaaattttctaataaagttccacctccatttccagccattcctctttaacaaatacatttagtgaaaaatactaccagttggggagaaaccaaatgggtatgtgtatatgtagtgtttctcagagtgtggactttaaccacgtttaattacataaatttacgaggatctgttgaaaatgcaggttcctgggcttcactccagttgctctgaaatgaaagctgtaggagtcggttggtgaaactacattttgtttctcaggtgattcttgtgtactctaactcatatatagggtgatgttatttatttactggttatttatttaccggttatttatcgtttggcaaaaaaatccagcaaagactcacaagtgacctttacacttgacataggattctcttccgctgctgacgctttttttttctaagaggcggggacttggctgggcagggctgggggagggcgctaggcggggcgggcaggggcggggcagaagagccctgggctgggtggggcagggcggaagggccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtgtgagtaagaaactttgtgaattggtgtgtccgaatccgtcaagcacgacgtcggagaatttgtatgcgtgagcgagagggacgcgctgacagtaggggcgccgcagggagagaagccgaggagcagcggagacaaccaatttgcagtttggggagggattttgtgcgggagaaaccacgcgagtccttcccccggagcggactccttgtgggttggtttccgggcccgcgatgtcagcatagcatcgtcggcctctgccccaacggcttcaagggagggactcgtcccggctgctttgcccgggaaatgggggtggaagggcctgcggtgtcgaggtgagcagtggaccctccaggaacattcccgacttcccttcgggagagagactgcctcctagaatcaagtagtatcgtggttactctttcgaaaacttaattggttctttctgttgttttcccaaggtggttgcacaattcccctctgccttcctgtggggtgtcatcatagcctggtcaatgagaagttgggtaacttcccagagggtcacggagggagtgggtggccaaggcaggaagaacagaagccaaccccgcccacagtgggaacccaggcgttaggtagagtcctcacgccggtgtaaactgactagcaacgagttacaggcaaaaaagctgtgcttttctagaagtagaaagggggaggataatcaaagaagagctgtgcctttattgttatgctataacgagcaaaagtaaagcagccttgctatgtaaagtggtgtttatctcacctcacaggagatgcttttgacaagttataataagggagagatggtagtaaaggaagtgaagaagcgacgtgaaattgaaggaaaagaaaatgacctgccttcttaccgcggttggaatacacacccaaacgagaggtagcagagaagcaagcagtgcattctgttaaaaattattgtgtcctcatttgagagaggagggatcctcaaataatacaactatgtgcaaagcaggaagtgaaatccttctcagtcctctccccagttgtaatccaagccttccacatctttcctgtatgtgcataaccatgttattttgctttcttatgaaaatgagattatgcatactgttcgataatctgtttcagattaaatatatatatatggtgaaagtcttgccatatgtagctctattttattgtaatgttggcgtggtactgcattgtgtagatgtaccaaattatagttaactgtcacttactatgtcctgtccgtatatattgcccagtattcttcaaaattatctgtttctcattagactacagatttcattaatcctttgtgaaatatatggcaaatattttcaagaattatcaatgctttggtttaaaatgcccaggctttttatctcaggtaagaaggtagtccccactcaaaaattcttaaaatcttctcctatattgcctgttaattctctttttatgatttactcattaaaacatctgaaaatgatttttgtatgctaagataaggatttaatttttttctttgtttttatgactaggcagccattttttcctgaaatcatttgttgaaatcatttctctcccaactgactagaaatacctccttaatatcgtaaattctcaagtgtacatgcatcttttctttagactcatctgttgctttgatctttttgtctcttcctttaaaaataccaatctgctttgatattacgttttctagtaattcataggacaagtccctcttcatttttccttttcaaaattttcttgaatataattgcattatctttgagataaaatttaacataaactgttcatgcttcattaaaatactctttttgggatttaaccattatattttcttatattttgtgactggtatgtagatgagtgtttatgtatctggccaactttctaaatttattaattttaataaattgtttcacttgaattttctaggaaaacaatcatctaattataattcatcttatctctttctttctttgctttagtgaattgctggcttccccagaatagtggtaaataaaacagtgattctggccatcctttatcttgtttcttagtttggggatgtttttattatgtcatcattaaatatgaagttactattaatatctaataaattatatttatcagggaagtttcctttaatatttctagctcattgtgatttttgcagagaactgtttggattgcatccaaagtcatttttgcaactggggatggggagtgtctattgtattagatagcactttgagaacaattttaaataatagatattggatgttcatttggtgtgtatattcattacttcttaacatttttatcaggaatggaagttggattttgtcaaatggctttttgacatctatcataacctttcataggtacttttcatctttgacctaacaggatagtgaattactttagtatatttgcagtttgtgaaccaatcttacgcttggtcatggtgtaatatttaagtatatattggttcctttggtagcatttttatttaaaatcaatgattgagattcattttatactcacctttttctgttatttttgctaggttttggtatcaaggttatgctggttcctaaaaagaactgggcagagttcctcttcctccgctctgatgtagtttaaatagcctaagaactctgctctttgaagatctgaaagaattcactcatgaaaccatgtgggtctgggagttcattgttcttaagacagcaacaatactcagcaaaatggttcagaacaaacaaaaactccttggagtaaatacaattgaatgaaagagtctgggacacggtaatgtcaagaactaagaacagctgctgtactgatgctggttatttcccccctacacacaacttttttttcatggacaaggaaaaatgctgtaggtaggctgaggctgttaagtaaaatgtcttgctattctttctcttctcttcttcagttatgttacagaagcaagggtattgcttctacatgggcaaatttgtctatgccctgaaagaaaccaagagtgaaactcaactgggaaagcatcagtttcactttattgtcactagcttcccaattttgccgggaaatttcttaatttaaaggtaataaccaagctgacattttactgtagccaaatcctacagagggtttcaaaatgagtgggtgaaaaaatatacaagcttaacatgcttatacttatttaacatgaagtgaaaatcattagcatagttcaggtatgtgcatggtatgtgcacgcacatggggcagtgctgtcatctaacagaagcccacctttttacttgactaatggtttactgttaatacctcgataatagtgtaatctttgatagacttttataaatgattatttcaaatgctttttgatcaccttcaagaatatgacctgagacaggtaatgtaatttagcagtttgcatctatgaactgtggaggatacctacagacactgaagcgttactaacagtaggatgcaggcattatgtgaatgcgtgggtattttatttccatttatgggctactatagcaaaaataattggggagttgccctatgatgaaagaagactgcatgttttttaaaaccatacctttgtccaaaagcaaatggtaaataaaaatagactgttgacataaagcttcgctatttcgatgctatgcattagctgattgactgttactgtttatcctttttgttttctaacaccttataagcataaaatattactgtttaattgcagttcgtttgtgttcagttacgtaaagcctagttttagtttctatttcctgtaggatttatgctgtggctgccatttcccacctgttatctcctatgcttgctgccatggttttgaatcataaatacagggaaagaggaggctattatttagatatgtaacaaaaatcgctttatagttcggaaccaagattatgattatcttcaggaagggataacagaatatgaaatgaactaccttttcagtgagttgttaattaattttcaaagtcttttgaactaagtgcagtatttggtcactgttcaaataagttgagggtaactggtaccaagccctatgcaactgaaaacaggctttgggacttatgtagtacatgtgtcacattttccaattcctaatctataaaagctttttaaattgtggtaaaattcacataacataaaatttaccatcttaacctttttttaaagtatatggttcaataatgttaagtgcattcacattgctatgcaaccaagaaaaacatttttaaagggacgtatttttcttaaggaaaagagtttgggaagtaaatgatggcaattgtttgtctcatggaaaatttcctggacagtaactttttaccttcagagatatattctctataaatggtaattatcagtagtaagttatgagagtaaacattttgagtactagtgatctataatagcttttacttaacaccaatacttttttttttttttttttttgcaaaaggaagggtctactgaaaataggttgctaacattgacaacaaagtattttaagtcattgcagtaaggaattactggaaattgagtagacaaagaaaattaatatgagttccattttgatggttacttagcaagttgaacttatgagagtctttgaaatagttgcagtatgagaattgttctattgaacagcgaaacaacccaatcaggtaatagtttttccagagagtgacttgctataagggacagaagttagagacttagattctttcaaaataaaggattttttttaattgcttgaagaaggatttttggaatcagcaaatcaactgttattgtgagagatttaagtggttttactattcacaaccatttattatgtggcatttactggaatgtggtttcataacctcaagtatttggaatcccaaaagtagaaatgcctttcccttgagattgttgtttctcaacctttaaaaatccatatttcctttctgataaacattaaaatctcacaaatcctagaggattgtaatacatgttccttcccatacagtcctactcctcctctacacctcaccatactgactacagactttctcttctagttccctcatctgtgaatattatgcaaagtccttctttatatgatttatgtaatagatttttaatattaactatttcaaaattgtatatccttcctcccccatcttcagattctaacattgcccctagtcagaggagaggataccccttaaagattactcagttcagcacagccaactgagcagtgccatgtttacgttcacctcagaggagtagaacatcacatgcctgctttcccttttggtgttatactgtttagttgtgcacttaaacccataacatttgataaatagtctcagagaaagaagtattactggagaaaaaaaggaagtaaggcaaaactgagactcatgggtgtggtctttgacagtgaaatcttttagctcttgcaagatcacatagaaaatttcaccaagttctaacatccagcaaaatggagaacatgtactggggacctttgggtttaaccagtgagactgtcttgtttatcctgttgcatttagccttccagcttatggaaaaatacaaaattcaaattctaacactgctggatttatgatatttaaggtttctattatatcagctgcctggatggagcacagaaacagcgtagtacaatatgctatgggtatattcatgaccaaagtttacaatgtggaaggagaatagaaatgcaagaggtcagttggggaattagctgcttgtgttatataactccttaaaagtggaaaatgatcacaagtaaatgtgagtagtgacagttctcttccatttcctttcttcaggtaaggaaaacacacttaatatttttgagtgtctttaaagatcttcctaaccatccaaaagagaagatgtcttatttatgtgtatatgtcgtgttgttgactgatttttttgctttttactcctgatgtgttttgtgggtgagaaggcaagcatgtaactaagatacagaaaagaccaagatgtagtggggcacagtggcttgacgcctataatctcaactactcagaaggctgaggtggaaggattgcttgaggcgaggagtccaggctgcagtgggctatgattgcaccgccacacttgctgcactctacccttgggggacagagtgaagctctgtctcaaaaaaaaaacaaaaaacaaaacaaaaacacagaatttgtctttcattcactgattcacctctttatgtactacagtggcaacttttctgaaatagaatatgaactcctcttattcatagcccaaggggttgggaaaggctggtggctttcttttctagggcaaagtggaaggagtagcagttattcaaggtggtttcctttccccatcctgaaactgctttagatttgagttggtctctcaccacaagtgtgaactctggcagaacatttacccagaaacagaataggctcagcagttggggaaacccagcagaggggccttgcctgcctcccaaattactcacacttgtctcaaccacctacaaaaaagtagaccttactaaagaatgactaatcatcctggggtcaagatggcgaaaatcctacctttaagcctttgattctcttcaaacgtggaattccaatgtatatatacataactgatcaaagctcagatgttctggttgaacaggcagttagaggtggaacatgatttggctcatacactgtcagcctcagtgcagctccagaggcaccactacttacccttgattactactttctttatccaggattggttggctgtcatttggcaggataatggctgccaaagacaacagacttaagatattgtatctattgtcaacctaaagaaatggaggcaaaattaatatggggaatttatttgggtaaaggttgacgacagctgccttggacacacttccaggttgccttggggggttgctccattcggcctttgttgcaaccaggtttttgtttgtttgtttgtttgtttttgttttttgagatggagtctctctctgtcacccaggctggagtgcagtggcgcgatcttgtctcactgcaagctccgcttcctgggttcactccattcttctgcctcagcctcccaagtagctgggactacaaatgcccgccaccacgaccggctaatttttttgtattttttagtagagacagggtttcaccgtgttagccaggatggtctcgatctcctgaccttgtgatacgctcgcctcggcctcccagagtgctgggattacaagtgtgagccaccgtgcctggccgcaaccaggtttttaaaggcaaaagagagcaaagaatgggctgatactaagttatttgataggaattctcactggtttacagaaataacattgattagtgattatacattgttgaactatagggcatgagttttggtatctaacgtatggcattttatggctacttggcatcacatagtaggtagcttcaagagggtcatttagttcacgggagagtgaggtgtgactgctgtcacacacttacatttcagtgcctctctgggcctgataattaaaatgggtttgcactcctcacattaaaagtttttatttctcactatgaaataaggagggaagttcattttaaaaggagtggcagaataaggagaattggagaaccagtacagaagattcaaaacccagatagtagaagtcccagaaaggaatacaaaaggaaagaaattgccccaaaaaattttcaagaaaatttccaagaactgaaggaggaatttccagattgaaagggcccaccaaacacctattgctatgatatagtccatggccaagtatggtcctgaaatttcagaatcctagggacaaaaagaaaaaaaatcctaattgttttcaaagagaaaaaaatcggtttaaggccaggcacagtggcttatgcctataatccaagcactttgggaggccgaggcaggcagatcacctgaggctgggagttcaagaccatcctggctaacatggtgaaaccccgtctctactaaaaatacaaaaattagctgggtgtggtggcgtgcgcctgtaatcccagctactggggaggctgaggcacaagaatcgcttgaatcccggaggtggaggttgcaatgagctgagatcacaccattgcactccagcctcgagcaacagagtgagaattgtacaagatcaggaatcaaaatggatctgatcctcaaaaaaaataaacagaagctagaagatagcatagcaaagctttcagaattctgaggaaaaattacttccaacctagaactcttaatctagccaaaggatccgttaagtcagagggtaaagatatttttagttatgcaaagcctcaaaaaatttacttcccaaacactttcttaggaagctgctacaagatttgcgtcaccacgtggggatataaaacaagattcaggagactgaaaatgagggattcaattaaagaaagagatggacaaagggtatccccaaattcaaggtaaagaaggtcccaagatgaaggctttccatcaggcatagagagcaactagtctagattggagcaagccagaaagcttacagagtgattcttctaaagagatagaatacctgacgtgtctgaatatattgaggagttgtattagtgataataggaaacaaagcaaacaagaattttcagggaaaaaagttttcagaaaaggaaaagtatccatggtattgttcaacagtgaatagcattacatagtaataagaaagtaaaagctgaatgctaatctaatgaaaaattagatataactgtattggggaaatgggggagaataggaggtaggggatatttaaagagagctgaatcctaattttccataatgaagagacaaaaactgaaaaatcagtagtggcagtattacatgttatttagggatacagagataaatacaaaaaagaattagtcaaaatttgttgcgaaggtgaagcaggaaataggaaggggaaagcagaggactactgtttttcttattttgtagaactacacaactcattaagatataggtacgtatagctctgattaaaataaaaaattagaggggagagagctagagattgtgctttagcaacagagacctaggtttatctggttcttccattttctaattctgtgccttatgcaacttatttacccttttgaagctcagttttgaagttcagtttcctcctctgtaaagggaagacaatatatgcttctgcagagggaagattaaaaatgaggtagtttatgtaaagcacctgcaaatagatctttgttccgaccctaaccccagtgcttcccatgatcaaatagggaaccaccttcttcattgttgggatgattgccatccaaacagaagactgagattgtccttcttatccatgactctttgtgcctctttgaattaaaggcatgtctttgagatctatcttgtctctcaactatctgtagatagtttgagaattgaaatagaattaagatgattagagtattgataggaggaacatcaagttaaaagtgtcattgctacttagtgggagatgggctatggtcagtcaaatttctcaacaagaacttcaacaaatgccattaatagagaaaacatttgttttctctattaattaagttgatgagttgtggaagttttatggaagcaagatgaacaaagtgctgttgctctgggccatctgccaaagtatcaaaatacctttatttatttatttgagaaagtcttctaccttagcaactgctatttttgttccgaaattctatatacttcttgtagaataattaaaaagcagatcactatgggaaaaaaggcaactttatgaaagcctgtttccctgcgttggtgcatatttgtatagcattttatagtgctttccaagctatgactcgaccccctatggcagtaattttaaatccatcttacatctccccactgtacaaaattagatccaggagtcttggacagggtttggtaatgtattttttaaaaccaccgtggatgattctaatttactgacaggttgcgaaccaatgtcctacagcctgactctacgccaagattctgaattgggagaaatgggggaacagaggtccatagaaaggttaaatgacttgtttactctcacccatcaccaagcctgtctagactggacatgtattgtatacttcaactctgattttatcttcagttgactaggctttttaatttagagtatctgatctaaattgccttagcagagaaattagtacattttacacaagatgtggtatagttaaaaatatcatttgcaatctttattttatagtgtctttttatttttttccagaggcaaaaggaagtgaaacagcaaatctgagtttctaatcaactattacttccccacagtagggtggcacagcaagtgttaagatttactaggtctgaatattcatatttgaggtaaactggtgtggccttgaaaagggtagaaagttgggtaattttggcacagatgcaagtttggaatgttgatctgttgggctgcccagggatttttgtagccttctctttaggaatattcaacagtctgaaggagagaacttgttgcatggtactggattaaaaatattagatctggttttaagctaatatgttaaagtcataccctaaacatcttcagaatggctgaaaatggagatccggaaatctctgaaaccttatttattttttcattagagttctcacaattacttctaataaaacaagttgtgacttgcaaatccagcagcctatggatgtcctcagggaaattaaaaacaagggatatgaagagctgtagagtcctgtgccagtggttaagagcacagagtaaagctttataattatgtaggtttttgcctgttcctatttatcattggtaatgttctcaaggctaaatggctgctcagctattttaaattgtgatttaaagagaaattaggcccttttgtgaaaaggtcctctatctcttgaaatttcaactcttttttcatagaagagctctcttcctccatagtggttttttctgatacagtaaatgactcagggatactcgaggggcagccaactcgttaactcataagattttaactacttctctttcgaaacaactttaccatttatgaatcttgtgtagcctgtgacttctgttattgtcttgtgttttgggggacctttttgagattactgaaaatattttttttcaaacttttctggttaagaccagaggatagatacaaactgtaccactcttttgaaaaatcattagtactaccttattatttatttataaatctggtagagtagaagatacttaaggaaaatcttgcattcaaatactctgccagagttgtttttcctgttatttaacagcatagaaaggttaacaaagcagagcattagataacatttctacatattggattaatagtctttttacataaaataacagacacaaaatgtcatacactattttatgcatttcctagttttccttctggcctccttcaaagaaataataagtgggcctgtcctcttttttggtttatatttggtaggaaaaacatgtacatcttgtgctataaggtggtacaataatgcgtattgcttttctctattgttttcttttcaaaaatgtagtttttttcggcttttttttttttttttttggggggtaaaacgattttggcctaattggccatccaaggatgtactagtatcaggagacattaaaaacaggacttcaagaatacaaacaatagtgaaggcatagttatcttcatttttttcctatagataattatgcaggtgatgctttcttcctctttattatgatgtcttttctagcactgttgtccaaaattagattcagtatcttccctctcctcctgaaaattttctttctgtcactttatgtctggctatcaccactttctactgggtgttttgaaaaccagtggctggtgaaccatctgcaacaaaatcacctgaggcgctttgctaactagaatgtagattctgaggtcccatttcaggccaactgatttgcagtcacaggtacctgaattgctgccctcttgtctattgtgcacatccagtcggccaccaaatcctgttgattctactcttgaaatgcctcttgaatccactcatctttatttcccctgctctagttcaagccctcatcttttacctagaatacagcattagttgcctgtggtatagcctcactttgtctccctcgctagtttgtagtccatgctgttatctgttctgtctaaaatatgtccatcatctccttgaaaatctctcattactccttgtgtcaacatgttaaagtctaaatttcttagagtgacattcgaggtctactatagtctagccataactgagtctgctgcatgtggtttatgcagccagtgtactctacagctctataggatgccattccaatcatggtctttatgtatggtcttccctagaatttttgtagtacagcacagtcatacatgctgaccctgaccatagcttatcatggcaccctcacctcgctatcatctctgcacacatgctagacttgcataaacagaatactcccttcactaaaatgcaccatattaatgacttttcagggcctctgctctttcagaatgaatgtactttgcccactcattctctacttgttgaaactcttctcatctttcgggactctgtttaagtgtcagatcctctgtgaagccttccacaatccttattttgattgttccttctattgagcctttatcttgtttataccttttacttaacagttttcttcttctttttaggtagaactgtgaatgaaatgcgtaaatctctagtgaaccattggttgaggtctacaaatgcttatacctgtgctacacagacctctgtgaagatgtgcccagaccttttttttttaaacatttataattgaccttttggctaattattttcatgtgtgtctgcctcactcaattataagctctaattggagaaaaaggcaaagaccatgactgtttttcactttcccagggagaaaaggagtgcctattgtgtgttcaacactgaaccagtcttgaacattgtaccaatcaggatacagctcagttcctcctttagagacccacaaaacagtggttaaacaagggttgcctgcatcacagtgttctaggtggcttgtcactgtaacattccaaccagctgggaaaaaaggtgaaagggaaaacttgttatggaagttacacccatttgccaatgactagcacgtagtcacatgaccacaccagctaaaaatcagaagtattagtactataagagaaggagagaatagatattgaggaacaaataacatatcttatatatatggtctcactgaagttttacttaatttttactgtatatatggtctcaatttttattgtaaccctacaactatgtatgatgtgaaaagtgatgttcagagttcagtaaatggctaggaaattgcagatctggggtctgaatttaaaggctgtattttttttcagtctatttagtaaagtgtttaggagggaatatataaatgttattgaataaacaaaagtcacagtaattttcacagtattacttgtaatcacatatttttcatatcacatatttttacagtatcatatcatctctttacttccaggacactctatatataaagtttactccttgcttctcaccattgtgaaatgaaatgccctagcaactggtttgcaatcaaggcttaatttgtaacataaattaagacaaagcagctactgtttttaaatatatgatatcatttatgaggaaaaataagtcaccatatttgctgagcaaaagtttttatgttgtgtatagtttggtaatgttatacaattataaagttaaaggagattctattatccaaactctttgtcttaataacaaagaaaatcaaggctgcagaacttgccttttctttcatttccacctctacttgctttcaggcatcatggggaaagctttagcgtaatccgtcatgtttatagtaaccatcattgttatgcttaagaattgtctcaggtttgcatggttgtcctgatcaggaaaatcaaactgagcagtgcataagaaatgcatataatccttgcctgttttagtaaagaattgatattatttaatattaaaaacatccttatcacagtgggaaacctgtttgaaaaaggatgactgccgtttgataattaaataaaaggaatgggtaagatcattcccacctatatctcaacactctattcaaatgccacctacctctcaaagcctttcctaaacttcataaatagattaactttcctctccaaactctagccttttggatatcttaggatgctcatatactatatgcttcaagttacagttaatggtaccttcatgggaggagatgtcatgtctgattcattcttactgtatcagtggtacccagcacacttctgctcatagttggcactaaatattttatcaaataagcatattgaccataacaccctgggagagcactttgcagctgactctaatgaacaatccttgaaccaagaattttaaagatttaatctagttcataacacagctttatagctatagataagtcatttaagccttctgagccttatcagtcaaagaggaatgttaatatgtaataggaaatgaagaattggtgaaaatactttgtgaaagaaacataactttaagatagtactatatctgaatcccttgctgttccccatatggtgccttacacatcataagccagcaaataccttgttctgattgaatggtaatgggatatattttattaaaatcaaagttttgctagggctgggaagctttaccaaaggaagagaaaattatctttcttgctcatgctacctctcttactccaggacagtttcattattgaaccaagggatcaatgaaagaggaagcagggattttcttggtgtttcttcatggacaggcacaccatgggcaatcactgggctggagaggtgggacaagaaccgactgccctcagttttgcttgtctgaaccactggtctgggtaggaaaaaaggaattactgctagattgacaacagtgggtagatgagagtatccaggctccagaagaactgcaggggacaagattgggttggtgatttgcattgagctagccctgctaccttcagggatttcagaatttttttctcatgtaatggaaggaaaccagcaaaccaaatccagaaataaagcaaaaccctaactaggagagtgttttcaagggagagattgctatagcatcagcctcttgggtttggagaatgagcttaaccatgagatttaggtttgagcatgtttactataagtaaaaagcattttcctggagtctggcaaatattgcggaagatgtactgaaatgtaattgaaatgtagctgcctcttaattttatacttaacaaatgccaaaaataaataaataaacaagtgactttaaagttcagggtgttaatatttgaaatctgtccagtttaattagctgagtcccagagactttcctttttctctggtcagtgtcgctgatctaacacctaattatcttcttggttgtgaaataggaattaaaagtatcatttacttatttgtatcaacctggaacttatttctttagcatacattcttatttcaggaaataggatgcatccgtgtggaatttactcagtagctcctctctcagtgacatttgtgtgatctaattcaaggacctgaagggatggctccacatgatttacttgcatatgatgcagctgtttttagtgctgcatttacatttttaaaaacaagaatgcaccttctcgatagaacagacatgcatttttaactcacaaactcaagaactgtagaaaaaggaagtttcttagaaattgggtccaaacacctttttgtactgaagaaaaagaaactttggtcccaaaagatttagtggcccttaactaagggtcagtcagtaatagaacaaagcaagggactagatggatttccagttcgaggctcttatttgtctcagatctaaaggtacaggtgtggtttatattgacaatttttcatgacatgcagctttttaaggcagtgatagatagcttagccgcttagctacttaaaacctctaacttctgtattagtttattatagtatattatagtccctgtgactacctatacttactttttctttcctctttgcatatttatttttaatctcatgtattttttgtaagtagccttagtatgttttcgaatgaagcagtgtctaaaatactcaaaatgatgctttttattaatgctaactgcttatgtttccatagtgtctatgtctgggccaagatcctagcaacattaattatcgtaacaggatttcaactttttcatctatcagaggtagcagtagaaactaacttcctaagtggaatgcataaagaattgccatttcttcagtttttcagaaagtaatgacattgttatccaaaaccctggaattgtttttattgagcctggtaaattacttaaaatgtatttagtatcttaaaatgaaagactttggctgaaagattacttgcatgtgggtattaaaaaaaagttgtgatttatgatcagttgatttttggcaagggtgccagggctattcatgggaaaagaatagccctttcaacaaataatgccaggacaattggctaacctcatgcaaaagaatgaatctggacccctacctcacaccttatacaacattaactcagtatggatcaaagactttaatataaattataaactacttaaaaagaaacaattgaaaatcttcatgaccctggattaggcaacagttccttagatatgacagcaatagtacaaacaacaaaagaaaaaataggtaaattggactgtattaaaattaaagacattgtgtgtcagaggacactatcaagaagtgaaaaggcatctacagaatgggagaaaatacttacaaatcatatattggataagagtctagtttctagaatatataaagaacttttaaaatttaacaataaaaagagaaataacccatttattacaagtggacacaggatttgaatggataaattgccagagttacacagatggccaataagctcatggaaagatgctcgtcattagggaactgcaaatcaaaaccttgatagggtatcctttcacacccactaggatggctgtaattttttaagtggactataagaagtattggtgtggatgtggagaaattggaacccttatacaatgctagtggaaatgtagaatggtacagcttctgtggaaactggcagttcctcaaaaagttaaagatagaattaccatatgactcagcagttccacttctaggtatatatctgaaaatattgaaaacgtgttcacacaaaaatgtatacacaaatgtgcacagtagctttattcataacagccaaaaggtggaaacaactcaaatgtccattaactgaggaataaacaacatgttgcatatcttacaatggaatattatttagccataaaaaggagtcaagtactgttacatgctacatcatggatgaacctcagaaatatctttctgaaagaagccagacacaaaaaccatgtattgtattattccatttatatgcagtgtcaaaaatagacaaattcgtagagacaaaaaaaaaaaaagattaatgcttaccaggagatgggggaagaggaggattgggactaacttaataggtatggactgttttagggagggtgattaaaatgttccagaattatcttgatggtgatgcttgcacaacataatgaatattctaaaaaataccaaagtgtacactttaaaatagtggattttatactatatgaattgtatctcaattgaaaatgtgaaaatttaaaaagtgtgcctgaagatataacaaaagatgttatgacagattagagactgaaattttaaagaattttcacaaacatgaaataactcggtacccaatataactgatagagaactttgtctagtctgtgacttttagagaattaagagaaaggtcctgtgttgtgatttttacagttggacaggaagaatcagagtcattagttagccttctgctcagagccaaggaatgtcgttaagagatgttatgcagactgaggttataaaaccaaattacctccactgagcaaatcacctgtattcagaaacagcagggaagttggaaaactagtcggtagtgggggtaggactgaagggatgtgatttttcttttttaacgtacaatgcaacagtggctctccctagattttgtgctaaaataagaacattttcacacattttaattgctctgtggtaacaacagtgcgaactccatccacaaacatttattatctatttaattttgctctaatttcagtgtagcaagaattcacctcataagtgggagtaagagtccatttaataaaatgaaatcccttcccacattgctgatcctattgtacatttccataataaagaatttaaaatggccttttatattttctcatttttaggttaagtttatagattagtattctcaaagtagcatcttcctgaaccggaaccccacttgctccttgaacattagaataagaatattttaaaattgtggaacttaaggtttcatacaatttctagtcaggattttagatgagacttatgtttatagtacttggtggtataatgtttgtggtaaaccttatagaactatctttaagatgcatttttaaaatgaggtttatgtaacttagtaattatctaaattgatctcattattttgcagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaaggtgtgtggttctggttttgaaagttattctttatcttggtacatggaattttagagccttttgcatctgaaaaatgttatattgttagaaattgccctgaagaactataattacagaaatgcaggtatatattaatggattaaatttgaagtttttgtttgttgttttttttaaaaatattgcaacccataggaagagttgatttgatgggctccttttcaggtgattgtgaaagattgtgaatgttgtcttccataaataattttaaaatatcagtatttataaataaggaggaaataactataaaaacagttttatgacacagaagtatcactgtctccatttgtttggttttggtgttttttatgttgttatttggctgacaggaaaacttttcaaatcttaaaatatttaagaactaaatttggtattaatttataatactcttccattctttataacaattcaaagtagactatttcagtgaaatctttaatgacttactaaagtttcagcttttacaattatccctgtacacataacatttatttttagtacttttagtttcagaagaaagtaaattggaggaaaggcatatccaggcaaaaattacttaacctcatagttcttaagcacatgtctgttactggttcatgatgagattttcactgatctgcagcaaaatgagaaaaataaggctaattattaaacttctcataatgctacatttatttcatctaaaattctgccttctattctgatgttatgttccatgtttccatacgatcaaagtaaagagcagaattttattaacatatacttttgtgaaatgatgatgataggattctctcctttttattatgtttacatagtagtgtttcagaagtctccaatttcacctacacgttctgtgattccccagaaggattcatgcaactcaacattggatcatactcatagttaagatttattacagtgacatagtaaagatatatagccagattattaatggaaaaagacatcaggaggagtctagaggaatccatgttgttcagccttcctatacacctttccttcaactttaaaattcagtaacgtgtgcagtatatcaggaactccattttagtttcagagttcagggtttttttttttttttttgaggattgatcacataggcaccctcttgtcaaccaaaattccagattctctcaaaaggaaaggtgttcattgtaaatctcattgtatagtcttaagtgggctggcacagcaggcacaacattatcatttaggaaaggttttcaaaagccaggttcccaaatgccagctgtattagtctgttctcacactgctatacactgctataaagaactacttgacggccatgcatggtggcttgcgcctgtaatcccagcactttgggaggctgaggtaggtggatcacctgagatcaggggtttgagaccagcctgaccaacatggtgaaaccccgtctctactgaaaatacaaaattagccaggcatggtggcacatgcctttaatcccagctacttgggaagctaaggcaagagaatcacttgaacctaggaggcggaagttgcagtgagctgagattgcaccattgcacaccagcctgggtaataagaacgaaactccatctcaaaaaacaacaacaacaacaaaaaaaaactacctgagactgggtaatttgtgaagaaaagaggtttaattgacttacagttccacaagcttaacaggcagcatgactgggaggcctcaggaaacttacaatcatggcagaaggcaaagcagaaccaagtaccttcttcaaaggtggcaggagagagagagagcaaggagggggggatgtgccacacacttttagcatcaaatctcatgagaactcattcactatcacaagaatagcatggggaaaatccgcctccatgatccagtcacttcccaccaggtccctcccccaatattgggaattaaaattcagcatgagatttgggtgggtacacagaggcaaaccacatcactagccaagggaaaacttgcacctaaacctttctgaagataacagcctcaggcctgctgtgttaaattacttctgcacaggcagttgaaagtgagagatcttatgttggttttcccaattaaaaaaaaaaattactagcctgtgaaactctgaagtctaatatgctaatattttggaaaaattctcgaaccttgtttttcctctaatctcacacaacaacaataatcaacaacatagaagaggagaacaggagaacgtcagagaattgaagtttagaatttggattttttttttccattcaggtttaaggcataaccatttttattaaaaaaaaaaatctcagagtttattcttattttgtgattaggttcattaagaagacttgacaattgtgaccaaatgtgtgtgggtttctccccacatattaagcagtggacaccagctagatgtcttccaattcagttccaacaccatctactcagagataacatcagatccgacaagtaaagggctcagtcccacaagaccaccctctcccctccccaagttgcaagtcccagcctccagaacttctaaccaactagtttccagttggagttcccacaatcccctctttgggtttgattaatttgctagagtggctcacagaactcaggggaaccaatacttacttgtaccagtttattttgaaggatattttacaggatattaacatccaaatgaagagacatataaggtgaggtctgaaagggtcccaaatacaggagcttctgtctttggggagttggggtgcactaccctcccagcacgtggatgagttcttcatctttctgtcaaccttcatatgttcagctccccagaagttccctgaaccctgtcctttggggcttctatggagacttcattgattgtccatgattgaagaagggacaaccagttcaaaatgtgattgcacaaaaagggtgtgatctaaacccagcagttcctgtctattcagattcttcttggtcattctgtgcagcattccttcctccagagtatgcagcaagaccctctctggaatgaaggtctgataacccatagtcatattagagtcctgtcttcagcaagtgagaggagggcaggagaaggttagagagactgtttcctgaggcgtgcttccaaggcctgaagcacctcagtattgtaacaaaagactataacaagagttgtgagagttacgagctaggaaccatggacaaaaacctaatcataatgccacagctagccatgcaattattagcttcttccttaaatacaggagctacacaatttccttctcctttctaattgataaatctataaaactagctgtcattcataactccctccattcttcagaaatcattgttattctttgtgagtctcctcttggtttacaaaagaatactccattatggaatacctatgaatacttatggactgtaagtcttcattaggggtggataggaggaaagagcgcacagtatgagagagggctttctaagattattgaaatgaagtttagaatttgaatttattttttttttcagttcaggtttaagacataactacttttgtagaaagcaaaaaactcaacgttcttcttaggttcattaagaaaccgtgacaattctatatttcttctagaggagtattaagatatcttttggataagacagaaacaggaattcctgttaactcctatattttttgcactagccattggtaagcaattgggagtttaaccccttatctgctgtggaagaagcctttgctcacattagcatatattccaaagaaggaaaaaggaaaatttttttacatttagttttcaaagctaatatttgttaagtactcaagaatggatgaagaaaaaatgtataatatatattcttgtatgttaaaatcaaaatattctggtagatttatttaagaaacatttattgagtacctcctaagtactgggcccttcatgaagttttgagaatactgaaataaataaaatatcatttatatcattaaggaactttaaaaagttcaaataaatcataaataaaatagatattttactatatagtagaataaaaaaagtagttattactatagtgtattttgtactataatagagatcagtataggataatacatgagcacagagaagagacacttggtctatgagaatcagttaataagctcaatgtgagtcgatacttgagctaaggttaggaagaagcaggaggagcactatatattaaaaaaaactcagaagtgagagagtatatgatacatttcatgtaccacaaggaatcatatagcttcaaagagaatgatgggacattccaggaaaagaacctgtaaaggtagattagtatggctaagtagtttgtactatatccttttcaatcaaaagttattgaaggattatttgtgctttggaacagtcttcctgacagtgggatagagatagataggatacagaacaatgtgaaattgagctcaacaaatatatattaagaacctatttcatactaagcaatgttctaagagcaagcaatataaaataactggcaactatccagttgcactttatgcactttaatatatgtattgatataaaattatgtagttatatgatacataaaatatctattaatatacatactaaatgtatgcacatatatattatacctcaattttttaaaaaagtgaatggcagtcatttcaagcaatcaaaatgaggacataaattaagcattagagatgagttggggaaaagatttaaggtttatttaggagataaaatggaaagcaggggtgcctgaatgcaggccacatctgaggcctggtaccctctcagatggtgtcctggtatctggaataaattactggattaatggtggtgctgatgactgaaaccaaggatggataagagggtacaaatttggggtagggaaataagatctataattaggttttagttaatagttgtagttacctgtgaggcttataggtgaaaatgccaatggatggttgtaaatttggatctaggcctagaagaagttctgaattggaaagtgtagatatggaagtaatggattttattgtatccttaaatgtggataacatctcccagttaagagtgtataggttgaaagaatatttgaaggacagaagtgggagatggagaaggaagggaagaagatcagtcacttggcctctggagattcagaacataggttaagcaatttgagacgcataggaagagaacttggagaataccaatattttacagaataggcatagagagggaaaaatcattaaggaaactaataaaaactactctacaaggtaagaaacaaattatagaaaaagaatgtagtatcatagaaggcattagaaaagagcttcaagaaggaagcactggttagcagtaccagatatccaagaaatctagtaagatgacaactgagaagccaattgcatttggctatgtggaggttactgacatttatgaaggcagttaagttgagtgggaagggcagattgtagtaggctgaggagaattagggaatgaagaagtaaagacaatataaaccacgtggttaaaagcttgactgtgcagaagataaatagagtgataactagtgaggtttttggttttttgttttttttttctttttttggatgaatgaaacaatgtggaagaatatataacatagcagagagagaggagaaagcctgaacatagagtgaaaaaataattcatcattctcagtaaactattgcaagaacaaaaaaccaaacgccgcatattctcactcataggtgggaattgaacaatgagatcacatggacacaggaaggggaatatcacactctggggactgtggtggggtggggggaggggggatcacccacctagaggatatatttaccagccttcttcactactagatgtgatcatgtgactaagttctggctagagggtgtgaacagaaatcatctgcacaaattctggacaacatcattaaaagaaagctgcctgctcttcacttctcttccccttctcactggcaaggaaatgaggagagcagccattgtgatttgggagagggaaannnnnnnnnnnnnnnnnnnnattgagccctttaacagagctctctcaaggaggacctactggttagcactaccagatccccaagacatctagaagatgaccaactgagaagccaattgcatttggctatgtggaggttactgacatttatgacggcagttaagttgagtgggaagcgcagattgtagtaggctgaggagaattagggaatgaagaagtaaagacaatataaaccacgtggttaaaagcttgactgtgcagaagataaatagagtgataactagtgaggtttttggttttttgttttttttttctttttttggatgaatgaaacaatgtggaagaatatataacatagcagagagagaggagaaagcctgaacatagagtgaaaaaataattcatcattctcagtaaactattgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgccagatgacgagttagtgggtgtagcgcaccagcatggcacatgtatacatatgtaactaacctgcacaatgtgcacatgtaccctaaaacttaaagtataataaaaaaaataataataattcatgcctttttacaatcacattacacaacagccagagtgatccttttaaaaagaaatatttaaatgttaattatatcagtctcctactcaaaatttttcagtgatttctataaaataaaagccaaaattatgaacaaaattagctggacatggtggtatgtgcctgtagtcccagctacccaggaggctgaggtgggaggattgcttgagcccagtgatcctgggagattgagggagtttgaggctgcagtgagctgagatcacacaactgcactccaccctggtgacagagcgagaccctggctcaaaaaaagtaaaacaacgaaagtccttcccatggcctactaaggcagagcctaatctggcccttaccagacagtccatttatctcctaccactctattctctcacagcctttctaccacatgggcttcctgttgtttttcaaatatattcctatttcagaacctttgcatttactatcccatttggttggagtggtttttctttggatattttcatggttttctcccttattgttttcctcctttattgctttcaagggcagtctcttcaataaacagtgctaggaaaactagataaccagatacagaagaatgaaagtagaccctcatttctcaccatgtataaaaatcaaatcaaaatggattaaagattatatataagacctgaaactatgaaactactagaagaaaacattggggaaatgctttaggacatctgtctgggcaaagatattttgggtaagatctcaaaggcacaggcaacaaaattagacaaatgggattacatcaagtaaaattacacaacaaaagaaacaatcaacaaagtacagagacaacctacagaatgggagaaaatatttgcaaactgacaagggattaataagcagactgtataaagaaaattcaatagcaaaacaacaaaaacaaatcaattttgaaatgggcaaaagatctgaatagacatttctcaaaagaagacatgcaaatggccaacaggcattttaaaaaatgcttaccatactaatcattaggaaaatggaaatcaaaaccacaatttgatatcatctcacctgagttaaaatagttttcttgattaaaatatttgacaaaaaaataacagatgctggcaaagaggtggaaaagggagaacactcatacagttgttaataaccaaaagagagcaagagtgaatatattaaatcagagacaacagactttaaatcaaaaattgttccaaactgggtatggtggctcacacctgtaatcccatcactttgggaggctgaggcaggtgggtcgtttgagcacaggagtttaagaccagcctgggccaacatgacaaaatcccatctgtacaaaaaaacaaaaacaaaaaacaccaggtatggtggtgtgctcctgtagtcccagctactcaggagacaggcaggtggattggttgagccctagaagtggaggctgcagtgagccatgtttgcaccactgcactccagcctagatgacagagcaagagcctgtctcaaaaataaaagaacaaaacaacaaaaactactacaagagacaggaaagggacattatataatgataatgggtcagtttatcaagcaaatattaacagttatatatgcatcatatgccagagctccaaagtatatgaagcaagcattgacactattgaaggaagaaacattacagctctatgataatagtaggagaattaaagtattatactttaaacactttaaataatggatagaacaactagacaaaagatctgtatggaaatagaggatttgaaccacattgtagagcagttggacctaacagacatatgtaaaaaccccagcaacaacagaatacacatttgctcaagggcatatggagcattctctgggagaggccattaaaaatgacttaataaatttaaaaagattaaaatcatgctaagtatattttctaatcacaatgaaatgaaactagaagtcagcaaaagaaaaagtgggaaattcacaactatgtacaaattaaataacactcttaaacaaccagtgggtcaaaaaagaaatcacaagggaaattagaatgaatatatattgtgacaaatgaaaatgtaaatacaaagtaccaaaacttctaggatgcagtaaaagcagtgaatagagaaatgtttagctgtaaatgcatgtattgaagaagagagatctcaaatcagtaacttaactttatgcctgaagaaactagagaaagaactaaacccaaaactagcataaagaagaaaataataaaaatggaaacaaatataaataaaaaatagaaaaacaatagagaaaaacaacgaaaacaagtgttgactatttgaaaagatcaagaaatgtgacaaacctttagttagcttgactaaaaaaagagggaagacaaataactaaaataagaaaatgaggacattattacctactttacaaaagttaaaaatatcataaaagagtgctatgaacaattgtatgccaacagattggataagctagtaaaacatcctagaaacacactaactactaagaatgaatcatgaagaaaatgaaaatctgaatagacctttacctagtaaggagattgaatcagtaatcaaaaacttcccaacaacgaaaagcctaggatgagatagcttcaccagtgaattctgccaaacatttaaagcagaattaataccaatcctctcagtctcttccaaaaacttgaacagtatgtaacacttccttacccattctatgaggccagcattaccctgataccaaagacactattagaaaagaaaactacagactagtatcacttatgaatatttgctatggtttgaatgtttgtcgcctccaaaactcatgttgaaatttaattgccagtataacaatattaagaagtgggacctttaagagatgattaggccatgaggtctctgccccccatgggcataattaatgctgctccaaaactgtcagtttggctgctgctgccctttctctttgctcttcagtcacatgataccttccactatatggaagatgctagtgtcttggttttggacttgccagatactggtgtcttagttttggatttcccagcatccagaactgtgaagaaataaatttctgttctttataatttatccaacctcaggtattctgctatagcagcacaaaacagactaagacaatattgatgcaaaaaatcctcaacaaaacactagcaaatcaaatccaacagcatattaaaagaattacatatcatgacaaagtgagacttattcctataatgcagtaatggttcagcatacaaaactagtcatgatataccatgtaatataccacgttaacaggattaaaaagaaaaaacatgatcctctcaactgattcagaaaaagcatttgataaaattcaacactgttttaggattttaagaaacactcaacaaactaagaatagaaggaaacgaactcaacaaaataaagatcatccaacataggaaaaacccacaactagcatcatactccagagtgaaagactgaaagctttttgtctaccattgaaataagtcaaggatatacttctattcaccatagtactgaaagtcctagacagagcagttaaggaagaaaaagaaataaaagccatcaaattggatacgaagaaataaaattatctctgtttgtaaacaacatgatcttaagtatagaaagccctaaagattccacacccaaaaaaaacccacctgttagaactaataaacaaattcagtaaagttacaaaatcagcatgcaaaaatcagttgtgtttctatacattaacaacaaaccatttaaagaagacacaaatatatggaaagaaatcacattttcattaattggacccttgcctttctccatatacaaaaattaaaacagatcaaagaccaaatgcaagaggtaaaaaccatgaaagacttagaagaaatcttagggggaaaggtttatgacattggatttggcagtgactttttgcgtatgacactgaaaacaggcaactaaggaaaaaatagttaagttggacttcgtcaaaattaaaacttttgtgcgtcaaagggcactatcaacagagtgaaaaggcaacccacagaataaaagaaaatatttgcaagtcatatttggtaagaaattgatatctagaatatataaagaactacagctcaacaacaacaaaacctggatttaaaatgggcaaggggctttagagatttctccaagaagttatacagatggccaataagcatatgaaaagatgctcagcatccctattcattagtaaaaccacagtgagatgctacttcacacccattggtgtggctgttattcaaaaaagcaaaataagtgttggcaaggatgtgtagaaattagaacccttatgcattgctagtaggaatgtaaaataatgcagccattgtggaaaatggtatggcaattcttaaaaaaattaaacatagaattaccatatgattcagcaatcctactactcttggttacatacccagaagaagtgatagcaaggactcaattggatatttgcacattcaggttcagaaaagcatttttcacattaggcaaaaggtggaaacaacccaagtgttcataagcagatgaatggataactgtaaggtggtatatacacacaacatagtagtatttagccttaaaatggaaagaaaattgtacacgtgctacagagtagaaccttggagatgttatgctaagttaaatcagtcacaaaagcagaaatattgtatgattaaatttatgtgagacactaagaatagtcaaattgataaagacagaaagtagaagggtagttgccagaggttgagagggaggaaggaatgaggaattactgcgtaatggatacagagtttcagttaggaaggatgaaaaaagtttctggaggtagatggtggtgatggctgcacaacaatgtgaattttttatttgatatatattttaccatatttttaaaaactctattacaaaaaaaagaattggtctagcctagataatcttagtagccatgttttattgctattcaacttgtcactcatcaatttatataaactcaccagccttttaccacttagctgtctatactccacatcagttcttctctcagtgtttcttccagttcactgcaatttgagactcagaagtttttctttgagaagtcagtatgctgtatccattaaggaacattctgttcaggaaagacatctaagtattccaaattgataagggaggtaaagacaaaacagataagtgatttttaaaatattattggcttaaattacgaaagcaccacatgcttattttttttaaagtaaacaattcaagatgtacaggatataaagtgatagtcctctccctcactccccagggctatccattgttagtaattgggtatatatcctttcagagtatgagaatcatattttttcaaaaatgcaagcatgctaatctgaaaaaggttttaaatgttttaatgtcatcatcttcatcactaagatttgttgaggtttgtttgccagagagctttacagttatttaatccttgtataaatcttatgaggaagtattattttcattttttggatgaggaaaatgaagtgagagagatgaagtaacttgcccacaaccacatagctactaagttagtagaattagtagagctagaatttgcaaaaaatgtttgaccacaaacttcttgtctataacttctctgccaaaaattgtcaatagtctttcaggtttgtacatataaacctacctcatatcatgaatacctgacaataccttgtactacccttccttcttaaaacactatttttcttttttttgagatggaatctcactctgttgcccaggctggagtgcagtggcgctcacttggctcacctctgcctcttgggttcaaatgatactcctgcctaagcctcctgagtagctgggattacaggcgcccaccaccacgcccagctaatttttttatttttaatagagatggggtttcaccttgttggccaggctggtctcgagctcctgacctcaagtgatctgcccacctcagcctcccaaagtgctgggattacaggtgtgagccaccatgcccagcccttactttctattcttacatgaaccttctcattttttcctgtggcttgagatatctgtgacaattaactcctaaatttatattcctagtccagacctgccctctgaactgtatacccatttgtatcactgctacttggaaggcatattaaactgaatatccagacctgaacttacatattcaccattttttctcacctgtaccattgcaagagagtaatgagtttaataagctgctgcgtggaataatactaccttttattttccctaaatttacttcacataaatttcaaaggataatctctcctcttaccactactagtgtcctgctactgatcacgaagtatatttattttacctggcctctaaattgtgtttttctcttttagttctagactaaattttccattgttatgcctaggccctcttgccaccatgctgttaaattgttttttttagaacctctagtcttaaaacatggctctttttagcttatcctctggtacagccctcattctagaccatactaaaataccagacaatttcagatacatggaagtagcgcactaatctcaaatacacagaagcagtcttcttcccttcaacatttaaattcatattacttcataaataagaaaggaaaattaacatttaatgaatgagcgtattctacaggtgtcacagccctacaaaagtagacattgttagctttattttcaaatgaagaaacctagactcagaaatgttgattttccaatctaagttgcagaatctatactgaaactaggtttatcagaccgaagaccatattcgttatactaacctagctaagtcatagctcattccaggttttcaaactgttttcttcccattgctatgaataacttaatatagtctcctctctccttggatgaatccttactttgtgatttatacatctctttttagcaagagaggctagagcataaagtttgctatgaatatttcctttactcatccttcaatttatcatgtgccagggacatcatatatgctagcaattaaaagatagagcattcacttaaagggttcacagtcaaatactgcttattccatttcttggcatgtgtaagcattcatacatacccacactaagaggtcttctgttcattccaaggtagaggaatcttttaatcacaatagcctctgaccagacaacttttactatgcttacagaataagacaaaagattattatggagagtatagggtggtagagttggtttggcccctgaattggttattatataggatacgctattacagagagactaagaaatacagtgcataaatataaaagttgacttttgtctgtgcttggcacaaagattcatgtgagtaatcccagcgctttgagaggctaaggcaggaggattgcttgagcccaagagttcaagaccagcctgggcagcatagcaagaccctgtctttatttaaaaataaataaatagataaataagttctctcttttgtagcagtccacaggtgactagaacagggctagtaaggcagctctaccattcttaaaatatggtttccctctcccaaatcacaatggctgctctcctcatttccttgccagtgagaaggggaagagaagtgaagagcaggcagctttcttttaatgatgttgtccagaatttgtgcagatgatttctgttcacaccctctagccagaacttagtcacatgatcacatctagtagtgaagaaggctggtaaatatatcctctagctgggtgaccatgtgccgtgttaaaactctaagaaagaaagaaaatggatatggggaataattagcagtccttgccacatcttttggctgactacgccaaaattgcctggagagtttcaagtatcacaagactccataatatggaattaaatatttaatcagtttattactcataccaagttacttgtcatcaatttctgccactgttccatgagagaaatttctattgcttctttgaccatctttccaagagtagaatcagtaataaaataattaaaacatctgaaactgttaaaactgatagcaatttacaagtcagattaccataatcgtaaatgattaggttatagaaaacctgcagctggcctctcctgcttgtcccaagattctttgtattatgtaattagaaaatagaaatctctttgttgagaagagaaatttgaaatggaatttttctcttcttgccccctcttgattaaaagagaaaaactgacaaagtcttacatagaaaggaagcattctccttaattctaaaattattcagatgctatgatgtattaactgctttttctttgtaccgagaagaaaagtgaaggatacataatatttaaaaccatgcaatttgctaagcaaagagtcttattgacttgccagtaaggctgaagagaaggcctaaaataagagtaaatttgactgtgccttgtctttttatcataagttacagatcttctctaatgtttttctgacaataaatgttaagcgataaggaccgttttgttgtcagattgctttactcaagagctagtcttgacccatgtgaaatgtaaacctttagcctaaggcttatgctacctctaaaagcttgtaaaacatattttaaaggattgcaaacggcataaaatacctttattgtaggtactgtgttaaaaaaaatccttcattttcacataaaatgtaaatggcctcattattgtttaccactcttttttttatgttttttttcccccaacaacatatatactctatccaaagtgttgatggggtaaagcagttcattctggttttttttcctaatgaagctactggtattagaataaaagtgctccaggtagtttctgatcaaagctttatttctttgttgtacattgtcagtactttgccagtagattcattttccacgttatcagaatggaagatatttgtatcctttcttccaaggttttacttccagaaatatgtcgtgttaaaacttttagtcaggtatgtaggatatatgttcaaggagattggttaataaagaattaatgatattcattcaaaaatatattgagcagctactatgtatccggaactgcactaagtactaaatctacaatgataagcaaacagacatgcttgcttcctgcttcatggaatggtggcacagtctagtaaagcagagactaatcaaacaatctcacaaatatagcttgaaactctgatcaaagtatcaagaagaaaggtaaattgctattagaatgtctgttggggacttgacctaatccagcaggtcagagaagattatcattatataatgatttttgaaagggcaggtttggagggctttttaagttcaaggacctgcattgtaaaacccattggcctaaaagaacttaaagtataagggaaatagtgcaatgagaagagtcaggggctcttagtagggacttggagaccatattaaggactttcggttctttattctaggagcgtaaggagccatttaaggttttttgggggacaagggtgaggggtagggaaaaagtatggagtaatatgattacatgtgcattttgcaaagaacacagtggctactagagaataggctattgcagcagtccattaaggatgtggtaatagatttaagagatattaatagttgagattaaacttgatacttggggccaggcgcagtggctcatacctgtaatactagcactttttttgggaggcccaggcaggcagatcacttgaggtcaggagttcaagaccagcctggccaacatggtgaaaccctgtctgtactaaaaatacaaaaattagccaggcgtgatggcgggcacctgtaatcccagctattcaggagcctgaggcaggagaatcacttgaacccaggaggtggaggttgcagtgagcctagatcacgctgctgcactccagtgagcaagacagagctccgaaagagcaagactccatctcaaaaagataaataaaattgatacttggtaatggattggctgtacaacaaatagatgtcaaagatggttacagctttctgtatagataagagcaccatatactgagaaaaggaatactagcaaagaaccagacttttggcggggtagagaggagagatgagagggagtggtaattgggggaaatcatcagttttgaatattctaagtgcttccccaggaacagttggccacatagatctatagcttagaagagagatctaagctagaagaaaaatttgagctactggcatggatgagattacctaggaagagaatatatagcaagagagggcctcaggtgagctagaggtactaatacgatgtggcatagtggttagttaggggcttgggctttgtattcaggcaagcctagattcaaatcttagctctactatctactgggaaatcttaataattaagattaaaattgatacttgggggccaggcgcggtggctcacacctgtaatcccagcactatggcaggccgaggcaggcggatcacttgaggtcaggagttcaaaaccagcctggccaacatggtgaaatcttgtctcttctaaaaatataaaaattagccaggtgtgatgcgggagcgcttgtaatcccagctactcaggagactgaggcaggagaatcacttgaacctgggaggtggaggttgcagtgagcctaggcagattattttgtacctctttaagactcagtttcctcatctgtaaaatgtgggaaatagtctcctgggaaggttggtttaaggattaaatgagataaagaaaataaaactgattttggtacatagtattaaatgaaattatcacatgatgataatgtgttgctgagttgaaaaatttggttgcggaatagttctcatttgtaaaaaagtgtgatacgtatacacacatgtatacaggagttctgaaagggtatataccaaaatgtcaatagcagttacccttgaggaaaaatggaaggcaaagtaagggatgatactgccatgttttactttgtacatatctgtacgtacttgtacattatttttgttctgttggtggtagtcgtcattttgttatttgaatttttcaacaaatgtgcgatttttataactatagccattaatctttaatcgtttagtccattttgtctctttgtaaacttcgaacaatcaggtgttggttttttgttttgttttctttgcttgacagaatgtttttgattcaatggagataccatactgatttctcgtgaagaaacacctgaatcctaggttacaacgaactagaaaaatgactgagagatctggcttcggtgataaccagagcttttgttcataaacatgtgctacatgctctgtgtcttagtccatttgcactctataacaaaataccttatacaaggtaatttgtaaataatagaaatttatttctcacagttttagaggctgagaagtccaagatcgaggctccagcaggcttggtgtctggtgagggcccagtctctgtttccaagatggcacctcattgctgcatcatctagtggagatgaacactgtgttctcatatggcagaaaggatggagggcaaaaaggactgaactctgtgtgaagccccttttataaaggccttaatcttattcatgtgggagcagcccttataacttaatacctcctaaaaggccccacttcttaataccatcacaatggggattaagtttcaacatgaattttggtggggacacacattcagatcatagcatttcacccctggctcccccagatttatatcctgcacacatacaaaatatatgagataaatgcacgtgatacacatttattccatcccaaaagcccccaaaagacttaccttgttccagcatcaactttaaaatctaaagtttcatcttaacactatctaagtcagatacggagatgagactcaaagtacaattcatccagagacaaattcctcttcagctgtgagcctatgaaattatacagttatatgcttccaaaagacaatagtgggacaaacaggatagatattcccactccaaaatggagcaacaggaaagaacaaagggctaacaggttctaaccaaatccaaacacctcagataaacaacaaaaaactcagtagggcaaacattaaaccctgaagcttgggtgtagtcttttactcccatttctcattttctggacacactggggtggaagttggacccccaaggctccaggcaaccctacttcatcacattgctggctgcatttcttgtgtgttggagttgcatgcctttgggtctcccagcctggagttgcaccctggtggctctactggtctggggtcttgggatggccctgcctgggcaactccactaggaattgccctgatggtgactctctgcattggcctcactcccacggctgtggatattatttagataccttgctcattgttaaaaacaggaactaatatttccaatgagcatatcgcgagacaaatactttatatattctgtgtctttcaatccttcaggtaagtataattttcatttacagaggaagaaaccaaaagctcaaagaggcaagtaaattaatcaggaccgaaacacaggattgtaaaataaaaatagtttgtcatagtttaccatttggcatgctgagaaattggtggcagcactgtcacctaaaagtagataattagattggaaatctgatctgtcaaattgcagatcttctagataaatcttggtactggagggtgggaacgtacagggcttataacctagtaggcagaaaatggttgaagaaagacttgtgtaagccaggatctctgggttgctgatcctgtttgatctcgtactatttaaagaaaactcaaaattgaagttgattcttagcttaccaaaatttcaagatgtattttaattagattgtgtctaattagtttctatctaaagtgctatgtattaggataattaatatttaattatcttccttcatgaactgtagagcttcctatggagagcatttgtggtagccacgcaaatcctttagtaaatctttcattctctttattaaccttggaataatttgaaaggtttttgaattgggactatttcttttttttttcaatccactcaacatttattaaattccttaataaatcattggaggaaagcagtgatatttttgagaatattgcaattaattattgaggatgagaagaaatgtttgacttaggatattatagataacttaagggcacttaaactttttttcccctatgtaagaaataagtgccttggaaaatacaaaaaaaaaatgttcaataccagcaataggaaacaattcaatttatggaactctattttaatatttatgatactcatggaaatttaaacatctatctacagaaaattataggaaatatgctgccttagttttgaagaggaaatactgaaattttgcctggataaaagggcaatttttaaaataaactttttgctttgcttatcataatccagagtatgggcaaccatttttgataaatttaggatgtgtgctatatttgatcaccagtgttttaagttttacttttgaacactaagaaagaatacaaagttaaccttatgggccaggcatggtggctcatgcctgtaatcccagcactttgggaggccaaggtgggaggatcacttgagcccaggagtttgagaccagcctgggcagcatagtaagaccctgtctctatacaaataacataataataaaataaaaaacaaagtaccttatagcacaagtacctaagtacctgtttacctctttagatgctggtagaccacttgttttgctagtctttgaaattggaaggagtgtcaaatacacagaagccagagtcatcttggccagatggtgtttgatacagatggatggttagttgtcatgcagatctcctagttggtaacttgttgctgccatctgactcaaagaatcattcacacacactggctgtcaaaagcatcttcttttctgtctgttttagctgtcatgtctgtgctctgtacagaagtgttgacaagacattgctgttgtacattttcaatgtggttgttagtgagttttctgtttcgtggggtctttgatagtgctagaatgtacttgctttgtaattgtattttaaaaaaatactatgactgtgcaacaataatctgaccttgtaaaaggacttttctggttttaagtttaggcagatatgttctgtgaacaaaagcatttaatcaaatgaaaaaaaaaagactagtttcatttactttccaaatagcaaataaaccaagttctactggttatttcccagtttgatgtaatatttccttttggtctttccctctcatagtctgtggtcaaaatctttgtacttttttctgaatatgcattttctcaaattactaccttttttctaacggtataagcttccctttttaaaaaaaagaatcttcaaacattacctatcttttgcatccgttttctcaaacttagtttccctttgtcgtatttacctactgaccttgtttctgtttttagtgtttctagagaaatataagcaaaagcattcctccattccttcagatcatttctgaaagcatatctgttcctctgatatttcttttttttttttttaagtgaaagcaagtttattaagaaagtaaaggaataaaagaatggctactccagaggcagagcagcagcatgggttgctcaactctgatatttctttaacaagttaattagtttgtttattcaactaatatttactgagcatcctaatatgtgccaggcactctgtaatactctggagatatcaggaggaaatactctctacccttgaggagttcagtctagagggaaatcagacattagacaattagactagaatattataactgctaaatacaagtatgtgaaaagtgtaggaggaaaacatggactcttgctgttctgtttcccttactatacttccagagtgttggtttttaaaattattgtagactttgctcgacctttataatactttattaagtagcttaagaagtagttaaaacttcaatttgaaatagccattgatccattaatttttcttagctattgaatacattttcaggattatttatttattgtaatatcttatatgcagatgtgctaaagtatgttttttaagccagagaatagaagataaaaattaactggcagaagctttctgagttggtttcaaaagaaaatatatggtttcttcattaaggtgggaaaaaaagacatagagacttaaataacataggcatttattctgcgcctgtctctaacttgctaagttttttggactggttacttaatctctggacagtataatgtatatacctatcaaaataaagtgaaaaaaataggtacttattgattgatgtttgtgaagaactttgagttcttggagaaagctttaattagcgcagaaatatatagagaagactgtaacttgtttgctgattcttcagccctggtggtgctctgtagcccaagtaaatctaaggtatttagaatttgctgtagatttttggatccttcattcagtcagcttaccacactgtttctagggggttgggtgtgaatttatacaggaataagatgtcttatcctgggaagccaggccctagactagacttgggtatcagtgatcagttctgagacgtattcattggacatgcacttcaggtagacctacatgattcattcttctgttcacaataataaaatgtaattggaatccgtatttccttttttaatttttcagtgaacatatactgaacatctcctatgtataagttacttaatccatatgaattctgtggggaatgtgaaactatgtaagactgcctttaggcaatgtgcaaagacaatgtaccacatgggttgcttatcagctttgtcagttattcatatttggagtgtattacttataaaagttcacctttcatttgggaaaatgtagtatttagctctaatttctttttttttttttttttttttttttgagacagagtctggatctgttgcccaggctggagtgcagtggtgtgatcttggctcactgcaagctccgcctcccgggttcacatcattctcctgcctcagcctcccaagtagctgggactacaggtgcctgccaccacgcctggctaattttttgtatttttagtggagatggggtttcactgtgttaaccaggatggtctcaatctcctgacctcgtgatccacctacctcagcctcccaagctttaatttcttaagctaatttatatttgctaatctatgaacagctatgtaatttattaaaatttttaagtttattggtctctgaaaataatagagcttcactaattttgaactttaagaatcagtttaaagtgaaatatctagtatctactgaagatcattctgagattattagaacttcattttcattttatatttcaaggaatttgcaacttagtcattatttatttatccctccagggatagaaattggttaaaaaaagagttctctgctattgtttggtgatacgcttttaagactgtactaatttggtaattgtgatacaacagtttcaaatttgcttgaatgtttgcagcatctgtattcctcagtacaaacttgtgtcttttttcattgctttattctcacagtcactgcaataacatagcaaaattaatggattaacaatataagggaaactggcatttaagacaccaaaggtcaactatattctcttaatttcttaaaacttagtggagaagtttctggtcagtataattttataatttgcatttgtccctttgatttgtatcaacacttccttagtgtttgtgtactctaaaaataaatttagaagtgtgtttatttgaaagacacaaaatcttaattttttaagttagtatgtatttttaaagaatcactttaatatagcatctgttgtatcatttgtgcttttttttttccattaaggaataaatgctaaattacagttttgatccttactgaaggatcaggaaatcatagattgaatccttgactgaaatgtctttaaataagttaatctttaaaacttctgcggtgctttaagtgtcttaaatcactgatgtttgtaacaattacaagtacattcctggagccagtttgtatctcataaatcacaatacctgcaaaatgacaatgtgggcaactcatatctatttatattatcaatggatggtaaatatatgttcatgtctatcagtgaatatcaggctaactggtttttatgtcagcagactgagaactatgagcagagaatacgtgaacaacaggaacagctgtcacttcaacagactattattgacaagctaaaatctcagttacttcttgtgaattccactcaaggtatgttcatgttaattttttatgtatttctagaacctcttggtgaaaagaaaggtgtaagttgagtttttctattttattccttcgttgtttctcaatagttttgatattataactgtggtacagttatatgttatgtttatttaaatgaacacttgcaggatatgggaaagtggactttcacatatactatactatatggtagaactctaagtttataaaacttcctaaaaagcaatttgccagtaaatagcagcaaaagcttttgaaaacatctatgccttttgaaccaaaaactcaagtcctaagactatatcataagaaaatatttgttcaggtactcaaaaatatatatgcgaggatgtgtatcacagtataatgtctaatcatggaaagctagaaacaaatattcagtagttacactgatctatatgaatagctatgtagccaagaaaagtgatgataataggtattaacttgtaagaatatgtggacgatatatagcaaaatgaacaaagcaggatacataaataagtgtttttttcatttatgcagaaaaaggtgattcttgtgtgaagttatatgtataggaaaagaagaattctgatagaatatataaaccaaaatattaactggaataattcacaggtgataaaaatttgggtagcatttactttttattctttttggctgtctgcattttctaattttcccataataagcatggagtcataatacaaataattatcttaaataagaaacgcatacctgaaaatgtgaatataaaagttgaattgttgctgacagatgcaaagagcatatttctagttttctaaattctgcatattttacatactgctggcttttggagagcaggggttttgtgtgtttgtttagtgggaaggaaaaaatataaatggacaacttgtcaaagtaactattacctaaagaattttctaaaactcctaccttaaaatgtattctctttatggttttgagtttgtattattttttgctttttcaggtggtaccaaaaataagggttttctgctaatgtccaagaggtttttgtcttgcagataacaattatggctgtgttcctctgcttgaagacagtgaaacaagaaagaataatttgactcttgatcagccacaagataaagtgatttcaggaatagcaagagaaaaactaccaaaggtagacattgcttctgcagaaagcagcatttaaatgctgatgcgtgacatagcttcctcattttatttttctgaagtgatctgctggaattccaaacagaagttccatatatacaaatatgtggcttaaatatttctaaatagaagaactattttcaagtaaaataaaggctgaggttttgtatttcctactgaccgtttttctacatcacaagcatttcaacaaagaaaacatttaacaaagaaatagggctggacacagtgactcactcctgtaattcaaacactttgggaggccaaggagggaggatcacttgagctcagcagtttgagaccagcctgggcaacatagggggatccctatctctataaaaaatgaaaaaattagccacgcagaatggcacacgcctgcagtcccagttactcagtaggaggattgtttgggcctaagaagtcaaggctgctgcagtgacccatgatcatgacactgcattccagtttgggtaacagagtgagaccctatctctaaataaataaataaatgaattaatgaatgaatgccacatacatatgtacatatatgtgtgtgtgtggtgtgtgtgtgtatatatataaacaatgaaataaaagattaaaatcaggtaaataataagacacagattagataatagctttctagctttttcttcaatagtctgtgcttagtttaaaagaaaaatacacccaactagcttaagcaagactctattgaagtaatacagaaagaaatagtacatatctgcaaggagacatatacaaggacgttcatgccatgggttagaaacaacctaaatatccaccaataatagaatagtccatctttagaaactctttagaaaaattaaaatatactaaatatatattaatttgcctaaatttcaatagcaatgttgagtaaagatggaaattacaaaatgataaaatgggaatactttatgtagtttgttgttgttgttggttttgttttgttttgtttttggattttttttggaaatgaagtcttgctctgtcacccaggctggagtgcagtggtgcaatctctgctcactgcaacctccacctcctgggttcaagcaattctacaggcgcatgctgccatgcgtggctaattaggatactttatgtagtttttaaaacataacattaatgtttgtgaaaacacaaatatgtaataaaagtataaaaacctgtacaggaagggcacacatcttctttagaaaaacgatcacctctagaattggggagaaaagagactgtgatatctgaaaaaggaataatgagggcttcagcagttatatctgcaacttttttttttaatagaagagagccaagcaagtatgcaaaatgttaacacttgttaactcagtagtatatgtatgtatattatattgttctccatgttttcataagtcattgaaattttataagtttgaaaaggatatttttaatgagatgagttggcttttagtgggacgatacatattttgaataaaatacgaactcctagcaaataaggtttcttaacatcaacaagaacaattaaatcaagagtgctatatttatttctttccttctaaataaagtaggagattttcactttgttagggttattcagttactgattgcataactaagactatcttactatttaacatcaaatctgagaaatccaattttgagagcttttttctataaataaaaattttagaataagaagttctcttggtaccccttagtacatatatttttattttaaaccattctttgagtcattcagttttcttcacccccattcgaattttcatttatctaaaaatgctgataaacacagaaaccatggcaatgaaatatactaggtttattttgcaaaagaggaaattgagaaacaatgattctgactttttggaatgcaatttttttactaggcctattgtagtacattataaaattgttgaattactatactgacataaatttagtgcttaaataaacaatatttctaatcttcctctttcaatgtcttccaaatgccattacttaactgcaaatttaataataatttatagcattcctttgaaagtaatagaatatctccagtttaaagtatgtagaaggtagttttgaaaataaaaccttggttagaacaaaagggatgatgtgaaaagttctaagatatagtaatagttttgttttttttaatttggataatttgttatttatgcaagttttagagtttattttcagtcaataagtatcaaaagcagaccttcaatggaaatctttttaaaaattatatttgtttaaattctgtaagctaagtattttatctgtgaaatatatatttggatacctgggatgaaattaagtttaagtaacagaaatcatttcagagatagcctgtgtgcaaagagtgaataatattacatcaattataactatatttttgggcagacggtaagaggaaaagctccaagtaaggaataaacctaacttcagcgagttctcttaattatctttactaataggggaaaggtttatgttttagccacatttttatactttgaatagttcatcaactcaattttctttgtaaccatttaataaaaataaaaattaactgtcttgcagttcagctttctctttttttatgtatctctagccaaagtgctaatgagcactaaacgtataagggattaaagaaaagagaaaatatattgtaaaagaatggataaattagatttattgaatatttgagagttggctgtgtgcttagtgtaaaaaattaggcctatgttagaaaaaatactggcccatcaagcaatggaaattaaaatatgttccattggcctatgtgttgatctatacttagtgagttataattcacctttagctaatacaggtgaaacctttcctaaagaactctgaatatatggttatattcaagcttcttccacaatgaaaaaaatccatgtctgttgcagttttttaaaagtatgcacccacatggatgagaactggaaggcattatagagaaatggttaaggtgatggtatgattcttttttattctatttttaatatactttaatggtcttctgcaaaactaacctatttctagaaatcacattcccaatcaattggcctagcttctataatgaattagtaagttaatagaaatgctttgaaccagtaacagaaggaagccactacgagccacccacagtgctttcctccttctgtttggtgggtggtttgaggatttgttttctttagacaatttgttttgtttaggattttgttttgtcaggatgtttgagaagggaaagacttgtggacattttggcaaatagccactctggctgccttggaaaaaagagacacaaagtagaggcaagagggatatttgaaggggaaagaggcccttttagaaaattttacttaagaaacatgaaatttatagttcagtctctattcatgttattcctacacaaaaagaatgcaaaaatcctttgacttctaaagggacagaaagaggtaaagacaaagcctctatcattagatgacccttagtactctgcttgagacagtagggaaggaaatactcagtttaatggaaaaccttagttttgtcttttgtacaccacagtaatttgcacagtcctttgcattatctatcatattattccagacttaccccaaaacttagggcttagaacgacaaatttacctgagtttctatgggtcagaaattcacccagtgacttacctgggtggccctgactcagggtctcttatgttgaagtcaggatgtggacaaggactgcagtcatccgaaggcttaactggttggaggatccacttccaagatgagtcactcacatgactgttggcaggaggcctttccatatgagcctctctgcacaaactgatagctaacttcactcaaagtaagggatctgagagagagaaaggtgccctctgtgacgtagtctcaaagtcacattccttcacttccacttaattttgttcattagaagcaagtcactaagtagtggggcaagaaattaagctgcaccccttgaagggaaaagtatctaagtttcatagatatattttaaaagcaacacaggtattgtagattgtggtgtacagaagaggatgtgaaagatcaagagacaagggggctgatacttaatttaccttatgacaaatattgatgaaacgtaagggaacttaatattcacttaatagtgaattaaattcctgaattatgtgattattaatcctaaagggaaaaaatatcatagcctgtcatctgaagaacaatttcaaaaattctaatatgaatatactttccagaggagaataatagcaatgcttagagaactaagaaattgttgcatattactaattcttttttataatgttaaaaactgaaaatgcagataggaaatcagataacaaaaatgcacacaattattcttgacaaagactattcatctcttgtttacagaacaccattttcagacatagtaacttatgtccatgttagcagttactatttaaataacaagttttgtatttgtgtaacaaatataaagacattctataaaaatacaaaactataaattgtcagtttaattcacttttttaaaaaccaggattgtaatgtactgtgtcacttatataatctcagaaatgagatttttataatttgcttctgggaaatagtttggttgccaaactaaatactatcttgagtgtctaggttttgacagaaattgtttgccctcatctttctatgctactttttgttcctgtggagaattatacaaaattctccggtggtttgatgcaagaaaatatgtagaaagcaataatatagaagacaaaaaatttggtgatattggtaaattatttttcttcatttatccagtaattctgaattcatgatgtatacttaacactgccaaccactggagagcaaagagatgttgtccctgtcttctggcttaaagtcttgatttaataattaacattattgaatgttgaaaagttatttcagattctaggatccaaaatatgaagtgaacatggtatgagttcactaattaaatagagtttatgtgttctcatgtctatatatttctaatttgttctttaaacatgtctttatttttcatctgagttaatcaaaaactcaagtaaatgacgagtgcagttactgaaagatgtcagttaaacagtttgcagatttcgaatatagctatcattgtgattagatcagcagatatggtggctttgaggaacaagaaagattttttaggtttagaatagtataaacagtgatatagctgtggagctggcaattgcaagcagtaagatgtgctgtacctgacaacttcaagtaaatatagaagctctgacatatttgaagaaagctgttgtctaaaaagtcatttgtcaatcacttacacaagaagtagttattgaactcctatttgccaagccttgctagtcattaacagaaatacaaaaaacaaaacacagcaatagcaatagtattgtaatagacaacatctatcccctttaaggatatagtctggttggggaaatgacaatatggagacctacagcaattagcaagcattataaaataatgtaaagtcctaattatataacaaaatgaaaccccgtctctactaaaaatacaaaaattagccgggcgtggtggcaggcacctgtaatcccagccacttgagaggctgaagcaggagaattgcttgaacccgggaggcggaggttgcagtgagctgagatcacgccactgcactccagcctaggtgacaagagtgaaactccgtctaaaaaaaaaaaaaaaaaagaaattctaactataattttatggcacagataaaacatttaggaccttaatttaaaaattaaaattctcagtgagcttaagataggcttgatcaagggcccaaagtttaagttcaaatacagaaaagaagacaagttcttacttgcctttatcttggttatgtgtgcatagataagtaaagttaaattttctacaagactttgatggaaaaaggataatttctagacaagagccagaattattctaggtcacttgggagagaatattatgtatgtaaactgaaagctaaaactgagggttttgaatgagccatttcatttaccataaccatttttagttgacataatcatggcttcagaggagaaagtgctttctacctttttcttaactttattctatagacagtccttcagtgagcggcatttacgcatggtctgcttcttcaattatgtatagcagttttggcaggcagtacatgaacttgaactctgttttgctttctgatcttctgtagctaataaaatcctaatctcacaggtctaggtcttagatggcattcccatccttacactgttcatatcttatatacactggacttcaagtgcagtgcccacttagggatcttcgtctgagttttgggcccctgtagcttctctcaacactccagacactttctgttgcaagtcccttaatccacatttgtttgttaagttgctgtatgttgtccaggtacctggttttatattcattgtaaaagctttaaaatggtttataggtaaatgataaatatgtttttcatcatttgaacaaaagctaaaaattaggccgttagtcaacatatttagctactaagtgatttctatggaaaagccaaatctcatttacatcatctaaacacatagcacctcttctaaaagaggaacttgaaataaatgtaattgcatgtgtttgttactcaactttttaaaaatttgcccctgaattcctttaatgtttaatcttttctatcttttatcatacagaaatggtgattatgcacactgtacaatggcacaggccaatgtaggctggggcttagagaactggagaaaaacgtgtttgtgtgtagtacctcaggtactccttgccttgcagtccaaagcaaatgtaccgcttctcctggttttctttctagaaactgcattatatataccctatttttatatataatgcttctgtattactcctctggagactagccttttttatagactttctggtagaatgttaattagaaaggaaaataactatcttcaaccaatttattcattaaaagttcagttttttccaaagagtcataatacataaactttttttttttttttgagacagggtctcattctgtcacccatactggggtgcagtgacaccatctcggctcactgcaacctccacctcccaggctcaagtgaatctcctgcctcagcctcccgaatagctgggattacatgcacacaccaccacacctggctaatttttgtatttttagtagagacggggtttcactatgttggccaggctagtctcaaatgcctgacctgaaatgatccacctgcctcggcctcccatagtgctaggattacaggtgtgtgccactgtgcctggctgatacacaaactcttaagaaaacaaatattgatatccaaaacattttaataattacattgaaattttctattgcagaaactgtgtttccaatctaaattattaattaatcctaaccctttcctgctctgggtttgtgtttttgaattcagtacatcatcttacagtttttgcttttgttaaaatactggaaataattttgaggaagaaaagaaaataagaagtgatatgtcaccttctaaattgtctttcctaacttagaagcaaattcgaatgtctctagtatggcttttctctccttatttcccctatcatcccttttctcacacttctctttatttaaaacttgtcttcaaagcacacaaaatagagtcgataagagtctatccagccctgatttctcttggccaaggaatgaaaggctgttctctaaaccttgataggtaaggaatagccccctgtccacctccatcttagtctgtattgctgtaaaggaatacctgaggctggggatttataaagaaaaaaggtttatttggctcatgattttgatatctgtaaaagttcaagattggacattgacatctggcaagggccacaggctgcttccactcatggccgaaggcaaagaggagccagcattgcaaagatcccatgatgagagaggaagcaagagagagaggggaggtggcagactctttttaacaaccagttttctcaggggctaaaagagtaagaactcactcacctgccatccttacccccacagcccccaggatttctctattcatgagggatctgcccccatgacccagacccctcccattaggccccacctccaacattggggatcaaattttaaaatcagagttggaggcgacaagtatccaaactatagcacccacaaaccatctagtttatcttattattataacctgtcatcctaaaagttctcaaaatctggctgggcgcagtggctcacgcctgtaatctcaacattttgggaggccaaggtgggtggatcacttgaggtcaggagtttgagaccaacctggccaacgtgatgaaaccctgtctctactaagaatacaaaaattagccaggcatgatggtgggtgcttgtaatcccagctactctggaggctgaggcaggagaatcgcttgaacctaggagatggaggttgcatgagccaagatcacaccactgcactccagcctgggcaagcgtgagactttgtctcaaaaaaaaaaaaaaaagaaaatttctctaaatctgttttgaaggtttttttttttttcagtgttatgaaatgcttctacattcaacctgctgttattttttttttttttggttgaattgtatgatgaaaattcagcctcaaatagatattgtatttgaaaaggggaagagtattttaatagcttttttagcgattgtggatagtctttgatactgcactaaaacttggtagtgtcttaaaatgttagctgcaatatggaatctgaaagcgtatcaatgaacttttctgctacattaaaagctgttggtctatcttgtactttgagtatgtcttttactaatgtatgattctgtaacatcatgaatcaatcatttggaaaatattggttcactaagttatgtagatcttgcaaatgttgacctattatataatatttttaaatcacatttaacatcatcactgattgcatcagaaaaatctttcaagtattgggcatctgtcaagcttactgtgacaggtacaggtcttccaaaattttaattttcacttgaaagctcaaattttatcattggcaacaaatcttgtctgttgctttccttaacatgacaggctaacttcatttgcttttgagaaaatgtctgaataaccatagcttgtgtgtcagtcattctttcaagcaaaaatggcattccattagaaaagtaaccagtttacttgcaactcaaatagttgcacaagtacttttccccaagacaataattgtacttcagtatgcagcagaagtccttttgtgtatacttcccattttgtcacacaaaatattaaaaatatgttgagatcaagtttcaataaaagtaatcacttttactgccttattaaggacattcttagttgaaactgcctttttttgctggtttttttttttttaactgagtgtgtgacattaaagaatacagtgacaacagtttgatatggccttagtcatactcgggcaccagcagttttattcattgtttttgcatcatcagtctaaatgccaacacagtaaaaaatgcaaatattaataatatcttaattgtgacaatagttgatttcaattatgtcaggctctgggatttcattttattctacttacaagctaataagttagttactgtttcatgggtgggtactggaggaaaacagaaaagtgaatcagagaaaaaggactttattatttacagtaaagttagtagcgaagaacatcttattttcattggtcctgcctaggaggtaacacagacacagatgatgcttatacatgcaatggttacattaaaggagaggcatattgagcttggggaacccaccattttatagcaggcagtaagcatgcctgctctttgtccaagagggagacattacctagtctttcaaatttgctctgcaaacacaagcctaagaaaaggctccggtaaagaacagtgagattcttgtattcctgacatgaacagcaaaaatgtgccaggatgctcaggggccatggcagattacctctcccaacagtggatcccttgaaaggctcttgggacctttaaggatcctggaccatattttgagaaccactggtttaaccagattataatttcctgttagaaaaaaatcatattgcctttttcttagtaagttacttttcatcctcctgaaaaaatgtcatgttctaagaatattccagcatctcctcaggaacctttatttgtacatggaggtcctaatgcttcctcatcagttcttttcacatacattggataatcaattgtcttatatcttcatactttaaatcgtgatgcttgtaaattaatctatattaagtctagagcagactctgaattttgactctaatttgttaaaagatagtttgatagtagatacctgcattttctagtatgttccataaaaccctaggactatgaagtgctgcatactaggtactctgtttttttaatttttaaaggcgcaagactgtatctgggatctgaaatcaatactaagaaaaccacttagctttgtttaagtacaggatcttcagctaacactcttcccagtattgtattttaacatcctctaactggattcttagttccttctaagatactgctagattttgagggtagaggagggggaagagtcacctaatttttcatttgcacctatacactctgagcttctctgctgcttggttaagcagtgtcttgctatgttacgaaagctgatttatttcctgaaagattttttttctttgccagttagtcatctttctatatacttatgctctaagctatatatcttagaatcctaataaaactattgtatagcagtttccacacattctgcattgtcattaacctgtggtttttgtctccctccctgataagtcccttttggaaacaaataattctaagacgagcatcttttattgtctctttcctgttatgtttgtcaatagtagtgtgatttttgcatttaagcttagtttcctctaagtaattccatatttaatggatttactcattgttatttctgctcctaatttctcttgactatttaacattaaagacagcatgtttccctctacattttatcttaataatattatagggagccactgacttgtctgtattctctagaagttacatctggaccgtatgtctgctagacggccaaatggccacagtgaatctccttgctttccttcttgcttctgctaattgaacattctctcctgctttctcttttttacctgtgctgcagcctgagactcctcacttctgtcctcagctcttgcttctcatcttatcctgagccgtaagcataaagtgataattttttgataaagctgaatctaaaactcttcttcctactttttttctttttgataaatgttcattcccctttgacatgaagaatatactaggtcttggtagtttattttttactaagttctttcttggccaaaaaaaaaaaaaaaaagttggtgaggcccccagttgggaattttattactcaggaaaggcctaacctcagtttcttgagggtttctcctgccctaagattttttgatgctaacagaaaagaagacaagttcttatttgcctttatcttggttatgtgtgcatagatacgtaaagttaaattttctacaagatgttaatggaaaaaggataatttctagacaagagccacaattattctaggtcacttgggagaacattatgtaaactgaaagctaaaactgagagttttgaatgagccatttcatttaccataaccgtttttaggtgatataatcatggcttcagaggagaaagtgcttcctatctttttcttactttatagacggaatgctgctgtaaacatttgtatacaggtttctgtgtgaacataaattttgaagtgcccaggagtgcattcattgggtcatatagtacttacatgtttggagtttttttgtttgtttattttaagaaacagacaaaatgttttctagagtggtgaagggtattggtagttttgtttttacaggcagtgaacttgattagctcagggtaagtgtcactcctatggagaggggcagctccaatctccattcaatccttagagctttagctgcaaagcttttagcctcgcacaacctggagactgccagagacttgggctgaatttaaactcagaatttaaggttctcaaattctctagggctcctttccttcactctctggtgaccatggttatgatctcattctccttcttggttcttccagccagaatgttagtgggctttgttactggaatttcagccactactgtgcctctactgcagtgtggccatcatcaggacaaaaccatagaaaactgggaatgcactctaagccaattacttactacacattttttactctcctccaatatatgcaaagttcagtcttcagtgttttcaggtagttggtttgtgtgtgtgtgtgtgtgtgtgtgtgtgtgtgtgtgtgtgtgtgtgtgttgtccaaagtttgtaactgttatttgcagaagaatggtttgttaggtgctcactcctccacaatggaatctgagctcctaaagtctagttttttggtttttttctggctgagtatggtcaggatgtggtccaaaatcacccaacatataaagaacccagaaaatatgacccagttataagagaacagacatcaaccctaagatgattcagacactgaaattatcagacaaggactttatcagctgctataactatacccagtcttttattaaaagatagctggggaggcaggaagggagttaagctttccagagaggatagaattaaccagtagggtactccacccattgtcatgctttgtcaaatgcttaacttctatgccaagtttgagaaatactatgaaattttgtcaaagaaaatactgccaaattgcctatgttaacaagtgactcgtttggcaaaacttgagtaaatctatcttaagttatttttggatgtacatttctatttgtacgatacatccttgagaacgcagcaaaaaaaaggctataccaaaggtttcccctcccaccctgggcaatatttaagcatcaaaacatggcctgtaactgcttctcagtgataaatatattttttattgtatgacaggaagattttagaatcttaaaattagtttgccttggtgcaatatgtaaatgtaaccattctttatctccaaccctatgctggataactgtaccacttagcttctccagcagccaagcattatggctaagtagttaaagctactggggcaaaaaggcttgtgttccaatcacagctactccgcctgccaaactatacacaaattatttgatctcttcaaagcaaatttaaaaatcataattaaatacgtaattcagaagattttgtggcttgccaggtgcagtggcgtgcacctgtagtcccagctacttcagaggctgcagcaggaagactgcttgagtccagaaatttgactccagtctgctcaacgttgcaagacctccatctcaaaataagcagcttttgtgatttcagttaaataagtaatacatgcaaattgcttaaataatagctattttcaagaagatagcttctgttcttcatggtgtagtggcataacactaaatttgtagttaaaggatttttccaaatcagttcattttttcttttttgagatgagttcttgctgtgttgcccaggctggtttcaaactcctccctctcagcctccctagtagttgggattacaggagcacaccaccatgcacagcacagatcagttcattttaaatgtagtgtttggggaaagagtgaaaggagtgtgagaaatcttaattaaattgctcactgaagttatgcagtttctattttgcattaaaaaagcatgtccacaattaaatatttcttccctttaaagaaatcagaaagatatatgcaaaaggtacctaatacaaagtgaaagacttagaagacagatagtagaaaagtattcatctcattctacaaattaactttgatagaattgaaattacagtaattgtggcagtactggcaaaggattttaccttttctgaacaatatgttttattgtagcattgaatcagtagagattgtggggatgggttatgttaaaccacaacccaataaagaacttggaagtaattagggtgtttaattttatttttatattgtttattttcttgccacttccttcagaactctgggatggatcccattttgccctggagttgttcccacactggcagtgggtttgcctagcacactgtatcacacagaacagacaaggctcctaggatttgtgtttctcttgctttgctagattttcaggaatgttaatgagggtgagagaaccatagattttatatggccgtaagttcttttagattaaatacaatattctatttttttatcttttatcctcaaacttttatgtactattcttttatgtttattcttatcaaatatctttttgtaattttttttttggtcctgttttataccttaatctttttctgtctcagcccttttttcactttctccctgattcagctgtatccagtgcttgacttcactataacatcttttgtctcagtatatgtagactggtaaggaaatattcaacctcagttcctcctttaacatttcattcttagttctcaaaaatctaagtgacaaatgaatctttattttcagtttttttcctactacttacttttcctttttctgtagtgaattttatcaagctaacatttatacctattccatagtttatattccctctaccaatccatcccatcccaccttggcttacttcttggtttacattgatccaagtaaggattctcgtttctgttttaaaagcatatttctatttagcctcatcccgaaacgaaataaaacattgactacactcagttgcctaagctagctaaaaataaatattcctttgcatgcaaggatcgtaactaaagtttaaagggagtctttgatatgaacactggagttaagtgaaatatgtatcattgaaaactaaccttctttacttaatagaagccttttaaagtttaggtttcttacatacatatgagagaatatacatcttgttaaagagtttagtcagaattatctttaaaaattccataactcagctgggcgcggtggctcacgcctgtaatcccagcactttcggaggccgaggtgggcagattgcctgaggtcaggagttcgaaaccagcctgaccaacatgttgaaaccttgtctctactaaatatacaaaaattactcgggcatggtggcgagcacctgtaatctcagctacttgggaggctgaggcaggagaattgcttgaacccaggagatggaggttgcagtgagccaagatcacgccactgcactccagccaggacaacaaaagcgagactctgtctcaaaaaaggaaaaaaaaattctgtaactcaattttattttgctgactttaattgcttaaaatttttaagaaaaaatatggtttcaaatgacaatttttatttcttttctgtatctttccaattttttataaaaggaataaaataatttcacttttagtatcaactataacaaaagcaggtgttaaggaaaatgtacatttctttctttgagaggttgatatctaacatatcctagaatgggaaacaaaaacatttttgattatttttgcatcaataataaagcctgatttggactaatgaaatattaaccacttttttttctcctccttaaatatcactgcatattcaactgtcccttgaacatatatttttgatataatacccatctagggagaagcttaaattgacttacactaaatcaaaattctcccaattcacataggaaatttaaggaaacattttacatcttccaactgtttcagatgtgtttatcttaatggatttagttgaatgacttacccagcgacatactggaagtgtatatgaaaagtatgatgtgtaaaactcttatttcagcattcattccacaagttcagcatttccaaactagtacttggaacagtttatgatgttaagtattttaagttttagtacctcaaaataaattcattttttgaatgatttaatgcttaaaatctcctaaaatataatgttcaaaattcccttgctttcttatttgaagttacaacttcatcttcctgcagtacagagcccacttggattatatttgagaatagaaagaaaaatacaagttatcttactctctgagatgctcaacaaactgattaatctttattaagataatgcattgacaaaaaagtctgagtttctgggaaagtgttgaagttgccattgattatactaatcctaaatcctttgaaaaattaatgattgttttcagaaagttgtatcagactgctataatggaaaatagcattaacatgttatgccccattctaaataaacccgacttcaaaatgtctgtcagaaaaccgtttactttttttttttttttcccccaagtaacatgttaagaggtgcctttctgaagatttttcttgggtaccgggaactcagaattttcatttgaaatatactaacagctttatttggcatgaatgataaaaggtgcagtgtattgcctagtacaaccagtaatacttttttcaataagaataaaaacaaaaataatagtaagcagagctgtgtttctaaccccaaagaagctgaagaccttagtttagatacgtcataggaattccttaaggagtcctcctttacctcctgccaatacaccaaaggaatcttttcttgataaattcacccacactagttatcaaatccaaacatcacagaagtaagttagcatcaattatttaccaagcgagacaaaggtttgtcatttttttcctatcttttccttcagccctcttcatccccattagttttttaatacttctttaatctcagaagcagtcattcctagtttatgtcaaagtcaggactttggaatttggagcactatctttaccactttctgtaactatctccagttttaggctaaaactacagggcattactcttttttttgttttgttttttgttgttttgagacagtcttgctctgtcgcccaggctggagtgcagtggtacaatcttggctcactataaggaggtcattccatttaatatataatcacttattttatgatttgtttgacatattaaattatcaaatataagtattttcttaatatacctcttctctgattttgttgatatagacttaataataaaatcttttaaaagtttgttttcgtatttgtagtgttctgactggctggctagctttaaaatgttgcctttcttcctagtccacactaaaatccattgagtgttctaattgtacaaaacaccatagaaaaaccttgtctaccacttttaaaaacaaactgtgaatgtgaaaatatcttctgatgtgactgccttataatgctcaatacagcagttttaatccagaagaatatatgacctgaatgtttgtcaaacacatgatatgcagcaacaaaataatctttattttacttcagtctgacaatataatgtataaaatcacaaattgtttgtattggcaagattttattttactaattctgagatactataaaaataatactctatatatttaaagtatttatttagaaaaaactgggaaataaattggagaagatattaattttaagaaaaacaaactgaaatcaagtctttgtcttagagaacaaataagactctgaagaaattgaaagaaatcttttgaaaagcaagagtgaagtacttcagtgataagacacaatgaagtaaaatcttccatttataatagctacaatgaccttaattgaataaaatctaaatgtcactaaagacagatatccactggtttggatttgaaatttaagaactatacaattttggatgaattataacttatgattctgtattaggattcttcaaatccttttcagtttataagctttagaaagtacacaacactttctaggtatgatgtaaaattttttaaatatttaaaccatagaatacattattacaatatgttctttaatgttgatttttaaatgtcagaatagatgtaataccagtgtaagccacagggtgggagtgaaaggcaagaacttgtgttgaagcagcttaaatacataattgcaccatctttataaatcttttaaatgcttgttgaattataaggagctgtagcttggttttctttcttcctttaatacagctgcattcttcagcaaagaatctataacaaaagacaaacacgttgatttaaatatataggccatttttactgaatatcaaaagaagtagacacatagatttttttccccctaagtttctgagcgtatgaggtgcttggtgaacagagcagcaattttgatcaatagttgaatttgagaaatttcttgaattaccagtaccggaaatagtaattgaagttaccagaaatatttcatctcttcagactttccttcttcattttcctttttccttgatttttctcatttaaagaaaaaaatcaattgtatattacatataggtctataagctgtctcaagttatttttcagtagggaaggtaaataaaatttcctttgtgttttctctttactcgacctcatttgaatttgggagcaatttaaagtagtaatagtaatcattttgtatgtttaaggtaagaagacaagaggtttcttctcctagaaaagaaacttcagcaaggagtcttggcagtcctttgctccatgaaaggtagttctacatccttttttctcaactcttaaaaattatcaatactgaaatatattttatatttgttttttttaagctttaacaattgcaaaaaaaatagccttttagaataagtggaagtgaccaaccccagaatcctacatgttaaagatgacctaaacaagtcatgcagttaatagcagagctgaatctaaaacttgaattctgtaaagctctactatttcaatagaccaagtgttaaggtcgtatttctttatatggatggctcctaatgtgaaccttaccaaaatgaggaatatttaatattctatttaagatatttgcagagaacaaaagtcaatgcattgaaatttctaatgtgagaataagacagccaacattagtgtatatatgaataagtagatatgctagactatactatatttatgtattaaaacttttaatttatcacttactttgtgcctggccctctacaaacacaagctgattttggggacattgtttaggaatttaaaataatttttttttacttttaaataattattttgtggcacataaaatggtactacataagtttgattatttaaaaaacttggaagttatagctttacattttaaaatgttgatttttttttttaggggtaatatagagaagactttctgggatctgaaagaagaatttcataaaatatgcatgctagcaaaagcacagaaagaccacttaagcaaacttaatataccagacactgcaactggtaagatttaatttaatttacagtaatattgatttgcttgattgaaattgatttccttttgaatgtgaaaatattcctgaatgcctattaagtgtgtagcatctgtaatttacccctcatccacgtatgtttgaatgtgtacatgctgtgtaagttctgtaatgtattacatgtgtaattgttggtttttttctctttgttgtatatggtactatatagattaaattgaaagacataattactaattatcttaatgagacatcccaccttaaaaaaatacaaaataaatacagactatatccctgaaagttttcagttgttttttgggggaccttattaaacattaacttttatgttaataagtgaccttgaagccacactaccatattatatgagctaagtaaaattataacatcaggtttgtttgtaaattctgcctgaaagtgcattacatacactatggatagatgtttttttaatgttcttttttttttaattcaatacagaatcttgctatgttgcccagactggagtgcagtggctattcacaggcctgatggtgcactacagccttgaactcctgggctcaagaattctttgaactcatttggttcaagaataaaaacgtggcactcaaatttcctgagtgctagttgtgtttaatgcacaaaatacacatttagtataaaatataatttagaaggaacatttgttttacatatgtgttatagtatgttttgtaaatgctgtaccctttcctaaaaccccagactggcttcctggtgtttgcttcagtagttctatatgaatagcaaaatctaagggattaggtctggcaaccaaacacttctgcaaacaaaaggaaggtaaactgatcatttataatgataaattctcctttacctttgtgatttgagctattctgcagacaattcccaaaggatgtgatttacagttttcactctgagagatgttgcagtcttgctgactaacacccttttaattaaagatcactttccatttcttgcagctcttacatctaggctatttaaaatcattttatagtgtaaattcactttttgctactactaccattttattttcagaaaagttacacaatgtggtattacagaaacaaaataatctttgtagacagacataatttggttctttctctcccttcccccacctccccaaaaacaactcttttcttcaccttaatttttgtcattttcatgagaaattgatcttttgtatggactaaagataactaggtacctctgaagtaaatgaattatttctgtttaaaatatgctagctatggagatgtagtacctagaattcataaacatgcttttttgaacatcaacatcttttcaaggcattgtaatggtgatatattctttgttacacagaaaacttatctcattatcaatggcttaatactttgaccatttttaaattgcacaggtctaaatctgagtatgtgtctgtcagctagaacactgagtatttaacttcaatttcttctccactaaaactgcttcctgatgccttatttttatgctttatattaacagtgtcacaaataataagtacattattctcaaaatattttgtgctacagactctagtgaagttttgctggggtccaaagagaaaccaaaataaatattatactctgacagtggtatatcaaaaggagaaaggaaaaaatattttttgaaaagatgcctattcagggtttccaagtatgtatgctacactgtataaaaatatagaagaactattttgaatatgatttgcacaatatatctgggaagagtacgtgtattgtccctatgttattttgtattaaaatttgatttttacttttaaataaccagatatgattcatttgaaaatactgagttagtagaattctacatttcctatttattattactttgttttttctactcatctacatatggcagtagacttaagaaatgataaagataaaatgtatgtttatccatagcttcaaataaagtactgtttggttcataaaggagtgtccaatttcagtagagattgggaaggaagaatataggattaagggtaacaaacatccatgagaagggtaataaacaaccatgaggtctttttcttttgtcaatatacaacgtgattatactgagaagtaactaaatggatagcctgtatttaaaactgggaaatctaaaaatatttcccattttactttttccttgcaaagctaagtagtcttaaaatagacaaaatagaaaagctatttgctcacctgatcatgtttctcaatatggtgtcaggatgacaagtgctttcatgcatctcatttgagttttaagttgtctcagcttagatttctagtagcattaggaatgtaaggtttaaatttttttaatagatattaactctcactgcttgagcagattaactcagattattttaatgtggctgagttttatgccagctagctttgctgaaagaaaatatctgtttttttagagctgtttgatttctcctcgttttgttcacagcggggatagatcaactgctagaaaaataattcaaagcacatttctgtcaatttggggacttctctctatatatagaaaccaacatgttcaatttagcctaatggttcagagcacaaatctacagttaggttgcctgggttccagtggcagatctaccacttactataatagttgtgtggcctttgaattaacctctccaaccagtttcttcacatgtaaagtggggataataatagtgcctgcctcaggattactttgagtattatatgaattaatgtacatacaattattataatagtacatgccatgtggaagtgctattaatgttaatagtcatttccattagcagcagcagcagcagattctccagcattcaccttgttctccttgtgaagatcatttgataagtctctcctcttcgggtgttacagaatctgattacctcaacagttggttttcctgatttgttatttgcaagtagcaaatgtcatctacaaagacagtactgtttcctagactttcctaccactttcaagtctactgccagggaaaatgactactcgagagttaatggactttaagaacctcagaggctaaagaaatccagataaacaattaagcttggtgacaattactatagcactcctagtcatagagtatctggtaaatgttgattattatagtaggctttgtaggggagagattacagattcattcagaattcatttgttaggggcatactatgtgccagacactgggcaagggtctggagttagaaggaaacaaaacagtttaagacctcaaaaaacctactttagtgggaagaaacagagttatacttggaaatacagtcatgtgccaaatgacattttcagtcaacaacagattgcatatacaatgatggccccataagattataatggtacttaaaagttcatatcagcccaggcacagtggctcatgcctgtaataccagcactttgggaggctgagctgggcagatcacctgaggttgggagttcgagaccaccctgaccaacatggagaaaccccgtctctactaaaaatacaaaattagccgggcgtggtgacgcatgcccgtaatcccagctactcgggaggctgaggcaggagaatcacttgaacctgggaggcagaggttgcggtgagccaagatcatgccattgcactctatccagcctgggcaacaagagcgaagctcggtctcaaaaaaaaaaaagttaatatcaccctagtgacattgtaggtagctgttgttacattgtagcacattttgttttttttgtaaatttagtgtaacctaagtgtatagtgttcataaagtctacagtgatgtacagtaatatcctaggccttcacattcactcaccattaactcactgactcacccagagcaacctccggtcctgcaaattccattcacggtaagtgctctatacaggcatacccattttttatcttttatgccatatttttactgtaccttttcagtgtttaaatacacacataccattgtgttacctgcagtattcagtacagtaacatgttgtataggtttgtagcctaagaacaataggctataccatataatgtaggtgtgtagtagactatactgtctagctttctgtaagtacactctatgatgtttgcacaatgacaaaattgcctaagactgcatttctcaaaatgttccgtcgttaagtgacacataactatataacagtgtgtttcagttctcagggcatccaagagtcatgggagagtcatccagagaaacttatgtccaagccaagatatgaaggacaaataagagttgggcaaagagtaatgggaggggacacttcaggcagtctgcacagcaggtgcaaaggtgcaaagacaagagagtgtagctattttggagaactatacaaagttcattatagccagagtatggagtgaaagatgagcatggagagatgaccaggggccagtcatgaacagtctaataagccttttctgagatctgaggggcttgtagagccatcaaaagattttattaggaaggtaacttggtcagattagtattttagaaaaactactctgagaatgaagggatggaggggaagttgcagtgaagagaacagattggatatgagacaaattcagaggcaaggaagcagtttaaaggctgttataataatccaataagaaaggatggtatgaagagaggtataaagagaggcagtaggtatataacaaaatgaaccaaagaagttggttgcattttactacacatacccaaacagaaaaaaatatattggaatgtgctgtggcaaaagacagagaggtgtcatgagactgccaagaccaaaggaatataaaggaactgacatttgttaagtgcctactaacctgtacagatactttgtataccttgtgttctgtataccctgtctacctagatttgcatcattggtaatgtctccatttgtgaatgttcaacagtgctgatgacaatccttaaaatacatacattaccaacttcagtgccttctttaagggacattgtggagcttaatttggctttttctagtgtctcagaatcatcaacatggagagtactttgatgattgtttttttgtattgagcactcattggccctatactagactgtagtgttttctaagttcttatatcagcttctttgtctttcttatctcttcctatgcttttagctcttgttgatatctatgtctgcctttagcaactcatactcccttttaatttgctgtttcaaaccagctatgagctgtggaaataccaccaagtttgttagaataaatctaaaatgacaataggaacaaaattcatctatctatgaaccttgtggctctaattctggctcctcagaagctctgttttctttctagcttttgactgtgtcctacaaagctgaatttgttggataagtggttctagataaatgagctacagaggcccttttgtctaccagatatttacctgttttttacagaggtcttttttaaaaaaagatataagatgataaaataatctattcatccacagttttcttaacatgcatcacaatatttcatccttcctttgccttcactgtcttctttttcccaactcctgcaaccaccagtccctcacatggattattgagagcagacagtggctaaactgattagtgatatacttagttagacagtgacattaataataaatgacctaattttagatatacctagtaagattttcccttttaacaacttatttgtctaagcaaactcacagttatagcttccgttactgacaaaatgtttaaatgtatacactacaagcaaatgtttttcaagtgtggagcagtgtaactgtgaacaagatgcaaagcttacggcagaagacttaggaaaagacaaagtagttaaattgcgactaataagctatgtttcagttcacccgctggagactgctaatattctgtgtaagatggtagcaaattttaaaatcccagttgtcttcatttgctataaaaaccaatagaaaaaataataataatctctccaaagctgattgaacagatttttttaatgatttgaatgcggctgtttctcttttgtgttcttctccctccagaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcaggtaactgttttgcattaacaaatatattattatgtgtgaacacacattttgccatacatgcacagatatgcatctcttttacgttatcaaacatcctttttaaactactgacagccaaagttaaggctttcaaaaaaacaagtcccataataaatgacatgaaattagaaaagctgaatatggtaaaactttattggaaagtaccttagaatttatgtcagatttaaaaatacatgttaagccttatccatatctgtcgtggtgtcactttcttagttccttattcaaagcttgtttactcaggattaataagaatattaaatttcatagtgtgaaacaaatgctgttttatttaatagtttgtgtatatcatattcatctttataagaattcaagatctttcataagtaaataattgcatcttacatttctatttatcaaaataagtgaactatctttcagtgaatacttctactacatcttcagttatatagtacacagatctgtagggtttagtttggttttggttgctaatctggaaatgaacatgtagcctagtatattttttaaatagtctctgcatgtgtatgatatcaaatattttatttaatgtttctaaagctcacagactaatatcccccaaaccactcctgccctcccttttagattcaaattctatcacagaatgattcttttagttaaaaaaaagtttaatgtctgaaagcaaatgaaaactatataatttttacaaaaaacagaagcttatgaaaatacagattgatgtaaatgtctatgtaacttgcaaacatttgtctgatttctctttgccttgagatatttaatttttttaaaaaagttattaatacccttttgctttaagtacacatataggttatagacttaaatcagcacgcaaagaaggcagttgtcaagctgtggtatattttagtagtgggaagaactaggcatggctgacaataagttttaattataacctcacttatgttcttgttcattgtactttatttcacatcatagtctcagttatagttgctactaaatgaaacaaattaaacaatttcatttattgcaagtagaattcctgtggagctgtgaagtgcatcagttctaatgcttgttacttttttctctattatatgtcttgcttgttcttttactagtctgtgcattcatgtttcagtagatggcaccctgcattgtacatttgctttctatactacagcaagggaaacagctggtatgtgattacaacttgatggaaaagtattcagcttaaaaaattcaggagaattagtgttgagttgtcacaagacatggggcataaggttagataattgatattttggcagaaaaagcaaagaaattagtttgttttgaagaccatgttacagtttaggatggaaagaatatttcttaaaatgagttttttaaaaaaaaccttttaagctattttattagtattaataaagctagtattatgcaagctagtataagtacaaagctagtataagtacaaaattcctgagttgggccaggtacggtggttcatgcctataatcccagcactttgggaggctgaggcaggaggattgattaagcctaggaatttgagaccagcctgggcaacatagtaagaccttgtctctacaaatacgtatagttatatagatatatgtagctgggtgtggtggcttgtgcctgtggcctccagctacttgggaagctgaggtgggaggattgcttgagctaggtagttcgaggttgcagtgagctgtgatggtgccatcacactccagcctgggtgacagagcaagaccctgtctcaaaataataataataattttttttttaaaaaaatcctgagttgtttgtagatagtagcaaagacaagtgaaatttttggctacatatttcaaaattttactttctatcaatcattactactaaacatctattttatatattcagctatcataaccaagactaaagtatatcagattattattgttctatgtgattttcttttttactttgctgagtcagtgagtgggatcccaactaaattctatgaagagatcaaatctgaactaaaagttcttaatagagaaaaatgaatatggatttaataggtaaattgggagtagaagattggcttaccaaatttagaagctaaattgcttctgatttaatttcttactattttatataaataagaattatctttaataatcttttatttttggccatatcaatttcccattacagtgatttgtacttttttgtttaaactgaaaacattaaaattagaatcaagttaactctaactagatttttgtttgtatgctcacaatttttactacttttatcaaagaagtttttccagagagttattttaccctaaattttataacatttattttaaatattactatttttgtaataaaattgacatttcttatgaaaggaattgagtcagcattattataagtcctccatactgatatttgaatgtgtctgggtgcctagacagacgttgtatatttacaccaattgtacacagctgtccagtaaactgttcataagaagacagtgatgtcgtgaaatccaagtgcttccattagtaatatactgtttatgtaaatgattggttaaccagaatgaaagaagttaggggaaataacagtaacacttgtcaggtgctagactaggatgtgtgactttaaaaacatattagtaataggaggataaggggtctctttaaatttgactttatgagatgattcttcttaaaatatcagaatttagctgtgtcagaggaatttacctgtgtccacataagaaattttaaaaaataatttggtttacacaattcaggaaaatattttccagttaacagacatctattgtgtagctattattaagctaaatgctatttcttgtccttctagaaatttaaaaaaaagaataaatgcagttatgaaagggtatttatgtgctggttatagtggaggtggttctgttagattatgactttccataattctttaaccaggcaactattgacgagtttcactttattcagccacaagaatgagtaaggccaaactacctattatataacagaagcaaagtaagaagtcaaaacactgcatgtgttagattttgttgaatgattaaatatttgtgtttttaaaaacaaaagataacatcagtgaaatttgttcagtagtttaaaaggaaaattttctttttaaaaatcaaaataatgctgattcatgtatgatgtattcactgtatttgcttataaacagtagtgaaattgattttgattaagacgcaatgcacacacacatcatgtcttgtgtactatgtaattaataaagcccctataatttaaggtttttattgtaaaaaacaaaagatagaatttaatttaaaagaccagagtattagctattgttccaaaactactgctgttgtgatcgagtattaaaaattgcatgctaaagctgcaatctttttaaatatataaagataaaatgcatgactgtgtgtgtcccaagtgacttttaatcaaagtttagttgtgccctttatgaaaccacgaattgagtcatgtcatgctaactttacggaaaagtaatttgcttttatattagggaattcaatatatatgcccatgcgtaactcattcagaaattcaaatttgaagtccagtgctatttgaatttaaacataagtaacagatatttttgtttgtttcctgcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacatctttgtaaatatcaaacctaatacatttcttgtccagtgataaaacaactggtagaattatttaaacactttagatttttaaataatatacatggctttaatttttactgtgtgtatagctacatgatgaaattaattaaatattaagaggtacttatgttgtgatcatttgtatgtcctttgttcctgagtaaaaaaaaaaaaaaaaaaagggaaggaaggaatcacatttttagggaagtttataaaattcatgttttcatttcagtaacctaatagaatggtgatgaccagatttggtggcatttattacaattagtgaatcactttgaattttagaattattcttcaaactaaactttctaaagaaacatttgtttttaacgggagaaaatctaaaaccctgcaaggactatctatatttgttaacttagattagaaatgttcatattcttgttgagaaatttgttattcattgttagcagcctgattgatggccactgaagacatttgagagagtggataccaaattcagacggctgcaaaatttgtttaaaatgagacttccctttcatttttattccctatgattctcgccttataggtttctgttttcccctgattcttaaaagtgtttaaggcatggcttccattttatgaagtaagcattgatttgcaactctcagaaatttaagccttcttgaagcaagtgctttaaactagagggtgtgggatgggggaatttgagcaggcctctgtgccacagtgaagaaccttaacttgtggaagaatgagagtggtgcctcgacttctcctggtgccaagcacatcatattgacatgttcctcaccagggtgacagtaattattaggtattcactgcgaagggttctgaggtatgtacatctttctttcattgccactagggctgaatggaaatgcctagacaattatccaagtttcttcccttccccccacttcccgcccacccagcctcccttctccgcgcgcgcgcacacacacacacacacacacacacacacacacacacacaaaattaaaaataaaaacttcccagcgtgtaccagccagaatataccactgtacctatctggtgaaaggggattctttttttcccctgtccttttctagatgggaagactttctctcaacacagttgacatctactagcttgctgacaaccagaggaaactccgtgtcccagaaggtgactcaaattaaagtgtaccattgaccttcctccccagcccatcctttccccgcccccaccacttttagcaggactagcaaactcggttttcttctggattccagcggcaccctaagctccacgtggtgagggacatagaccctttggggccacaggaaaggcagcctggagagcagccccctgccctgctctacagagggagcgcgggtcaccgctctaaaggtggagtgggcacccgccaggtctctccctctgtctcatgactgagtcgtgcagggtctggcttttggcatctgctaagcgtggccgggtaagaacagctcccaggtaaaaaagctgcacacgcgaaacgccgagtctgaaaaaaccacccccgccgaggcgaggcagttg

SEQ ID NO: 16321 - DNA, 85878 bp, Human
ctcccagggatgtcctgaaacacagcagaaagggaaatcttactgacaaacagaactttgagcagaacatctgcttttctattttgcaagaaaaaagagatggcccaatgtaagatctacactgactcatcagtggtggctaatgtgttggccagctgctaccttaaggatttggaaaaaacaagattgaaagactggtgacacagaggtcaaggtgggggaggcatgtgagagagtctcttgaaatgggcacagggtgtgaagatatttgcgtctcatggagtgccctccagagaacaaattgacctgtcccgtagatgtcagccagcctcctgccagcttccttggggcttgctgaatgtacaatgagtgccatggtgctggcatggagatgaagcacaggcttaactctccagacttccttcaccgaggctgatgtggcttaccaatgctgagtgagcaaaatgctgagagtgaagggcagcactgagccccctgtggcaccattccccgtagtccgtgttaaatggcctctcttcacagcatcagttcacagggtccagtaacaccattgactcatcttcctcagcagttggaagagggaggaggagagttagtttcagcctctggagttgggggtgagtgaggatactgatgtatcacaagcaactagtgggcaagggggaaaagatgactgagttcaaaagcaatgcctggattggaaataaaagatggaaaattgcattaattcataatcatgtggtaatgccccatcggactctgcattcttaatcttttacctctactgacagagaggctttgcttttcagctgctgtgaacaagctgaagaggccttatcctcttatctgcaagagtggaagtaatcacagggggccctaaaggcaaatgtttacctgtgtattttatcgtgaaagtgccaagggtccagacctcacctctcttgtcccactttatctccagtacctagaagggaggctggcacattgtaaccactcaaacatctgtggatgactggaataaatgggaggatgtaggaatgaatgaacgaatgaataatcctttagggaacaatagagagctgggggagggagaagccatacctgatcttttattcttctccaaaacccttgaaaagactatgagaggccgcatagagtagccattaagaccttgaactcttaatttaggatctacaacttcctagctgaatggcttggccaagttatttattctctgtgtacagtcttccttcctgtaaaacaaacacagtaaatgcttagagcagcacctgggaaaaagtcaagttccacataagtgttactgtcattatttttgtcatcttgatgagtgtgtaagcctgcaagacaatcgggaaattccctagggagggtgaatccagatactcagcttccaagggccattcaagagggaacaatcaccttttctctttgcctttcatactgctttagacccctcactgcttcctaacataactttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaaggtgagtgccgcgccacgtacgtccccggggcgagctgtggggacctcttcgccaaactccccaaatggcccaaaagctggcgaaaccggaccagggactccccttaggcggaagccccaaggccaccctctgacaggtgaagggacgtcccagagctctcgcttagctttcggaccctggcttctgctaggaccctggcgtcgagctttgaatgtcccggagagccactcacagaacgcacgcccgaacccgggcaggggtagagaaaccaacgctaatgtgctctgaaggcacaagttcaagggcacccgccttagagaactccaactggcgcactccagacgccacccccacccccagcccgcggtctccctcttctaacgcactcccacctgcaaatcctgctgcctctggagcagccccgaccctcctacggaaactggggccacacgcttccctctaattggacttgatctgctcggcttgcagacaccgtggaaggttcttctgggactgctgggtgctgctgcgcttgtcaccatcatcaccgtgcccgtggttctgctgaacaaaggcagtaagtttgaaacatttgaaaaagataggacagttggagctcaggtcaggctccgtcttaccacgctaagggaaacgagggattttgcgtggggttggaccagtgccccgaagtgtagctgagaaggcttcccagttgttgttgctgcttgtagagcagcagctggattcacttcgcggggtcttcagtgtttaggctgaaactcttgcggctttcacgtcttgttatgtataataaatgcatgcttcctgaaattagggagagtcgggatttttaaaatttcaattttaaatttaatttgtaaatttttaaatttacatgtaatttttgagaaaagtttttgggtgtgatcgaaaaaggaaaaaaggcagtgtttaaagagcccaaagacagcagtaaggatatctgaaatggaaaggaaaaatgagaaagcaagccccaaaatacagttttgagaaatgatgttccacagggaacccagactgttttccctcaagggtggtgagaattcagttggagggtggggaggcagggaagtaattgaccaatttagcagtattgcagagctaaataataaagctggtatacacgataatatttaagaagggtctggaatcagtgatgttttggtggattcttttatttaaggactttcatgtctttttagcttgcctaaatgtataaaacactcacataatggaatactcactgtaggatgcaagcaagtgagaactactagtttcagtctcccctggccttactttccttttaaacacttgctttcatttcagcattacacactataaattagtcagccagttaaagcattctctctggaagatttagtcaactgaggaatgtatagtcagtgcttgcatactcaaggagtcttatctagattttaggatgacagttcagaattagattgtagagctatgaaaaccatgcttgctgtgcaattcaaggccagggcaaatgtgccaaaggttaaataactgaatgggttgacctactgctaatgaaatttgaagaaaccagtggttgctactattttataccattaaatgacagtccacttaagcttgactcttgtggactgttaaaatataactattttcataaagcaactctttgtgtaaaccatacatgcaaagccttgtgggagaagaatgtgctagtcatacaattgataaatatagggcttacaggcttacattatgttccaggcaccgcgttagttgctgcaaatacaaagattaaattttgtaaatataaatataaaggccctgacctcaaggactgtataagctagtgggaacatgcaaacaaatatgacttgttttacatatatatgtgtgtatgtgtgtgtgtggatacacacatatataaatagaaataatctgtatgtttctctccaaaacatcactgaggcatcacagcatcgctggaagtttgagtaaaactgtaattatcagaacttccgttaaagcaagttggaaggaatactgtactttgataagccacttgagatggccagtgaaaaggcctagggatctgaggcttgctgcagttaactctgagaattttgttttgctgggtagggtatacaggccaggaagagctgttttgccatttctgctaaatagcacctggtatcttctccaaatgaaatttgaacacatttcaagaatgttctcttgaggaggacttcctgagagactcaacttgtttccatataactactcttatgattcaaaaaaataacttagaggtgcttgagcagactgctctggaggttagaaggaacacttctgggaaagtctccccctcccgggttcaagtgattcccttgcctcagcctcccgagtagctgggactacaggcacacaccaccacgcccggataattttttgtattttagtatagatggggttttaccatgttggccaggatggtctttatctcctgacctcatgatctgcccactttggcctcccaaagtgctggaatgaaaggtgtaagccactgcacccggcggagagacttcttataagaggtttcttttgtgggccaagcttgaatagttaacatcagtttctggagataagatattccagaaaatgcaaatgccctgtgtttcaacacagagacatgagatcacatcctgtgttagggattataaaaggatccagggccccagaggagggtgggaaacaggcaaaagagtttgattctaagctggagatgatgcagtgaatgatgttttgagcatgcctgaactgttggccatgacagtgggaaggtgagttgcaatggagcaacactggagggggaagtgagggaaatggcccaggacacttacagtacaggtcagaatttggaggctccagagctactcagaaatgtgaatgactggacttcggtaaccggttaaacagagagaggtaaaggagagggtggctaaggatacctcttggacaaccaggtggagatgttgtttcatggtggctttatttatttaccactctagtaatttcttgtctgtatttcttaacttgtatgtatgtatgtttaaggaaaaaagggaagtcatcttgttaacacttctgccttatcataggaataaagataaaagctcaggaatgcagcattttcactaaatcagcaatacctttcctgggctgtgccataataaaggtcagcattccttacaaaaaagtcaaagtcatcacccaagaaatgccctccatgttgtcaatcaagctttcaagtaaacaaatagagtgaaggaaaaaggaaggaagtagggagaaaggaaatgtaaagggaaggggaagggaaaggaaaggaagaaggaaggaaggaaaggaatttgatagaaaaacaaagcaaagacctaaattacgtggaaactaaagaattaaacagccaaaaggaaggaggaagccatgagcaaacccaagttcatcccctgagaggttgatttaagaggtcaagcatttccatgtgaaatgcttactttagcaaaactagacacacccagaacaggacgggggctagtgaatggggagccagagagagagagagagaggcttaatactattgtcatatatttaagaataaaaactccttgaagtcatattattcatttcaccaagcacaatcaaaagttcaccctcttctgtgtatataataaatgattgtatgttttaaattttttttcaatcatcctactataggaggatattgcatatgtaagcattcagtttccccaagaatcagtgagaaatacgtaaaaatacttgtatggaattgtagaactcttcatggcttagtggtaataaaattcacatgcagcatttatgattcctttattttttcttttacactatattatatgctgaaatttgaaatatttggttatttgtcaaatagttttattattattgaattttattatggaaaagaagtatatctcttcttttgctcctttcactgctttagtggtaaatttcttctataccttctttcggtggaaaggaaatttgactgctcacccatccatcagtaataagagaaaacccaaatgtgaaggagacaggaataatcagagagaaaagatagcatctatgaggtttgcctgaggaagtccaggatctgttccaggtttaaagcacagaaatgcgcctgaatgaaagctttgtatgtttcaggggacaatttctaaacagtatgctctgtaaaagctggagttgactccagcttgctcagttaactattgtcaacctttgtggaatgctcatgaggtcagcaggttagtctttttcaggccagttattttgggttttgcttccctagccatagcatatgccttaagtttctctatcttagaaatctctgcctctcttctcaaaggggatcacaaagagagagaaaatgaagactactcagttgatggtcagagaaagacaatataaaaagactggagctggatcgtgtctttcaaattttatgacttaagaaattactgaggcccatggagaatgtggctgtaaataacatgcaggagcgccttgcttgaggaagagaaggcatgcaagctacaataatagccaatatgcatttactaagtgctaaatttggggctgagggctttcaatgtatttttcatttaatccttagaacaactctttgaaagagaggtactattaccctctccattcctacagaagatttatagaaactttgagagggtactttagttatctgtaattgcataatgaattacctcagaacttaaaacaataaatatttattatctcatagtttctgtgtataaggaattttggagtggcttagctgggtggttctgcctcagggtctctcatgaggttgcaatcaagatgttatctgaaagcctgactggggctgaaggatccccttccaagctcactcatgtgcctgttagctagaggcctcagttccctagtgtgtgggccccagttccccaccatgtgggaattatattataatttcatgacttctaatctctgtgtcgtaagcattctgaagaagagcctactgtggatgccttcattcctatataaagctgtatacaggcaatgactgacatctcaagcttttgaatggttctgtttagtagtattagtagtaataataggtccagatttacttacttgcactaaattatacttaggataatatggtagctactttcccttagaatgaaggatccaagagaggaactaagcaggaagctgagttgccttttatgacctagcctcagaagtggcaggtataccattccttctgctgtgtactattggtcacacagaccaaccctgatacaatgtgggagggcactacacaagtgtgtaaataccaggaggtggagatcattgggaaccatgatggaggctggctccaatgactatcaaagaagttaaggaacttgctcaaagttccacaaagttgggattcatactcaggcaatgtgactctacagctgatactcagtactgttcaactccatatcattctgtcagcttgtaatcaagtataaaatcaacttggccatattagcataattgttataacttctcatttgcatagcgatattataatttcatggcttctaatctctatgtgttaagtatcctgaggaagagcctactgctgctgccttcattctcatataaagctgtatataggcaatgactgacatctcaagcttttgaatggtttcgatttttagtattagtagtaataatagattcagatttacctactggcactaaattacacttgctttgcttctgatgtaagttacattatttcatttgatcttcacagagaagttcattttagagagatatattaatatcttgactttttacacgtgaaagtttaggggtttgcaagtaagtactggatcttgggaatccaaatcttttgactaccaaccttccctgagcctgctggttcccatgaatggctaatttatagaaatgccttggtgagagtttttctgagttaatgtttaatcattactttatggttggatgctaatcctttcattgctgtaaatcaatatcttgtaaatatttttaactttagtcttcacagctccattatgacctccaaaagagggtgtgtctctcaatttgagagtaacctgaaaccatgaaattagaactaactgttttattatttgccaagcattgtattgttttatattgttcttcaaaattataacttcctaggaagcttttacaaatttaaagataaactatgtgctttctttaactgggggcattaatgtgcacatttcttaattatttggttcagtgaggaagaaagtagacctatgagttcagggtcctagaagaggaggtaatgtaaggcagagccaaagccactagagattttattcatggcactctaggagccatggtggctcaggatgtataattgaggtagagggagtaggagaggtgagtatcaagcaggtcttatcatccaccccttccctgacttcttaaaactggggaccccaaaactgagcttagtggcctctgtggcctaataccatttctgtgaggctggaaccctcttttcttgttttcctcagttgttctaaagcccaccctgctcaaactcatgtccataagtttcatggatgactcttatttctctattatattcttccattatttgattccaggcataaaactctttcagtatgagatttaaaacctcttcagggccaaggtccaacagtggctaaatacaatatttttcaattcaaaaaacatatattgaatgcttactgcatgtcaagtattactgaagatatgggagtggggggatatggctattgaatgcttactgcatgtcaagtgttattgaaggtatgggggatatggcctgctatgattgcgtatttgtcccctccaaacctcatgttgaaatttgatctccagtgttggaggtgaggcctaatggaaggtatctgcataatgggatcagagccctcccacaggggtgagtgagttcttgctctattcgtttccgtaacagctgattattaaaaagagcctagcacctccctctttcttgctttctttctcaccatgtgatctctgcacatgccagcctccccttcaccttctgctataagtagaagcagcctgagaccatcatcagatgtaaatgcccaatattgaactttccagtcaccagaatcatgatccaaataatcttttaaaaagataaattactagcctcagatattcctttatagcaatacaaaatgagctaagatctagccctaagcagtatagataatgtccctgttccactggacctttacagttcatagagcaggcaaattataggcaagtgcagaaataatttcagatggtaataaatgctatgacagaaatcaagtgggatagagaggaccggcagacacagaaaggagtttctctcttattccaagtatgattttgagctcctggaggatttcagcatgaatgtgacatgatcttttcacatttcaaaaatatgcctctgactcttgtgtggatagtagtttggggttggtgtggtttgtccaggtgatcaatgatggtggcttggagaaggatggtagcactggaggtgaaaataagtttaaaaaaaaaaaagaaacgcaggatgtattttggaggtaagacaatgtgcaggcatgtgaagagtgagggaaggagagaaggtaaggatggctccttggacagctggctagatagcttaagtaaagaatttctcttgcctcctggctgtttcctttttatcagagcttgtctgcagaggttcctctggcttaactcccctttcctattggatcagccttcccctttcaaggatgtgctcaggaacacctcctacttcatattcacccagcacagatttgttgacagaaggtaattctccaacttggcaaatatttattgaggattttctatatgccaggtactttgtgggtccctagggatagaaagacaatagatatggcctttgtcctcaaataattgacagcattaaaagacacataaacattaactacaatcaaaagagctaagtgcccttctagtaaatgatcaaagtgctatggaagcactagtgaccaaatgataaatgctgccccaggaagtttctacataaacaaccaagcataaagcattaataattaatgggtcttaatattatccttccaatccttcagcccccaaactggctctgaggcatgcagtgcacctccgtgtccatcctcactgacttacagccccctgatgctgtatgaggattgtatcaggatgttttgggcttcaaggaacccaatacctggccaaaagttatttgaatgatagcgttttattactgtattgtcattagcatcttttataattggaagtgcagaagtaaagtggttcttgggtttgttaatgtaatggcctgaacacatcaagaacatggggcctttccacctttcagctctgccatccttggagttttgtcttttgatctccagtatgtcatctcatggttgagcatggcttctgcagctcaacccagcacttgctcatacagctcattcacagggcagaagaggatgctcttcctcattcatgttctgctgtatcagggaggaaaaccatttccataagtcctctgaccagatgcaaactttcagatcttactggcgacatttgtgtcacttgtccatatccaaaccaatcaccggcaaggagaatgaattgccgtgattgaaccagactactcaagactcacctttctcaggttggaaagtatcttcttttgctagcacatggaaggagaagggcaaatacctaagttgaattgaaaattctgaaagacagaaatcggggagacggcctatgtaggcatatcgtgtatttggttattgctctcttttcattacgttagaaagatttaatttttcaacaaaagaggacagacatcaagccagctctgatctccaaaaatctggagctgtaattctctcctttccttctcctcactttctttcctaactgggtttattgcaaatcagtgtgctttgttgctgcctttctgatctcaaggacattttgacctcagccctttctttcttttggcatccaaagtgatcaagaggagaaaataattgaattgcaatgttaaaatataaatctgagataatagagcaggtaagaaacatctgaggggaattactgacaatttacctctagaaaatccacataaactgtcacatttcatccagttcataatagcagaaagtggtagaaatagtcaacataaaataagatgggcaaaatttttaaaaaatggtaaaacttagatctgctaaagttaacccaggaaagtaggacttaaaataattaatggccataaaaataaaatagtaaataacaaaagcaaacaaaataacctcacaaggtccagaagctataatttaatctaacatgggcaaaaaaaatctaattgatgactcaaatctttgttttaaaatttccagcgaaaaaattactctgcatggtaatgattttcttaaaatgaaaagggtttggctgtactgaaaggagaacccagaacccagcagccagtggacccttattccttcctggcaatctggccctattttccctgtctgctcactcgcttgcttttctggtgaactattccaggtatctcctctccactcaaacttccaacacctcctccatatgctcattcatagctaaggacctggcttcctgttttgataagaaaactgaaaccattagaagagaacttcaattctcaccggctcatcagtgcattcacctgtatcggctcccctcccaagttagaggaatgaatgctcaggctcctacccaagaccaggccctttgtttgtgccctgggtcccatcccttttgcctactgaaagattaggctccagctgtccccttgcatgtggcaacatcattttttccatctctatttgatcatgaacatacagtagtgtctcatattcttaaaaaataagaaggaaactgtctttttccaccctcatccctgccaacctaccactccctttctctgctctctttaccacaaaacttcttaaagagtttctattatcactgtctgttacccctctccctttttttctcttaagcctcctggaataagggttatccccaccacaccactaaaacagctgtattcttgtcaaggtccctaatctctgtgttgcagattgggagttgcttctcactctgtgtctcgtgtgcctgtcaattagtcatccttcttctccacctcccctcggggctctcactctctcctggttgtccttctacctcactgtgcagtctttcccagcctccttaggtattcttcctgatgtcttcaacttctcaccttggactactctggggctccatcctaagaccttttcctttttcaccttagatgacctcatccactcccatggcctcaaataccatttacaacttggcaactttccaattttacctgcaaaccagaccttttcctgagctctaggtgcagtatacaactgcttactggacatctccatttggatgtgatattggcatctcatactgacatcttccaaaactctttgtcttcccttagtacatcttatttcagcaaatggcaattctatttttgtagttactgaggccaatatccatgcaagttctcctcaactcctctctttcatccacaagtcacatccaatgtgtcggcagttttatcatctgtatcttcatattctctcagagtttgaccctacctcaccacctcatctcctactaccctggtcaaagacacaattgcccttcccctaaattattgccaacatctctctttttttttttcttacttccctatggtgtattctcaacacaacagacaaggtgattgtggtaggcagaatgctaaggtgacccccaagaaccctctcctccgctcctgtgtactaatctctgagattgtggatatgatgaattttcttcctgtagttaagtttcgttatgatgcacagttggctttaagaaagggagattacctgcttgggcctgactgaatcacatgaactgtttaaaagcagagtttctctggctagtcacagaacaggcagtcaggaatcccaggcatgagaaggatttaacatgccattgctgacttggaagatggaggggccatatggccaggaatgtgggtcatctctaggaggtgagagcagccctggcttatagtcaacaagtaaatgagaacttcactctcacaacctcaatgaactgaattttgccaacaacctgtgtgagcctgggagcaggtaatttttccccagagcctccagctgacaactcattccagccaaaactttgattttaacctcacaatactttgaacagagaactcagcaaaatgggctggactgctgacttttagaactctaagctgatacatgtgtgctgtgttaagtcactaagtttgtggtgatttgttacatagcaatagaaaaccattaataatatagtgataaaattgttttaatttattatttatttatttattttgagatggagtcttgctctgtcgctcaggctggagtgcagcgatgcagtctcagctcactgcaaccactgcctcccagtttcaagcgattctcccgcctcagcctcccagatagctggcactataggtgtgcaccaccacgcccagctaattttttttttttttttttgtatttttagtagagacagggttttgccatgttggccaggctggtctcatactcctgacctcaggtgatttgcctgtcttggcctcccaaagtgctgggattacaggtgtaagccaccatgcccaggctggcgaccacatttaaacataagtcaaatcatgtccttttctgcttaacatcgttcattggctttccattgtgaaggctccatggcacttgttaccacctagcatatggcattgcttactcattatctgttcctatgtctcccccagttaaaatataagcttcataagggcaggagtttttcatgctttattcactgtgatgtctctagtgcctagaacactgaataacacagtaagtgctaagtaaatatttggtgaattaaagaaattatcttggagctcaggcaagaaaatttttttaatgaacatttattaatattgctgtaattctgaataaaattattatatttataaaccactcagtactaaatcatgtatacctacaatttgtaagtgctagcaactgtttgaaaaaagatagaatacgtttatcctcatggcttattaatagtttggttaagaaaagactgttaaagtaagtacttaaatagatataaaattacttgattaattggcaaaatatgtggtacagaaaataaacattttaataagatgaggagagagaaatgaatgtggactaagtagtaagggatagatcaagagacatgaagaggaatagtgggaaaatgaaggccatgaatgtagactgtttatttgagaagtttgtccagatggcttggggatgcagcaggatcaggtaagtatttctttaagatcagtacacactctgcatccttaaccacagagcagaagtgagcagtggaaagaaactgaagatgcagctgggcacagtggctcacacatgtaatcctagctctttgggatgctgaggcaggaggatcgcttgagcccaggagttcgttcaaggctttagtgagccatgatagtgccattgcactctagcctgggtgacagagtgagaccctgtttcaagtaaaaaagagaaagaggaaggaaggaaggaaggaaggaaggaaggagggagggagggagggagggagggagggaaggaaggaagctaagaaagaaggaggctaggaaggaaggaagctaggaacgaaggaagctagggagggagggagggaggaggaaggaaggaaagaaagagggaaggaaggaaggaaggagctttgtgttttagagggaaaaggtaagattttaaaaaaatcccttgggaacaagaggacaagcatctgagtcatagattggggtgtggaatgatcggggaggaagctcacctctccctcagagttctaaggaaagagttgaacaatggcaggagggacagataccacagaactgatgagcttggtagaaaataagctcctatggtagcttttgctgtaaaggaggaatcattgaatttttttgttggctaattttataattttttcaaaatgtatactgcaggacctgagttgttcagcattgtataatatttaaaatctagagaacatgaaaaaagggaagaaaacaaacctattttaaagcttacgtgactactttttaatgagttcaggaaaaagatgatgaaagttattgggtattcccatggaaaagagaatagagatggtaaaacttcctttctaggaagttaccttctaggaagccacagagttgccatccttcttactgtccagagggaaaattctagagttttctgaatttgcactcttttgactttgaagcagaacaaattaagtttcaactgacccaagtcctaaggatactaccaacctgcttatttaaaatagttgcaaaccatgaatttaaacacttccataaagcctaattcatctccaccaattcacaaaaaaatgccaagaaagcatttaccacatgcaatcactgttccaaagatttagagaggtttagaagagtgattgtaaccacaggctttggcgccatattgcctggtccaaatgtggctttggtgcatactaatcacagaattttagtctagttactggctgtgcctatctgtgcctcagtctccttatttgtaaaatgggaatgagcataagaagaataagtgggttgaaagtctacattgcctagaacaacccagcaaactagaagaacaccataagaatgcgtaattattattctttatatgtttataacattttttgtttgtttgttttaacagctccagacgcaggtagtatagtaatttttgccccatactgctgaatgttttgcctggcaaatactgggaatggggcaattcctgtggcagttttgttttccaataattgttttttcttatatcggggatgacaaatgcttgtcacaaagagtagccttgttgattacacttataaatcttcgggagacttcttcaatgagtcagtgttagagctttcagtttccataaatgcagatttcctttactcagttttcttttaaacatgagctgatctttcttagtttgcactataataccctccactgaagtctcactgcaactgcttttaagtatatgtgaagagaaactagccctttgctaaaatagttgcatgtttcacgggccagtgagtcatttagtcatacacttaagaactttccacctttcaagtgtttatcatcacctcggatttcacggcctaatgccagtcaatttcatggggcatagaagccctgtacgtattagtttgggccattattgtatcagtcttgtttattcccagaaaagtcttatcaagaaaagagggagtgactataatcagaaaaaaaaaaattcatttcagaaagggataaagcagtcctgccaccttgcttagtgctggctccctgtgtgtgtagagcttcctgactctgcatgatagcagagggaaccaggcagtgtaactcggcttagttcggtcagtccttccagccttgcatttctttaccaacatgttcatatttgggttaagatgaaaatagatatctgatacttgaatactgagacatacatattctgcccacttttacttttctgctacatatattggagtcgtatgctgatattgtttcagggtaattggagtttcagtctcaacatttgtctttcaagtccagtcttgtgagcagtttttgtttttgctttaatggtgctcacaattttgaggaatgtccagatgagattgtcaaactgtagtcaggactggccacctgatgttttaaaaggaaagttttatgggaacacagctgtgcccattcactcacagattggctgtagctgcctgcaagttacaatggcagacttgagtagttataacagaaactaaagaccataaggcccacaaagcctaaactattgaccaaccagctatttaagaaaatgtttgccaactccaggtctagatgttgtattcttaccacttaaaaatactttcgttataatgtctaacttgaataacgagattcagaaaaacgattaaatatagagtttattcaagtgcaaagcttgaggatgacctcttggaaaacatactccagacaaatggggttagcattaccaagtgaggaattgaaagtttcactcatataggcagttaacagggttgcaacattttccatacaaggtcagtatgtatattacagtgattttgttggttacagattgctatattccaactaagatttctttaacattccatgagcaggggtgatgatctgaggggttcctacctcgggcaccacagggtcttttctggtcatttacaggaaaaagcagaagttacagctgcatggtatgtgactcaggccacatacctctcaaggctcaaaataacctaaagttccaacagatttaagttctaattatttaatttcatcacaataggtaagatgaatcagttcttatatcagttagggaaatcacactagaggccaggcgtggtggctccagttagggaaatcatactagaggccaggcatggtggctcaggcctgtaatcccagcactttgggaggccgggacaggcagatcatctgaggccaggagttcaagaccagcctggccaacatggtgaaaccccgtccctactaaaaatacaaaaattagctgggtgtggtggcacatgcctgtagttgcagttacttgggaggatgagacagaaaaatcgcttgaacctggaaggcagtggttgcagtgagccaagattgtgccactgcactccagcctgggtgacagagtaagactctgtctcaaaaaaaagaaatcacactagatatttcagcagagagatttaatatgaaaattggttacacagataaaagagcaaaagagaaactctgaggtaactgagaaagtgtaactgcaggaaggaggaacacagaagatctcagatcaaagctctaaggtttataatccccctagctgctactggtacctccgtgaggcatgatgaagcaggttctggatattacaaaggaagctagaggctggagcaggtgctactgctgggtgcatgctgtcagcaagaaggaggaaaggaggagtccctcctcttctctaattgccatccaattttttctctattttctcctattaacagaacctagcaagaatcctgcagatgaggcttcttggaaatatagctgtagagcccttccccagaattactgagcaaggaagggtatgtatatttggaggtgaaagccagtaggtgactggctcaggcttacggaagtgtgctgacctaacagtagctagtggtggtctagaacctgagttgtaatagtctgacaggttcttcttgcccactgcacagataaaaccaattcactgtgacagtgatattgcaatagagaatttcatagtcacaggaacagccaagtgaaaggacaggagacagttctcaaattgactccctcaaagcttggaggttagggtttttaaggatgatttggcaggcagggacctagggaatgggtgctgttgattggttggggatgaaatcataggactgtccaaaatggtctttatgcactgagtcattttatgggtgacggtcacaggactggttgatttagttccttggtatgagtcacaggtccaggtggagtcagcaggtccaactgaatgcaaaagtctgaaaaatatctcaaagaccagtcttaggtcttgacaacttgacaatagtgatgttatctataagaacaattggagaagttacaaatcttctgacctctggaataatggctggttatcatttaactactagcctacatcttggcagaattcaggcccctcctatagtcctcactgtgtggctttttcttcgtcttagaaaggcaatctcagtcctcagagtgggtcagttttgggagggactattaccatccttgctgcaaagttaaactataaactaaattccttccatagtttgcttggcctgcacccagtaatgagcaaaggtaattagtttgtgaggttagaggcaagatggagtcagttagtttagatttctctcactgtcataatttttgcaaaggccgtttcagaggctcctgtgctcactctgtctagtcctatctggctaagctcactcctcttcctacactacagccacttggagttcacatattgtacttggagctgttggtgcttattttcagattgtctgacttttatgttttcattcaacaactatttattgagtgtctactgtataccaggcactgttctaggctgtagtaatataatagtaaacagaatgaaacaaaataaaatcagtgccctcacggagcttacatccaattaagggaggcacacagtgaacaatataaaaaagtaaaatgtataatcagttagatggtatcattgctaagggaaaaatgagtaatgctggaaagagtagtagagaattccatggggaagaaggctgcagtgctagtccagggaaggaatgcagcatttaaataaacacctgaaggaggtgaggaaggaagcactggccatatctgggggaagaacattccaggaagagcatatagcaagtgcaaagtctctgaggcaggcatgagcctggtgtgtctggccactgggtggccagtgtggatggagtggaaaggcaaaagaggaggagaaggaggcataggaggagggggaactaaaccccattaagatgttttatttttttcgaagtgttgctattctaggaaatgtgcattatactatttcaggtggacacattggaaaatgattatgtccctaaccaaagtttggtcacctggcagtcccaacattctacagcctccagctagatggcaatgcatttatcatatgcccctggatgtaccacagtgttctttttttttttttttgagacagagtttcactttgttgcccaggctggagtgcagtggcacagtctcggctcactgcaacctctcatgactcagcttcctgcgtagctgggtttacaggtacaccatgccaggatgacttttttttgtattttagtagagatggggtttcaccatgttgcccaggctggtctcgaactcctgagctcaagcaatccacccatctcggcctcccaaagtgctaggattacaggcatgagtcactgcacccagctgtaccacagtgttctattgttgacaaggtaaatctgctattgtgattatatgctaatgtcccttatgtatagtaatcagagaaacatcagtcttcagacattctctaattccattaggtccaatattttcccttcatactgaaaactgctgacttccaatatggaggctatggatggtgttaggcatgtattaatagaagggagaaagtgatattcactggcacttaggaaatgattagattgcacttatcctaaatatttttctcaatgtaattgtttcatgcttttttattaggatcatttttcattatgaacgtagtgaaacttaactggctgttattttattgcagttaaattcttaatctcaccgttaggtgcttcagaggaaagactcttttatattcttttttgtattctggttgcctaacatatgcttggaacaaaacaataatgtgcagtgtaacatatctacaggtgcttcttaagttctaagtcctgagctaagcatatgacatacattatcttgtttaatcattgaaaatccccatgggctattagtctcatgttatagatttttaaaatgaaactttaaaaggtgtgttagtttgtgctgctgtaacaaaataccacagactaggtaatttataagcaacagaaacttattttctcacaattctggagatgggaggtttaatatcaaggcattggcatttagggtctggtgagggccttcttgctgcattctcacacggcagaagagtagaaagacaaaaaggcttagactagttccctccagcccttttataaggcacctaaccattcatgagtggggagccctcatgacttaatcacttcaaatggttccacctcttaatatcacaacaaagatttagtttcaagacattaattttgggggacactcagaccatagcattcacccttgaatcccaaacttcatgtgcttttcgtacgcaaaatgcattcattccatcctaatagccccccaaatcttaactttttctagcatcaactcagaaggctagaggccagagtctcatctaaattagtttttacctaaattaggtgaaacccaaggtaagtttcaccctgaggcaaattgctctccagctgtgactctgtgaaatcaaataagttgtgtgcttccaaaatacaatggtggggtaggcctaggatagatatttccattccaaatgggagaaatagcaagaaacggttaataagtgccaaataaatctaaagcccaacagggtaaacaacattacatcttgaggtttaaaaataatctttgactccatgtcccatgtttcagacatgctagggtgggggttgggttcccaaggcctcagaggaccacccccacccccccagtaaggctttgctgggcacggcccatggtgcagctctcatgggttgaagtcttgtgcctgtgactctcccggctgacattgcatgctggtgactctacagttgtggggcctcaagggtagccttgccccgcagctccattaagcattgccctagctgggactctgcagtagcttctgtggcagttctcttcatgggccgctagcctttctgaggaatcttttgaaatctaggtggaggtagccatgtccccatgcttgtgcactctatgcttctgcagaattagcaccacatgagtgctgccaaggtttatagcttatacatgctagagtggcagctgagcctgcttgagtcatatatgtggcagctgaagagtgctgcaccagaatgctgacagcagagacaaggaggtgcaggggagtcaatgatgaggtcccatgggtgcccaaggctccttttttgacatagtcctttcccctaggccaagcttgtccaacctgtggcctacggacggcatgtggctggacggctttgaatgcagcccaacacaaatttgtaaactttcttaaaacattatgagttatttttgttttttttttttaaagttattcagctatcgttggtgtattttatgtgtggcccaagacaattcttctcacgtggcccagggaaaccaaaacattggacacccctggcctaggccgtggcactctgggcctgtgatgggagggacagcagcaataatctccaaaatgccttcagggttgttgttccattgtcttgatgaatagcatctggcttcctattctccatactaatctccttattaaacttaaacattgcttggccacaccctgggttttctctctgaacttgccttttagtctttacaacctggggaggatcaggccaggctgagacttttccaaatcttcccttatgattatgaactctgtctataatttgtttttctcttctcacattttcctataggatgtcaggagaaaccattcagcaacctgaatacatttttttcttctgccggatatccttgtttatcctctaattctgccttccagaagggcacagacacaattcagccgagtgccactttctggtatgaaaggccatttctctagttccaatgagatctttatttctatctgagatctcatcaaaagggtcctttactgccatatttctaccagcattctgatcacaatcacttagataatttctgagaagaccgaggttctatccacagctctcttcttcttctgagccctcgccagaattgtgtttaacactctgtggatgtaatctaggctttttctagcctgcacttcaaaactattccagcatcacccattacccagttccaagccacttccacatttttaggtatctgtaacagcaacactccatttctctggtaccaatttctttctaggtccatttgtcttgttataacaaaatacctaagaatgggtaacctttaaagaacagaaatgtatttctcacagttctggaggctgagaagtgccagattaaaatgcaggcaggtcagtgtctggtgaggccccaccccatcgaaggcattgtctctccaggcagcatccccacatggtgaaaggtagagggtcacaaaggcagcagcgagttccctccagcgcccctgtcctccacttttttttttttttttttttttttgagatggagtttcgctcttgttgcccaggctggagtgcaatggtgtgatcgcagctcaccaaaacctctgcctcctgggttcaagcaattttcctgcctcagcctcctgagtagctgggattgcagacatgtgccaccacgcccggctaattttctattgttagtagagacagggtttctccatgttggtcagtctggtctcgaactcccaacctcaggttatctgcccacctcgacctcccaagtgctaggattacgggtgtgagctgctgcacctggcctccctccagcccttttatgaagcactaaccacttcccaaaaaggccccacctcttaacactaccacaatgtatattaaggttcaacatgagttttggatgggacaccatctttcaaatcatagcaaagattcagtaattttcccaaggccccaaggcaagaaatggacctggtttcaaatccaggctctctgattcaaagcaaccagctgctcaatcccttgagtggtgtttgttgaatctatggagatgggtggcagcctgcatgtgctgctggagaatatagccacaggatgaagggacattcagtcagtttcttcttttacctccttgatttttcctccaccacccctgtgtcaaggctgttaatttgctaaagcaaattttggagtaacactcgttttatttctttatacccatcatagatacaagcatcaatatggaatgttagctgattaccatatggaacacaggaactttataaccagataactcttttgcctgtttttaacaactttccacagttatgtgccgtaacgagcacatttcttttgagatgtatttcattagccatttatttaccaaaacagtttatttttgtggagtggaaacattatatgtcaatttagtacagacaaaaaagtttagtatgaatgagtgacaatattcaaaatatcttgtaatcatacagaagcaattgatcaaagcaaggatatcccgtggaactatactactctcttatttggattttatcattctggaattattgtttttcagaaatgattttgacactacagcaaggattcattaagataccttaacactttgataagaatttattattagattgagccattttaaatgccactattctaccttttttaactaataaaaatggtattttcatgcggttcaagctaatagttgctttagctaaagaagaaaagtataaaattataaatctatatttttatttttaaattaaagatttgaaactcaagtttctgtataagctgatgggtaacatatgattaagtgctttacttggctgcacaatgctttgaactgataagtcaaatgaacatgtcccaggccgaactaagaaaaccatgcaagcagccaaagaccttcatctgctgccgcagcagtgccctgtcagtgagcaagtagacaaggaagacgaatcatgagcatgtctcataagagtttgacaaaataggttgtaacttggcagccaactatgaacttgctaaaggtcaaaacctggagttggcactcttgtctcacagaactcgcttatctagatgtttcaaaaccgtcttccaatgtgccctgcttatcaaatggcaaggctaaaaacaaggaacatttgtgttgctctgcttgctccaatttagccgctcttctcttggactggcagctaatatgtggaaactgggttgcagggttattctaacgcagccgagtgaacctcacacagaccagggtaagcctgggccttgcagggatgtcctgggctctagcaagtgtggcatcagagttgatatctgggaaatgagcttatggatccaattcacagggagccatcatgagcagaagggagcctgaatgtggtagagatgatgggttttcaaaaactgtggactaggcctggtgcagcggctcacagatgtgaggattgtggatgtcaataaccatctatatttcaaattacatctatttcaaataaccatctatatttcaaattacactaatttagggtgtgttttaagtactttttaaactaatacctcttgataacagagtataactccttaatagtatttttcaaatagtactcactttttaactatttgatgcatgaaagagtggttggatgaatacaagcaattgagagcattttgtgaacaaatccagttactattctcaatatgagtttcaaatattttctgtagcataaggctttactccttgtttgaaggttggcaaattcaaggactgattttacccgcttgctatatttctactagcaaacacaaatctcctactaacttttagggatgaaatgcaggagtaaattgaccaaaaaaaaatactttagtttttttaaagctctctttaacttattaaatgaacaaggtttaaataaaatcaataaagtaataaagtgaaatgtggcatttttatttcttgaaacaaagttgttttaggcaggtacaaggctattatcagataagatctgaagaaataaaatcttttattaacctacaacttgaacctgtattttctttattatctttacttataatgatgaaagcagaaagctttatcatttttaactgagggaatggcccacctcagaagtcttcttatctgttttttttctttcaacttttattttaagttccagggtacatgtgcaggatgtacaggtttgttatataggtaaacatgtgccatggtggtttgcaacacagatcaacccatcgccttggtattaagcccagagtctgttagctattcttcctgatgctctctctctgcccacccccaaccccacccccaacaggcctcagtgttggttgttcctcgccatatgtccatgtgttctcattgttcacctcctacttataagtgagaatatgtggcatttggttttctgttcctgcattactttgctgaggataatggcttccagcttcattcatgtccctgcaaaggacatgatcttgttccttttcatggctgcatagtattccgtggtgtatgtgtaccacatttgaagaaataaaatcttaagaacattgtttgaaagagcattttctgtaagaaaattacaaggaaggcatttcctgcaagaaaattaacaagggacagggctactggcttcccagtcccccaaattgtaagaactgcagttataggaattttataacggtggctgattttgtgagtgtatgtttgtgtgtatgtggaaaaagtagaggatttgagaaaaaatactttaagctcttttatcagtggacatactctgggattggagaagaggaatcacgttggcttgattatgcttctaggatgatatcctacattaaccaataaaaactctttgagtgtgtgcctactgtggaattgaactgtgttaggtgctaaaggttgacgtaaaaattaaaacgaacaaacagcaaagccttgtcttcaaagactacatggcctaactgaggacaccacatgggtaggcagagcaaaagagttgtcaactattttgtcattaaatgacaagagcgaaatgagtagtgttggggcaaaagtcagagggggcagaactagtcttcatgaaagagatgggaatttgagggtagtgattatgacaaccaggaaagcagggaagacactgcagagaagtggtttagaaaaaggagcagaggtggaaaagcccaagatcttctgggttcagtgggctggtcataagagtgaatgagagggtccctgcaaggagagagtgacataagacagtcttgtgtcggtcgtggagggctgtgagtttcaggctaaggagtgttaatcttgttcctgtaggcaatggggaaatattgaaaacttttggcgaagggatcaccagaatgaaagtagtggtttagaaaaattattctagtggtggtgcagaggagggagagaattgggagaatctaatgtcagggatacccagaaaaaaaatttccaggaataatcaagagggtcaattagatgggcatggtggaaaaacagacagaagtatcaaaaatgattttcagactttgaatttgggtcaccagtggtagaatatagaaacacacaaattctgttaatttcaaagaaaagtgatgatattaatgaagctccctgaattgggtgatcagcatgtcctaagggtctctgagaagcaggagggcctgaaactgggccccaaagcctctgaaaaggatgatctagctccaggccatccactacagtagtcgttgaacacctggccacacataactattgacttaaaatgtacctagtcaaattgagatatgctgtaagtataaactacatatcagatttgagagttagaatgaaaaaaagaacatgaaagttctcataaaatttaaatattggttacatggcaaaatgatattttggatgtattgggctaaataaaatgtgctactaaaattatttttaccttaaaattttgtttcttatatagcttctagaaaatatactcacattctatttctataggacatagctgatctagaccttcaaagtaaagcccactaatatagcataatacagcagagtgaaacacacacactctcacacacttcatagttaaatgcatgtttactccatccattcagtctgaagtcttttaaaatgtgtcttgcattttgtgagtatatttctgaattttttgagcagggtatattgtagagatccatttgtttattttatccaaaacttaggttattccatcttactgaaatgaacatttggctctttctttcaaccagcagatgatgctacagctgacagtcgcaaaacttacactctaactgattacttaaaaaatacttatagactgaagttatactccttaagatggatttcaggtaagaattttttggggtagggcagattttatgcttacattcattctagttaagtcgagatgtgggcttttatggcactgagaagaggtaatccttgtttttaaaaattctatagagagttttttttttctttttctacttgaagtgcaaagggagaaagactgaaaggaacccaagtatttctttgacatgtataataaaaaattaaatgtgaattgaaaccttgacaataatgatgaaaaaatgaatgaatgttagtataatatcattcatgttttctcaacttagaaatgcctatttggtatttgtgagcttaaactgtattctgtaattttcagcttatgaagatgtttaataacaacttgaaattttgatctgggtgttttctctctttagatcatgaatatctctacaaacaagaaaataatatcttggtattcaatgctgaatatggaaacagctcagttttcttggagaacagtacatttgtatgtttaatcacgtaattaattcatgcatagaattctggggatttttttcattacctttggaatcacgagtactgtcatttctcaacctgttggactctttctgcagcatatggcaaagtggatctttctctccttcttgaaatgctccctgccttggctactttttagtctcctttgacgattcctcttcctctgcccatatttttaaatgtaagtgctccttggggctccatcttcatttgcctccctcttcactttgcatgctctcctttggtgaatttcatgcaaccccacagcattactgccctcctctctggcttgactctcgtatacacacacttaacgctaaccttctcccagatttaaactttaatttctagtagcctgctggttcctacatgaggatttcaaactcaaaatcccaagctaaactggttatctttcccccactgtcctagcacactgaaagcatcttattcttttttgtgagttcccagtattggtaaaagttacttaattctcctccaagtcacttatgctagaaacctcagaatcatcattgactcctgtcatcccccatagttggcgacaattctccctctgcatgtcaggtatctctcagtttccatttccactggacagtcctcgcttaaaccctcatttaatcttgtggtaatgagtgctctaacttgtgtccctatctgcattctgtacaccagaccactgcactccccatatctaggctgatatcagccctccgctcttccctctcatttcagccactgtgtcaccagagtatctttgtaaaagatagatatgattctatcacttccacatgcaaaaaaatagatctagttccacatcttatatttaggtcccagctatttttctaatttgttgtcctctcaccttccactctgtctgacaccagcgccccccacaaactatattcaggttacacatgacccttaaagagtctctaaacatccacgtcctttcccatgcctggcattttgcttacgctattcccactgttgagaaagttttcttttcctcatcctcactctcgcaggcatctttcctcttaggattaatccttccctttctggctttctaacattgatcgccacctaccttgcatcacggtcatttgtgtgggtgaatatgccacctctgctagattaggacttcccaaagcacaagccacatgtctagaacagtaccccctatgaagtaagtgcacagtgatggcaatgaaatggaattgttcaatttttctttgttcttcttgtttgacaggatgagtttggacattctatcaatgattattcaatatctcctgatgggcagtttattctcttagaatacaactacgtgaaggtaaaataaatgctttcttactgtaacatttaaataatccaagagtatgctatgttataaccgatttcaagtgtatggatacttaagattaatatctaagtaatgtaataggcactaaaactcattaattcagaatcagagtcattctcattcttaaagacaagttcagtgttttaaaagaaattcatttttagtgctttcaaatactagaaagcacagttaatattatattgttctaatatatactaataacataagtcaataaaaatttgtacttacacacatatttaaaagtaagtttacatgtctgatttgtacacctaatgacagaaccctttatttcctttgtcacagctttatgtatagtaagagcctccatagatatgtgtttttaaaagagttaaagtcgggcatggtggcatgcacctatagtcccagctacttaggagggaaggctgaagcaggaggatcacttgagcccaggagttggaagctacagttacctatactgtgccactgcattatagtctagaggacagagtgagaccccgtcaaaaaaaaaaaaaagaaagaaagaaagaaaaagaaaaggaagagttaaactttccatcctccagaaaagattccgcaagatggcccagaccatctcccaaccttcgggccccaccatatacaaactattctaaggaggagagcctcaccacagatcgtaaagattccatcaagagcactcagctttccccagttacccagctcaactccacatcctcacacattcaggaaaggttacagcttaatcatacatcctcttcatgtttaggatggatatgggtggccataactttaactacagctttttggttactcatggatttgacaagttgttcaagtataggaagttttgagacatgtagtgaagattacaaatttgtaaagataccctgtattgcaagcaaaatacaaagctggggattcccacccctgatcttccttttctaggataaataatattgaggagacaccaacactcacacaccaacactcacacaccaacgctcacacaccaacactcacacaccaacgctcacacaccaacactcacccaccaacactcacacaccaacactcacacaccaacactgctgtactcaggccaagcaaaccattccctactgcatttaccatctcaggatggtgactgttaatcgtaatatttaccctggatttgctgggctgggctcactctcctggacatgaagactctatgttctgttaaaattaactgtaagtgaatcggaatcttgtaccaactttgacacatctgttgccaattaatggattattgtttgtttaattaagtgcttcttatttctatctatagaatacattcacttaatttacttgagaaacttttaaaacttcccagtgtccaggttcaatccccagatcagtaaacagaggtttctggggtaaagccagaatcagtatctttttttctttttttgagacaaggtctcattctgtcacccaggctagagtgcagtggtatgatcatggctcactgcagcctcaacattttgggcttgactaatcctcctacctcagcctcctgagtagctgagactacaggtgtgcaccaccatgccctgctaattttcaattttttcttagaaatagggtctcactgtgttccccaggctggtctcaaactcctgtcctcaaacgattctcccacctcagtttccccaagtgctaggattacaggcatgagccactgtgcctgatgagcctcagtatattttaaactgtcataggtgattgtaatggcaaccagggctgagaacccctgaataacagttgtccatgttaaagactaacatatgaaggtaaggtagaaacagaaaggtaataccagctcaccttactatatagccaggttcaacaaaagccatttgatgtgcacgaatgcgtgtattcccctggtggcccttagttggccagccacggttggagatttgtatttgttgtgtcactggagtttacccgtgtatttaactgcttttgcttttttcactctgtccccttccccctgccatctatgcttcagacagtatcgaaagtactacttttaaattctaaattagtttatgccacacctatgccacctacagtgccttcccatcacactcaaaataaaacaccagctctaaccctggcatcctgaggcctgtgtgattgaacacagtctgcccggctgaacacatctcctacccgcttctcctgcactcggcatgcttggccagagcttctcgtctcatctgcaccttaggatcacttgaggagcttttgaaaaaacacggatatctgtggcctaccctaaagcaactaactcagcatagctgtgggcctcctggagattccatgatgctgagttgagaacctttaattgcacagctctttctttttctcaagcatcaccctcattcccatctaaaggcaaaatcacttgctattgcttcctcatggaagcttctccatcatcatatgcttctctctattaactcaggtccagatttcttgggtcactttgtcaaacattgtcccctgccatgctcttccacccacaccccacaaatcagtctctgtcacgttaacccattttagtttcatcacaacattttgtgatattttgtcattgatttctttgcttattttttgcctgccttatttggtgccagtttccctgtgatttattcactgccacacctctgtgcctaggacagggccacatagcagatgctgaacatcattgttaaatgaatacatgttttattgcaaagtgctaaattataaagctattgaaactaaggatctatatcttctactacttttctttctttttttttttttactttcaagagagtccagtagaattttctgtacagcatatacgttttgactaagtgactcttatgaaatgtatctagaaaaaagaaaagtctaatttgattacatttccttggaggtctaccttttagtgttttttagatcctactatgtgacttctccatgactgagttagtgctatcacttccaagttgtggctacaaataaataaatgagcaagtgagtgagtgagtggataagtacccccacagtctggtatgaatgttctcctagcatctctgctcattgcctagtgctctggaaatagagataatagttgtgtcatcgattctatgttgacaatgttccagaaccctgctaagtgcttctcatgcattctcatgcatctgagattgttgccggcattatcctcatttgtctaaaaagaaaatggaagcttagaaagaaacttgcttcatgttacacagtgaaagcctgaatccaggttagaagactccaaagcctttgctcttaaatgtgatctttcctatctttgcattcggcttctctttgctatgatgctcttttactctttcccagtcaccctctgtcactaacctcagccaaagaatcatcttttccataatcctctctgcctccccaaggcctaatttatgattcctgcctctcccacccacctccattatatctcttggcacatcctattgtgattattttattgtcatttactattgcatatcctccattccactataagctgctccaggggagggactctgtgttatccagtaatgtctgatagatgatagctgccagtgtttataaactaaatagaataatgaatctgtttcaaaagatgaagtgaacataccaaacatcatgggttttcttttacaacccatggtggtttgtcatgctcagtgatctcaatccatcttaatagttttagctggtaccacaccttttggctttagtgaatattttgcttgaggttgcccagaaacaagcatggggtgtgtcaaaataatccaggattcaagaaaggaatgtatgactcccgaaaagtagaatttaataaatatttgttgacatgagagcatagaagggagagaagtgataaatagttaaggttaggaactctgactttgtatctcagctctgctattatatagctaggtgtccttgggatacctatttcatccgtctcatcctcattgatacaattagaattttattgtaatttgttgtatttcttgaacactcactatgtggcttgcactagaatagactccaggcatccaaagataaataagatacaatttcttacctctaggagtatggtaaagaaggcagacgtatagacaagtaacttatttgaaaatacctttaatttttatatgcatctatattcagacataatatttcataaatgcaaatatgtgatcatatacatttttatcttcggtcttatttcttcccttcttcacttggctctctaaagtctaatatgtatctttccatatttttatatttttcttcttgttcatataactgaaaatatatagggatgtttttagttattgcttggtctataaaaataaaatcctatagttttttgtaaattgcatttctcactcaatgataccatgtgaaactcctttcaagtcatctggttagctctgattcatttttttttaattaatatcactttatttttcagaacagctttaggtttatagaaaataagcagagagttcccatatactcccttatcctccctcccccactttcccctattattaatgtcttgcatgagtgtggtccatttgttataacaaatgagccaatattaatatatcattattaatttaagtccatagtttacattaggcttaactctttgtgggttttggcaaatatatggcatgtatctaccattatggtggattctgacaaatctatggctcttgacaaaagtatgatgacatgtttcaccattatagtattatacagatgactttgactgtgctaaaaatccctgtgtttcccccattcatcccttccttcccccagtctccaagcaaccaccaatctctttactctctccatagttttaccttttccagaaactcatattgttggaatcatacaatatgtaaccttaccacattggcttatttcacttagcaatatgtgtttgagattcctccatgtctttttgtggcttaatagctcattcttcttatcattaaataagattccattgtatggatctctactacagtttgtttatccactcacctgttgaatgacatcttagttgcctcccagttttggcagttatgaataaagctgctataaacatttgtgtgtagatttttgtgtgggcataaattctcaactcatttgaataaataacaagaagtttgctggtaaagttattttgccttggagttttctctatgtaaagtttcttatatctggattcaatttgtttattagatataagactattcagaatttttctcacttttaagaaattatttttcaagaaattttttgcttttctctaatttttaaaatgtattggcaaaaaaatgtttataatagcctcttatgatcttttaacatctgtggagtctgttgtgatatcccatttttcctttctgataccagtcatttgtgctgttttactcctaagttttactatgtttgcaattttactagtcttttcgatgacttgagttttggctttgttgattttttctattatgtgttttctactttatcaatgcttttacctttattatttcatttcttctaattactttggatttagtttgacttcctttttaaaaaaaaattttatttccctatgcttctgcagtcactgaaaatttgactttcatttctagctttttgagatggttgttaaaatattgatgatatatgtattttaattttaatatatcttgccagggggcttccaaaaactttataacactttacctttcatcatcagtgtatgaagttaaacatttcttcacatcaccatcagcaatagcatcatatatcgtttaaatcttttgccaataaagtaggtgaaaagtgaaaatttacatttttctaagtaggcaatcttagcacactatggtgagtgctagggataatgtttgtacaaaatgacatttttggtgcactgtggtcctggaggaggtggtgccagagctaggttgtagatgaactccagaggagtttgtatgagatgatctctaggatacttctgaatcccaaaattctcggaggaaattataagatatgataacatgtgagaattatacaatcatatattaccaaacctatcatcttggtctcctatagtgagtggccaaattatcaagtatcacagaagcctgaaatgtctgttttctttcatagcaatggaggcattcctacacagcttcatatgacatttatgatttaaataaaaggtcagtgacttcccaataaaatctattaggctttcctactgtcatatttttaaggaaaccccaatgtgagttattctttttgataatatttcctttcatcttttttccaggcagctgattacagaagagaggattccaaacaacacacagtgggtcacatggtcaccagtgggtcataaattggttagtgagtctctccagttgtcagaaaaatataggctcaaatttttcataggcagaagttactaaccctgatacaaagcagacatcttaggaactcaatacttcactatagaacatagtgttattgcccaggatctaatgtttgtctgcagctgaacttctctcttccagaatgcaactgccttctctctactcactctcccaataaagaaatatacaagcatatatcatcctgtagaagtggtcagccttctcggtcttctcatatactttagcattcaaatagtggtagttatgtacttctcatttttaacacattattaatggttttaggattattttgggattataggctgtacacttgtaatttaagaatgagagggaaggagtaaatgactcttcctgtttgaatggaatatttgactatggtaatccttacatttgcaatagataagtgtttctacaattccgggataaaaatatgacatgtattatagatatcaatgcttgttttttttccttctaggcatatgtttggaacaatgacatttatgttaaaattgaaccaaatttaccaagttacagaatcacatggacggggaaagaagatataatatataatggaataactgactgggtttatgaaggtagaaactttaaagctttttcaaatcagaaaatctataagcttttaaaatagttaaatgtttcttttgcaatgggaaaatttaaatgagattgaaaaaaagtttcattgtttaaaatgtcatcagatttctcttagaactcacagcaccagatgtctccttgaccaagaatttaactattcctagcactcctctgtcctcattgcctgacaatactcctcttgtctctgttatattgatacaaagggcttttctgtgtaggtagaccttttctgcctttactggaacataaaagcctccagattaacatcagatatttctctaattaagcctacctaacccgaaagttactaaggaaagctaaataatcccatcacattgagaagatgataaaataatatatacaggttggagagtacaggggaagaaaatgcctattttatagaggatttgtatttatttgaacttggacaaattatgatttcctgtttttaagaataaaaaagcaattagaaaggcttaggaaaaagtgactaataaaactaaaaaagttaaaaaggaatattctcccttttaggatacagagttgtcgaaactattaggaacacattttagaaacttagaaaatattagaaaaacattttttgtgtctgtatttgccaagataaaaggcattttgaggctgctccaaactgttcacaaggtttcctcatacttattagaaagacttatctgtatttcatcgtattatttttttcttctttgtagtttaaaaaaataatttttcttcatgacttaattttagttcttaccaagtccaagtcaagtttagttgactcattataacaacaacaacaaatcacattaaaagaaagataacttttcatgtcctagaaataagtgcttgactaaaacttacaatgaaatttactagcactagctacttagagattctttaacccttggacagcacaacccagcctccaggatccttgacaagagtggcctctttccaaagctgtgaccctctctcagaaacagctggccctctggaagataagagggcagctaacactttcattctttctaaagtagataattgctggagggagtcttttgcatgttcacgactaggccattcacatgcagaacagcttcacagctccaatttgggcctctctaatagcttcagttcctagaaggaaattactacattgtcaatacagaaaaatatgtcctgcattccaaataaccactaattcaagacaaacatcactacctgctaattacacttacaagtaattctaaaaaacaaaatcttggtctgattatattgattttatgtaattgcagctgtgttatagaccagaatcaatgggtaaaagttgcaaagaatgagaagtcaactcagtatatgaacaagttcttactataatagaaaccatgacttggagtcataagggctgggttctagttcttgtctcaggcaattcactggattgctccatgcctcagtttccttctttgtgcaatgagctatgaatcaccacccagagactaaatatgatatgttttgtaaattctaaattgctacataagagtgtatagatcagtgatatagatatgaggcagtcaaaggaagaataggctgcttaacccggaagtaggttttctattactggaaatactaaaatagaggcaggaaagggcagtatagcactgagatgaaaagcatgagtcaaaggagatttgggttggtttttgattctaccaattcttagccatgtgatcctagacaaatttctgatcctcttcaagcttgtctcactttatcaatacaatgggttattgtgagccttaactgagatgatagatgtcaattgcttatcaatacctggcgcatagttagcactcattgaatgtcagctgctcatcacaataattattattacattttattacagtaattatttttgctattattcttgttgttgaaaaaaagcatttggaagtaacttgaaaggaggtatcaggcatctgaaaactgattagaatgcatgatttcccaaccctaagattctagtttctatgcttttgcttttacatttacacttacatgagacttgtggaatatctaggcgtctccacccagtccacttaattcctccattcccggttggtgaaggagttttcaacatattaagagccagtgattgaatatctcatgtatagaccccataataatcatagggaagagctatctttgccagagattgagaagaagcccgacaatgtactggaaagcaagatctggtcttttatttgcctccctctttgaccctcttctcttacccatcagcatatacaccagagcagtgtgttaatctaagggagttttcagtttctgggctgggcaaggagatgtttctcagtaggggtctcaatggagttccttgccattctaaatctatccttcccacaccttgtttgtgccaagagtagtaaactctgggcaccatattggtttgatagcctggagctacacaccacccaccagtaccctgcgggctcagtacaaactgagcccagttggggagagtatgctggcatgttgactgtttgaaaattagaaaggagaatcagcctcctgtgtgaaatttacttttagtatgttttgaggcataaatttagaggattataagataaagaaaaaaatgtagagcttatattaaatattgcatgctaaaatattctaaaatggtccaacgggttacttatttttacaatccagatatatccttgaagattttatttttattcatttgtattactctgattttggaagcccagcaaatgcaaagtggttcattagttgaactctactgtaattactaaagctaatgagaacaatattttgaatgccaaagccaatttatcagctacttcttgtaacagaacaatttatgtcttttttcagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggtctgtgctcctgtttgtacagtggttccatgatttgatgggaagagaatggtttcatttaatcccttcttgctaatgaaaatattgtcagtctctcttcaacagcttgctgtgattactcttgctgaagtcaacagcatctggcaattttaaagtatttttattatcccaggaaagagtgtgatttaaggttttgtaatttctccaaaaactttgaggaatgacaagcagaaaaaatggggaaaatgctttagaaagagataaggggaatgaaaatgcttgaatggaggaaaagagaggctataattgaattagaagctcgtctcatttgtagaagttggattgtgccctcgacgaagttgcaaagctcagttatatatcagattgtattactggttaacgggatacatgactagttttagtggttctattatagatttggcactaatgtaaatttttcatgtcctacatttggaataatagtgtcacgtcttggttttcaaagctgttctcctcgtcagggttgcgtgtttactaaaattgaggagctttgttaagcagcgtaagccgggtgagatggggtttagaagggaaccaggaattcttcactagtaccgtaataataatggctacagtattgtctgcaggagaatctaatagtaaagtgttttttctgtaagaaatttggaaaaggggatttttatttttaccaactcactcaatttgctttatgaagagctgccattttaggaagacagaggaagttaaaagaaaaaaaaagatcagagactaaatatggagatgtgttttcagtggaatgttattttttgatgagcgaaactggcacatacaaaaaaaactccataaagtgttctcactaaaaatatcatattatttctaactaatctgtcaatcgaagatctatgtgtatatttaaaaaggttttataggtttcagtcataatattgattgtaaagctccaacatagtgaacctgaatttagagtggaaatgatggcttcctaattgacaccgttgactcaggtaaactgatttttctggtggatggtgtctttggcagaacccaaggtgttcttcatactgacaggcatcaaagacttttggtctcagggagacagggtatatttgcaaataataaagttgattttaagaggtttatccttgcttgcacaaagtgataaattataaagatataaacattcattatttaaacagaagtgctttggaccttcaagttttatatagtgtgtatatatatatatatatatatatatatatatacacatattctgtttctgcctgaccatgaaaaggttgcatttcatgactctcccttatgttcattttatgtatattaaattgttggaacatgtctgattgtgataattttatgaccataatgcagacgtttttgtgcagttttaaaatgtgtgcaacgatgttacttttttttttttgtcaataccaattctgtgattattttttcctaggcaggagctgtgaatccaactgtaaagttctttgttgtaaatacagactctctcagctcagtcaccaatgcaacttccatacaaatcactgctcctgcttctatgttgatagggtaagactcttgtcctgaatgcttggcttgtaaacagttttacactttctagggagaacttttcaaaagtgaatggcaaagtggatcacagcctcccactgtgtcatccccgctgacagtcattcattctttccttcagcaactctttgttgagcatcttcacgtcctcaggctgggcacaactctagagatgaggatgacaatggacagagcagccagcccctggtgttatggagcctacattcaaattgggggagacagacaataaccagataaaaaaagagcagtgtaatatgccaggtagcaataaatgtggtgaagaaaacctgagcagagcaaaatggatggggccgatgaggggaggtcagggaatcctcatggataaaatgaactgtggcagtgatgtgaagagcaggagggctccatccacaccaatagcagggggcagaggaagagcaagtgcaaaggccctgcagaggagatgtgcttggggtgttggaggaaatgcaaggaggttggggtgactggagccttttgactgaagaagagagtggaagggacaaggtcaggtcccaaagagccttgtaaggcctagagaaatgcaggaaatctgtggattaagtttagggagctccacggtcattttgtgctccaagacttcacttcctgaaatcatgtcagtggtttgaaattccgccatggagcaccttcagccccttgtttattttcctgtaaaggaaccaacatactgggtacaatttacggctctctgatagctccatatttactcatttctgttatttatttggttttgttgctgtttttttttttgttgttgttgttgttgtttgtttgtttttttgagacagagtcttgctctgtcgcccaggctagagtgcagtgatgccatctcggctcactgcaacctctgcctcccaggttcaagcgattctcctgcctcagcctcctgagtacagctgggattacaggtgcatgcctggctaatttttgtatttttagtagagatgaggtttcaccatgttggtcaggctggtctcgaactcctgactcatgatctgcccgccttggcctcccaaagtgctgggattacaggcgagagccactgagcccggcctgttgctgtttttaaataacaactagcatacattgagtactcaccatgtaccagacacagggattatcacatgctttatcttaggactctttaaagtcagtctgtctttccaacaactgtcatcgtgtgcctgttcacagataagaaaatgaggcctacagattaagaaaatgaccaagtacgaatctgtattcaaacctgactttctggcttgaacgaacaagctattagatactgcttcgtgtctccctctgtgtgattacagctggtgccctcagattcctgaaggcaccatcacagcagtacggaagcatccattttctctggagttgcattaagtacatcaggaaggctgtgggctgtgctccgtggttagtaattcattattttggttagaaatgtctgtagtaacccattcattcagggggaaaatcgattagtaagtttttaaaaatgtttctgggtttgtccaatggagtaaaaatttacccaaaggtttcaaagtctgcctttcgattccatccagccacctttaatcatcatcattgatgggcagcctctgtttctactcccaaatgtccatagaaagcctgtgcccttgtagcgcttatcatcagtagatgatagaaaacattcagataaatgcccccaggagtgataagagagatacgagcaatagaatggaggcattctgaggaggagaacatggggttttcacgaccccaggaacaaaaaataccccctggagaatgtgcagattgagcaggttggcttccagcagggtgcagtgaggaggaaggacactgaggcggaaaaaacagagtatggaaaagtcagtgcttcccaggagaagaccagcagagcctggtgtggccttttggtctgtcaccaatatctgcctgtagggaggatgagccatgagcacctgctctgaaaaagattccatcggaaaggggctttagaacttatcaatggtttataaactttttaaggacctggaaacctttgttcaagtgagatataatatagaagtgtatggccagaaagcaaatgggagattgcttctcagttttggcaggtctagtccttgtcctccctccttcccgcaatagtcctgggagcttagacagaacctggagtggttccaggacacagtcacaacaccgctgtgaggtacaggtgagagaaccgaggctcagagaggtaaagtcatttgctcaaggtcacacagcaagttagtgtggaaggtgggaataggaccaaggcctatgcctgctggaccaaaatatttgaataagttagttaaaaatgtattgagtccttctcatgggctgggactgtgctcagtgctctgctcttgctgtctcatttattccccaaagagacgaagtctttcccacttacagatccgtttccaaggcacagctgtgtgaagtgctgggctcaagaaacaagcaattctcaggacggatttttggccttatgtgaattcgtcaataagttcttgttctcagtagttctttaagtcacacttaagactcactatggagattttgtgtggaatgtatattaccaaagaatattgtttttttggaaatgccacaggaatgtgttttttagggagtttaaaatatagctctggtctctgttaacgctggtaaggttgcggttaaaatatagctctggtctctgttaacactggtaaggttgcggtttttctagaactagactctagatgctctctgggaaaaatgctctagtacatgatgatacaccgttttctggcctcatgcaaagatccagcagggccaagcaaaaccaggtgagttacgcctcttagtaacctgctcagcctgttacctggtgatttactagttcctggagtgggaagcctggccaggatcagtgcctctccttcctctgcccatgttaccctcattagttttcctgttaggccatatcccttcaccacagagcctgcagcaagtgaaatccacaggaggatgaggctggtttgtgactttgttaggaattagcagaaatgggtggaagccctgcttctctgataagtgagaagggcagccaggctgcgtttccaacaactaaggcctgaacttgaaccagggtgagtctccctgctgcctgcattgatttagtgctaaagttgattagatttgttatgatgctattttgtgttcgttgttcataatgagaactggaaagctcaaaaatttgaaggaaaacagcacataatgtaaaatcataaatctcctaacttttatctagagcagtacattcattgttgactgaagtaagacaggttctacgcagtagaggccaatcctgcaatcgtatctccagtgtgtagtagggtgcctgcgacatagcatatgcccaaccaatatttgtagaataaactaatagataagcagaggatggatggatgggtggatggatgaatggatgagtaagttatctagatggctttgtgtgtatagaatagtggttcacgctgccagcactatggatagacttcaaaatgaccttgcatagaaatccctccttttatctcctctctgccaaaaattctgtggcctgaatctaggggattggaaagggcatgttctactgtagtaaccccacccaacatctgttgaatggctctggggctcatcacacccagctcatgacataccccatccctgctctctctgctcctggatgacacaatagatataaagtcttgctgtgtcttctctgaactgttacgacccctggcctataaagctgcaacatcaaagcctcagattgtcacacaggatataaataaactggaagctagtgacatctgcacattaggacctgcatgctacgactgtgcgggtgtacgggtgctgcagccctcagatctgcttcatctcatcccacccattcctctcctgagggatttgtcagcgaacctgggagggttggcatccccatcagagcagagggtggcatggagcctgaggccagcactggcagtatgcccgcttcctcgggtgattcactgaattaatcattccacggttgcagttgctctttgtagcatttttccctccaatatgatttccagttgatgataaataccttattttaagtatccttaatgtaccaaaagaaacatttacacaaattaagggaattaatattacccaacaaacatttattaaatgcttactgtttgcaaggcattatgctgggacaggtggtcactttacaaggggattctctgttgtgtgattttcaacaagtctctctcagtgcattcacatataatttgccttataaaattaatttagtttacacacaagctctctaggaatagatttctttaagtgaggaactttatgctgaaaagaaacaagaaggtgaagctagctagcaacattttccaaatggatgggtggaggtttcatagagggagcgagtatgaactgggaatctgaagccaacagcttgaattgaatcccggctccaacacttcccagttgggcgatagtgggcaagttacttaaatcctctgctgttaagtttctttgtctgcagagcatgatctgcagtactcacctcatagggtggtcatgagcttatgtcaagcacttagaatagttcctggcacatagtagactccacatgggtgtgaacttattattttacatccagaaattactccgtcattttagtattaaaatcaaccatattcccgttggactaatccagctgcagaaggtagaagagcttgctggctcatatgtctaacctgggtaagttgtccaggctctcaggaaggcctggactgcaggggtggtccctcttctaccccaccaaaaccattacataagaaagctactcagtattggcctgtttttgcagaataaaagcagcatgcagtatgcaaagcatagatgataatcctgctggttggatttttctggttttaagtgggacttaaacttttcagtaaaaagtacaattgagccattggctttatttatttattttgagatggggtcttactctgtcacccaggctggagtgcaatggcatgatctcggctcaatgcaacctctgtctgcccggttcaattagttctcctgcctcagcctcccgagtagctgggattacagatgcgccccaccatgcctgactaatttttgtatttttagtagacacagggtatcaccatgctggccaagctggtctcgaactcctggcctcaaatgatccacctgtgttggcctcccaaaatgctgctattacaggcatgagtcactgcacctggcagttttttgttttttttttttttaaatgattctttgacatctcagactggcataatcttggctcaaggctgccactgaagggaagtatgtttataagaaaattcaaaaattcctgtctgcgccacgggtgaactgccttgctgagcatgcacagggtgcagagtacacctggggtcatggagagtaacccaggccatgcagagtccaggaccataaacctttgatctgaaaatgggcagggaagatgactgatgcacgtgagtttcctggctgacttcccaaattccattactcaatgttttcaaatggggaaaggttgcttttatattgctgatttctgaacctgatgtttaatttatgactgttaatagataaagctatttagtactgggtgatccactaattattgtcaaaaagttgttccccccatcacataccccttcgctctaccagagcacttttaaaaagaagaatattgctggagcccaaattcctaatctatgcccatggaattttcagatgttgtatgtatgtcagtggagaggcttttcccacctagagagaggtacatcagtttcatcagattgtccaaatggtttttggcctgaaaaaatagtaaccactgatataggacaggggttaacacactagggtttatgggccaaatgcagtccactgcccatttctgtgtggtccacaagtaagaatggtttttactttttttttttttttgagaccgagtctcactctcacccaggctagagtgcagcggcttgatcttggctcatcacaacctccgtctcccgggttcaagcaattctcctgcctcagcctcctgagtagctgggattacaggtgtgtgccaccacacctggctaatttttgcatttttagtagagtcagggttttgccatgttggtcaggctggtcttgaactcctgacctcaggtgatctgcccaggttttacatttttaagtggttgggaacaaaaatcaaaagagtaataatatttcattatacatgaaagtttaatgaaattcaaattttagcttttcagtggaatattaaatgaactcattcatttaattatggtctctggctacatttgtgctacaaaggcagagtggagtagtgacagagatgtggaccacaatgcttaaaatacttaactctctgacccttaattgaaaaagttttccaacgtctggtctaaaaaactaatttcagaaagcttcatttttctgttgtgcttttcatacttccattctctttgcacagatttattgcctttcttgggtaaagtgtattcacctttccaggttctcatttagctcccctgcattgggcagatgcagaagcgtcagactggatgagatgtctctgtttcccggcatggaaagtggcagttgcactctcagcccctgcagcctggcggtttgtgatgagtgcaatgagacctggcagagtggtgtgggagaaggaggtttccaagaagacatcgtggatgaggggacatttaggccaagacctaaggaagttagagcttggcagccacttcaggctaaagagcaagactgaacaaagagggggcaactggggaaactcatggtgtgttcctgagaataccagccacccagactaggtagtatatagtttcttcagaagcaagtaaaaggactgaagtgaaaagggaccccaatttacagaaatgcagtgctctgcggctgagtgaaggggttcggtcctgtttcagtacctgcgccttacagcagggtagcatggaagcccggtatcaccaggcacattcgcacattaagtgttcccagctgtaaaatggggatgatgaagctgtgaggggcttaaagggctttatccagcacctaatccatcccgagtgcccagtaaatgtctgttgtgtgattaggtgtctgcgaagggagtggagatggaaattgatctatgaattctgaagaaggacaaagctatggtccttcagtatgacaatatgacaggtcccacaggtgaggagagggctttgctttcttctgtgctgcattccacggacatataattagtgcctgtgttgagtcaggcattctgctaggccctggggacaccctgtaaaagagcttgcagtcaagcaaggagaggggcaggtccagcctgtgaaggagagggcaagtggattgtgtgagagcatttgggatggggaggagatacagccaccagaccaggcgggaagagggagatgaacacactcatttggaactctctgacaaaaaagagcaaggctgcaatcagacactcgagagcagggatttgtgaatagtaatccaaaaccacaatcggggaggaggagggagaaaaagcataaactatccattgccaataatgtgagggaggccagcagaaaagtaaacaatgaattccatgcacttcactataaatcagaaggtggttccaaaaattttttaagtatgtgttggggaggatgcactactagagatacctctgtttacataaatttatgtgaaaataccacagggttttttcatttctttgcagagttcatgttttgactcttgagaaatgtctttttagaatatatttctttgattttcaaagtttctggaggtgtgagtcaattttttcccctttgaaaatgaagttgagaaaagggttagctgtagtttcaccctaatagaaagaattttctggagaagcatgtaaaatacaagaaacagtcaaatcttagccagtgtctgtggcctcacttccctcaagacagcagaaaggagatgcgaaaacattacccttgactccctggcattaccaaaggccaagctgaagacttgataaatcctgagctcgtggtttgagtcacgcatgttaagccactgtagaatattgttgctgcttttcctgttggatatattttaattttcattccaaattaaattacactttaagctttaagaaaaggtgaaatattatattaaatggtttcattaaccatttataattctacttcccattaagattgatttcttttcactgagtaaaatgtctatttgtaccaaggtctggcaatagtcatgttcattctctctctctgtccttcctttctttcttccttccagggatcactacttgtgtgatgtgacatgggcaacacaagaaagaatttctttgcagtggctcaggaggattcagaactattcggtcatggatatttgtgactatgatgaatccagtggaagatggaactgcttagtggtgagactgaatggggatgttctgcttctagagcaacatgtgatcagagggtctgtgcagttggggagagtgaaggctgggaatcaggaaatgaagtttgagtttctcttctttctgactctgtctgatcctgaggcaataaaatcttgaataaaactcctagataacctgccatcccgaggtgcttctatttctcctacactgactagtcatactgttttagttatggatactatcacttgggaagtggagagggggtgactgaccacaagatagaatctgatgtaaatattttaaaaaccaaagagggccagcacctgcaagctcaacagagtgtgttttaataaagataatgtagggaatggggaataactggctgagtgtgtgtgaaacaaaacaaatacatgaggccacaaacccattaccatactgtcactgtctttaagcaggaaacagctttagaatggaaataaataactgccagtctgagagggtggcaatcctgaggccaactctgttcatccaaccttgaggtgctgggaggcttctagccaggagaccatgaggtccaactaggatgacggtcaaagttaaagtccctctgggagcctgcagcctgggaggggtggatcctggaagaggtttgctggcatatgccaaggatacctccccaatcccccttatctagtcacagaccctctgcctacacacctaccatccctgctctcatcctggctaggctcagggcagactctcacctcccagacctggagcctcacataacttgattcacttattaatttatgtaacaaacatggaattcctgttatgttccaagctctgtgctaagctatggatttttttaaaaagtgaattagtcagcatgcctgcccccaaaatgtttctgttctagttgggaatattatcaaagtaaataataaaagctgccacttatggtatacaagtcactgtggaagctgaggatcaacgtttgaggagctagcgcaggtcacagggcacagtcagaattcaaactgcaaaacccaagctctttgcttgctgccaatgaaatcctcataatacctcattgtaccctaaaaagggttcaaccaaggtacagagggaatagagtgcaaaagaagatgatcagctctactaagggcaggcagactggggaaggagatgatgtgggagagctatagagtagcctggggtaagttgccgtgtgctgagcagataaggacagaacgccatagaagcagagggctgtgcaaaggcatccagtgtgaatagcttggaacatgcaggaactagggactgggggagaggtgtagtggggagcaatgaggctagagatataggcaaaggctcaggtgccattcctggagtttggacttatctcgtaagaaatggggagttgtttcaaggttttaaagaaaagactatcacaatgggacaggcctatctattgctaactaaggtcagcagagaagagcagcaggatctccaacaaggagattctggcaacagaccctgggcaacctgctgaggacatgaacaaagcccttagctgtagagaaggacagagaagtcaaagaactaggtgacaggggctgaaggaggtgattatgaggagggcaggaatctagaatgacccccaggtctctggcttgggtgaataggtgccactaactagaagaagaatgagggagtagaacaggctggtgggacagaggaaaacaaatgaaattctctttagttttgtgcatgctggatttaaaacaccagtggagcttccagaaggacccaggatataactttaggcaagagagtcaaatgatctaatgtaatgacttgaaaaatactaacataaatagaaatatatgaatggagatagctctcagttattataagtacagctctatttatattaccacaaattatggctatagatttcatctgacttctctttgaaatgctgtcattgtctctttcccttcctaggcacggcaacacattgaaatgagtactactggctgggttggaagagtaagtgttataagttgtggggttttatggatgagtcagctactcagctatttgatatgcagctatttaaaactagggctctaagtgatacgttattaatagcaatattagttaacctatttctcaaaatatgtaaatgctccctataaagatatctttttgtagagaatatataacacacacagttggaaaaagtaaggggacaagtgaaaaatcaaaagcagagcagacaaaacatagcgcactcctggcaagttgtaactcccagcaagttaaagggtaaccatggctgaaagttggccaaggtatccagtgacctcacatttgaagttatgtgctttaaagacagaaaacacaggttctgtccccagcctgcacagttacctaaggagaggtcactataacaagcagaaaaactcagcagcaaccacacagtgcccactatgcacctctctttggaggaaatcatacttgcaggcttatgctttattaggcgtccagatgcagagctttatccaggaaagtgtggtgaccctcagggacttgtcatgcttctcagtcccactgagttatatacacattgcacagaattaccacccagattgctatggccatagaatgtaatgagttgatgaaggaactccagtcatcatgtcaccttgcatggtagatgaggaatgaatctcacttaatttttatgatcacttctattaagccccctttaagagggaaataaagtgacccccaaaatgtaaagattttatacctcttggatcatagaggtgaggtccccagtccaagaagacaaccccttctagctgggctcagagctccggcagcattcacacgtcctttttcttcaggcattgattgggcagaggggagaggtttgccaacatgaaaagtggtttcctccatggcaagagacacgctacacttcctcacgactctttgaaaaaaatatgttttttcctctctgtatttaaccagacagatgccacttttcacacatttctactaggcacaactccatccaggggaaacagggaaatgtattaaaaagataaggctgtgaacacaggtctagagaggggaatgtgtttcaaagctctgtaatgagaacaccaagtgtaccgcacgcctcagcttgctccataaatgaattcgctttgaatcactaaatagaagagggaagcatttttcttccttcccaaaatgggagctgatgagagaggaaacatcgagggcgaagtgaaccaacaattttaaaagaccatctcctacctgctctcaaatgtagctaggaaatcaaaatcgtaaaccaacatattcctttcaggctgggatagactctcttctacttaaactgcattatgttctgagtactatcttttattgaactgtaaaaaaatggaaatttgttctatatttctatacaaatattttttgtaaattgttgatcatatttaacaaaatgaaaaggcttataataataactatatgaatgttttcatatgaaatatacaacagacattccttatagtatgtagtccagaaatggttaaatactaagtctgagtttcaaaaagaaatatgtgtaaaaacaggaaagaaaaatatccccaaattgcaaaccacccccaacctgaaacaatataaaataatatgtctgtttcaagagagcacatttgtgacactgaggaaatttactgctccaaactgaaaggttaatgctattttccaggtgcttgcagccagaagtcatagttatcatccatagagaaaagatgtctccaaatcacaacaacttctatttattgttttctacaagcctctttatatacattctctcatttactgctcacgaaaattacctatgagtatggtgtttttgttcacattttatagaaagataattttctttttgagacactaattttaatttggcatataaatggagcatggatttttgagcgtaggtattggacaggactttctaaaactaaagttggtactgagatgagacactgtgctttaatgttcttttgttctctattattttctagtttaggccttcagaacctcattttacccttgatggtaatagcttctacaagatcatcagcaatgaagaaggttacagacacatttgctatttccaaatagataaaaaagtgagtattcttacatattttatttcatgttgacctcttttttttttttggaaaccaacttgaagtggaaatcatttggtaaggtggatcaatgtgtataaaaatcagattaatttaaactcctcagtggtgtattgtgtcatgtggaacgaggtggggaaacccaacaagaaaatccaaggttatttgaattcctgatataaatgatttaatcctccactttgaacagagagagtctctaatcaatcttttttttttttttgaaaaaaaaaaaaaaaaccatcaggactgcacatttattacaaaaggcacctgggaagtcatcgggatagaagctctaaccagtgattatctgtgagtattgtaacaattgataggatataaacctacttgtcataatcatgccctctttgcccagaagtagggaaaaaatctcctacaaataaagagtagtctttttggaatgtgttcaatactttttttctttttaacatacggaagccttaatgattttcacatatgcttagcagatttgataccatgccaccaggcagctctacctcttgctcttacctgctttacattacaagagctgtatcctcttttacatgaacgttgtggaacgccgaactagcaatgaggggcattttgttaaatttcagctggcactgattttttggaaggcttggaaaggcaattttatctgtccatgtcccggccttactctttgcaaaatggaaagctttgcagaggctaactgccatatatgagttggtagaaaagggggtgttatttttcattagaatctgaggcacttttatgattctttattggtctaatcgcggaggaattttgccgccgcccgaagtagcttttgaagcccctctttagcagtggctctgctgctctcaggaacatggggctcctgccatctagtagcttatgttataagacagaaaatacaacgatcgggatcaatgagtggggtctcaatttcaggctagctgcctagtcctattttttttttgacagaagccttcttttgtgtttttacttgtcactctaattaaggaagaaatctctggttttacatattttagtctgttaagaacaagacctttatgtgtagagatgacggagaaaaatggcttctcgggggtgagggacacggaagcgatggcggagggcggcgggcacccgtgcgcgcgctccgtgcacacttaggcttggggtctgagtgcggtggatcgcctctgacttcttaaaaaacataattaatatatatttcatttttttctcttcctagatactacattagtaatgaatataaaggaatgccaggaggaaggaatctttataagtaagagctctgtcaagttgttgacttgagtcattttagctgacgaacaatttctgaactctatttttattttttgccttgtcctaactaatattaaactggtattgctattgagcactttttattccttcataaatcaatctacatgtccacaagagagaatggctttattcgatgttttgtgatatttccaaacaatggaaggtttgaggttactattaattcatgtatttatttcatgctaaaaaaaaaaaagtcctaaagattgcgttggcatgctgctgtctttgaaactagaatatggctttattcagttccttcctctcacttatcttttcttcaagcacttaatttccaccgttggttttacagaatccaacttagtgactatacaaaagtgacatgcctcagttgtgagctgaatccggaaaggtgtcagtactattctgtgtcattcagtaaagaggcgaagtattatcagctgagatgttccggtaagtctgagctccctgggagggagggcagtcgccgctgttactcacttcgaagcagctccctctattccttttgaatctgaggagctcttgaaatcacctaagtccccttctctccactcacatttaagtagtgagcataaacaatcttttcttccccttatcactgagagacttgcatagcttgccttagaccgaacacactcacacatgcacaaacacacacccttgtgtataacagaagcacttcagcgttaaatacatacatattgtggggttttaaatgattattttatgcactcgtccctttcaatgagaaaatgtatgtggctggtgcgtgtcacccaacatgctcactgctccatcttctgttgctgttgctattattaattacaaatgaagaaacccaggcaaggagtggccaagtgacttatgcaggtggtcacacagcgagttacaggcacaacaggattcaaaacaggcctctgccgcccgagccatcccttttaaacagtgtgccaggttacttctcaaaatgggagaaaggatctggatattctgaaaagaactgtccatagcacaaaaataaataaatgttttcaaaccagttatctgagtcttccctcactagtatattttattattatgcttttctttatggttctttactatgactgactttttttttttagcaattatttcttgggcatgcgctttattctaagcactgtgctaaaagctttatattcatgatcttgtttaatctttaagaaatctctatcaagtagatattattatcctcattttctatgtgaggaaatcaaagcacagttctgttgtcctaagtcacagagctagtgagccaggattcatccccaggtatggaaagtgccttcactctttctaatccagtataaaaattaatattatcatccaaacacataaaattaaagagctcacaaaatagcttttctatacattaccttccactctgcaactaccacagttgggataaacagtgacgatatgggcttgtgagaaaaacacttttgcatgccagaaaggaatcgcttatccaagtcaggcactgtgcagatgtgccgcctggctctgggactccatgggagtgggggcagcggggggagatctgtccctccctagggaggctggctacagggctctgcagcccacctgggcagagcctgaaaaaccctgtgggatcacggatttagagtggggaaggatgtcagctcacattttactttgcagatgagtatattaagttcagagatgataatgtgcccaaggtgcccagcagggcacagattcatttcctacttcattctactgagccctgtgcctttccagtaatacttcttacactgaaattgcaactattttaaagagagggggaggagaaacagctaacatgtattaaacttcttatgcattataatatttatatattctatcaaagttaaatggtaacaaatggtatttttgaaaagtcatctatactatcttttctaaaaaagtattcatccaaaacatttttcccccattgtgttaacaggtcctggtctgcccctctatactctacacagcagcgtgaatgataaaggtattttctcatattttactcttcatttgtttctaagaaagtgtgttgcataagtctaacatgtacttagcattgtgtgattttctttggctttgtgtcttgacaatgagttgaacacaagccttataacctgaagtatgtgtagtccgatcagtgaatttcatgtttgctcattattgcactacataatccacatttttcacattgtaatgaatgactgctgtctcctgtatttctttagggctgagagtcctggaagacaattcagctttggataaaatgctgcagaatgtccagatgccctccaaaaaactggacttcattattttgaatgaaacaagtaagttaaattcctttggaatagtacttttcatggaaacaccaatgcactctaactatagtaattcgatctgaaaatatgtatttcatgttatatataaatctaatttaaaaggttatttctccatgaaatgttttgtcacaagaaatactaattttacatccttttgtcttaaaatataataccattctacataaaacttattctgtcaaaaaggaagggatttggagaacatgctctatcgttagttcacttttatcccattagtgactctattattctactaatattaattgtgtgtttaacttaatgacatcctagcatatttcacctttaacccaaagaggtcaaggatatctgagatagttgtataaaacaattcgtgttggctataaaatattgaaacttcagtctcagaagataaattttgaacttttccaaaccctgctgacctcccatagtgtggtcccggcttgattgtgtaatcatggattatgttcagagaccagtaagaacaatgggtttctttgagtagaaaatcttgttatttattgtttgtttttctttattttttccactaagggctaacagcttataggggagggaggaatctgttatattaggattgattcattttaggcttttaaaaaaatttaggataatagaaaagattcaacacatctaattttaaatatcaggaaaagcacaggaaagtatagcatcctcgtgaaaaacagtttacatcagtgctactcaaactgaatgtgcatgtgagtctcctgggatcttatattaagatgcacattctgacccagcaggtcaaggaaggtccaggtttctggatttgtattaagcttctaggtgatgctagtgctgcttacccttgagccacacgtgaggggcaagagcttagagttttccagagctaacattgacaacctggtacagaaggcactgaatactgagatgtgacattctatttcagtcatgaacactggggagcccctgcaggttttagggtcacggaagccacattagtagacgggtgacttgagacaggatgtaggatggagctgtggggatggggaggtggttatagccattcaaagtacagaaaggagggatgaaaggtaggtcagggaggagggagccgggaaggtgggactctgtgaatagaaagaaccccccaaaccaaagactatacatctccaaaaaagtgggactaaaacaccttcccatcaactaatgccaattcaaacaaagcagagatcaaatgatgggttttgcatattcattaaaaatatcatggtcaactgatagtttggtgttctattgaaattataatagagacttaaattttgctcttacaagcacatttaatcagaaggcataacaatagtcagcaaaatataaattgaagataaatctatctatatattttactcccaaatctttcttttcttttcaagtaaaataatcgtaacaaacataaacaaaaaggaagataaatgttagataaaaatagctctagagataagaatttttttgcctacagtttaaatctactgaatctggaataattttatttaaatgtggaaaaacacttttttatagatctattagtataactcatcttttatttgggaacgaaggaaactgactcattatttagggacaaattttattaaactgatgttaaatcaagcacagagaatgagacagacccgtgggagatcatacagaatgtacgcaacagtttgctccatataaacccgatctcattctgtgaaacacagagctgaaaatgggaactcagctttgcggtctgggatggcaataagaattacaaaaatgttattaaatcagaattctaaaatagagttggggccaactaaaaatcctaaacagcttcaaggaaattcaagaagaggaaaacattttggaggaaaacttagaacataagccataaacaaactagataagtagatcggatgccaaagaacagaatcataaaaacaaaacattagaaattctaagatgcacttttatgttactaggcaccaatgtatttaatagatacattagaaacaactttatgttttaacattaactagtattttaacctgaaagaaaatgttatatcttaaaaatgtgctgaatccaagcagttcattttccttttctactctcatttaacaaattgttaaactctagaaatgacttgctactgacggacatgaggaacaaaatcttgtgctaataatttttcttacctcactaattaatctttctgtttgtttagaattttggtatcagatgatcttgcctcctcattttgataaatccaagaaatatcctctactattagatgtgtaagtattcaagagaagggagcaatttagaagtattgagtcatatatatttttctcagtgcagcttactgaaaaatggagccaaatgcgtcctttccctcttcctggatcactgtttactatttcctcctttcactgtacagccacaaaacccaacctgtgttttctcacatcttcttaatagagaagggagatactccttttctgacataatggtgtatagattttcttttgttttgcttctctgaactccaagggaatttcaaaggaattcttaagtctgcattttcatccttaacctcctggacattttaacaagcaagagatgggcattaacagtcgtgacagttcccttaccccagctcccactggctgcctcatgtttctcttcctttagttcctgaaatattactgccggctattttctattcccctttttggtgaagagaagtgatagaggagagcgttcgctattaaaaacttcaagtctttgagaaagttaggaagtcacaagtctttgaatagtgaatgtgaactcacatgaattccaaatatgacagctttgtaaaatattttttataatcattaggaatacaccctactttaatttttctaaaattgccctagcgtcacccatgatgccataatgtcaggctcttcctgtcctggcttgcatcatttcctatattaaaaacaaaatgaaacaacactagtgcagggacctgccgaatgccaggtgcttggcatcatttgccttattttattcacacaacaaacccatatagtaagttctgttgttccattatacggaaaaagacattgaaggtcagggacataatgtctctgttgttaccagcgagaaaaaaaaagtggggagaggaaggcaggacccagatattagtatcagacacagctttgatccactatattcacagtttcatgaaaaccacacataaaagcacaaagaaaggaaaagatacatattttaaaattccagatgtgttatctgatttcttttcaagtaaaataattgtaacaaatgaagtcaattcattcgtgacactaatttgttttaggcttcggctccaatgctaaaaaagcatccttttgagtgatatttttatcttctttgacttcctagtaagtaacgatttgatctccattagaaaaggttttaaaaaatggtaaatttaatacatatttctgttcagttattttccttttcctctcttttagggtcttttttttttttctattttaaaaaataatcttgtttaatcttggggttagggaacttgatatatatacctaatattaaggcaagctcttaatctaccaaatttaatataattgagaggagcaaggcatttcacatgtgaaaaaatatttgctagctcaagaaatgcatgaatgcattttcctgtttaaagttagaatgttatagtgttttgtttaaaacgaaagttcttttgactgacctccctaagtagaaggaaaacattagcaaaggcatgtaagcagaacttgtcctatcctgtgcagggacagtaagcagatgagtggagagatgggctggggagggaataagttattggagagtatccatgtccaggagttgtgtagatggtgcaaagatgacatatttaaatgaattgagatgagctataaggagctcctcttgattaacaagcagaaatgagagtgctttacagagctttacagagattgtgcacacagctctgtgtagggtagatggtagcctgtgaagattgcagatacaagggagttaaacttgttagtatatagaatgcccaatgacatgcccgttttccaatgcaacctgtttcttcctctgaagttttaaatgttagcattcattcatactgcagtccattccacaatgatttacagtcattgtgagcaagactgtgccgggtgctatgggaaatgcaaagcatatgatgcagaagtcaaagtccttaaagaaggaaataaacttgcagtccaggagtattgtgttaagctgagatggaaagatatccaaagctgcatttattgttgtcatcatcattttttttataccacaactcccccttcttaactattagagaaattatttctttgatttccaagattacattaatacttctaaaatcttggcctatgaagtctgtgtttgataactatcttcaaagacaaaactgacaagtatctttgaaggaaatatacaaccatggtagttgtgttgctaagttttagaggactcattctggacaccccataggctggcacagtttaaggctcatgattgggaaggatgcatacttctccacggagaagagaaatgtaagcattcctcatttgattccagaaaaccatgaaagctaacaatttggtatttttcataggtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccaggtgagtgactaggagatgaagtcaaaggtcatctgattttttttcccctttaaaatttacattttaaagctgtaaagtgtaaataatttaaagtgttctgggatgaatttgtaatcttttatccttacggtaggttttagtgaagatgttatgtttaaataacaatatattacattatagattgatatgaagttcaaaaaaaaagcatttcctaaattcctctctgtatgagactctagaaagggagttggcatatgtcctaccacattctaagaacagaaaatcaaaattcatcagactcggggacaaactgaggaataaatgtaccctagtaaacatctgactaaacaagccaagcccattccttcacagtcaaggatactgtgtacatttccttcagtgtacatttacgtcataggcagtgacaactctgaagtcctaggagtagctcctacagtctggatgagggtgactctgctattttgggaaaattgtggagcacaaccatcatcggtactatgtataagggctctgttacgtatgaaccacatctcattcttgtgctcttcacttatgggactataactagatgtgatctggctcaagagatgttaacaatcaatgatggttactcataagatgcatgttgcatgagaagtgctttacctgcaggcattgtcgctgaagccccgagaggtgggtgttcttaccccatattttaattaaataaatagagactattaggttaggtagcttgccaaagtgaatcaggatttgaatccagtctcattctgactcttatatttaattacattcaactggtatgtgggaaatgtaactttgagtttctgtaaccaacagcatggatgtctggggaagcataatagggagggtggttgaaaataatgttatgaaatcatagactaggaaatgcagaaggatccatgaatgatgaaatagatggagagaggagaagatgacaattgattaaggattcctgaggaaagaaattctcttttactaaagttaatgattagctattttccttaacaattaaaaaatagagatttagaataaacaggggatacatttgtttgagagtgaggctttgatattttaaaaataaacttgtatctatccagatcgctcctctatgagagagggcatagtttccagggtctctcaaatctgaccaacaaaagtcctaaaattacaaaattaaggatctactatatacaaccccagttaaataagtattgagaaatagtgcgtttatacagtggcacacactattgcagcaactaaaaagagctaagcataacaacatggatgaattgcatatactgttgaatgaaagaagctggacacaaaagtgtacatcctgcaagatgcaatttatgtaaagataaaaacaaggcaaaagttcagtgaaatttttatggaattcaataaaagaaaaacatttccttttgtccctttgcaaagagggaaatgccttagaggcttctgataatatgcacaggccatgatttcaaggatacattcactttgtaaaggttgatcaaattatacatgaatgatctgttgcacattgctgtatgtctgcctccttcaattttacaaagtttacgtggaaaagatgagttgaaaactattttaatttttttctagcactgcttaacttagggcaacctaggacatattacatgaaaacacaaagactgtcaaaatcaagataggttaatgcaaaggtctgcaaccacccacaatgctaaaaatttgagttccatttgtcaggtatttttaagtaaaaaaaaatttcttttgatgtcaggctaatattaagaaataggtgcatacaatatttttcttatttctttacctggattccatctctgaacacagttttgtggcaaagaagacttcttaatccatcaaggaaaaatttatttctattgagtgcacggtactgagctaactaatcaacacccagcataagaagggatttatttagagaatggtgtttaagttctcaggtagggggcccggagacatttctaagcccttactcagaagtttttcatgcccttatctttctccattgcaggggcagactctcccaaactgaaaaacatctggagagatttaaattcaattatgtaaagaaaagtgcatctgggctgcaaatttttgtataaaactgtgaaaaaaactgccaggatttgttttctgtgaatcatacacacacacacacacacacacacacacacacacacacaatttttatgaactccaacaaaagtaaaccatgttcatctggatcttaggttaaaatgatagatatttatctcaggtgtttatttgattactggcagcaatttttagtctctaatagaatgaagcagagaacaaatggcagggtttcacatttgtgcctcatctaagttttctatacacaatgcagtactgatctgtggactttttccttgtgttttagacaattttcaaaaatgggatttgtggacaacaaacgaattgcaatttggggctgggtgagtagttgactgatgaatctgtatgcattcgttagtgaatatcactcagagcaggttactttatcttttgtatatacatatttggaggtgaaaatcacatctatcaagtcttaggtctctgggcagtaactctgcagaatctccactgagttaggcttacacctttgtttattatgatgagccagggaggtgaggtagaaagagcaagaaggaaggagtgaaagagggagggaagagggaagggaaggaaggagggagactttttcttatgcatcagtcagtaaagatttcgtgttattgtttttaaatcttctataattggtaccacccagtcactagggtcagcaaattttccgtagttttccccatatacctaccaagaaagggatcagggctctgaaagtgtagtctttaaagatactgtccaattaaggccaatttaagcctcctataccatgctttttatctctaaagaggcacagtatataaagatgtgagaaatgtggaaactgcgactcgcttaccatatgtccttattcttttacctccataaaaataactgtttccattccttagtcatatggagggtacgtaacctcaatggtcctgggatcgggaagtggcgtgttcaagtgtggaatagccgtggcgcctgtatcccggtgggagtactatggtatgtaattgctgccaggtacaaagagatacggagtgttgacctcaaaatgccagtaacaaagccattcctttctgagtttcagtgtttttacagcgaataataggctgattcatcttagaggttctttttggatacctataataagatgatctcatttattctgctattttgcaaggctgggtggtatattttattacacgtttgattttttatcaacaaattctgttttccgaatttcaaaatagccccatgctacatttctacagataaatcattccttatctttactctgatttgattcttgggtttcacatattagcagagtgagagaagtatgtatctctttcccatcaattaaatgtcaaatacaagtagggctttggatgggaagaggagaggaggaacagtggaaacacccattggggggttgttgttttttttcattcttaataggtgaaagctactctagaatatgctctttgtcatcgagagagtattattttataaggcatcatacacctacctctaagactacaattctcaaaggggagggagtaagcgatggaagatgagggaggaggggggattcagaagtggtaaggaggtaattgattttcctgcacctcttctaaccccatctcaagtcttctgtctagtgtaagaaaagaatggctgatgatgaatagcttattaaatattttatatccagaaatatggtagtacccagagaaaaagactctttaaagtctctcccagtcaagataaaccaatgtaaaaatacatttatatctttctgttaagaaaattggagggcacagttataatttgatctacacacaatgaatttgttttcataatatttttctgcttgatattaattgttctgttggatggcttgtttttggagacctctagtggtcaataaaataatggagtaaatctttgtaagtttaaaaatatgaaatgagaagaaaacttcatttaatgtatatagaccaatctaatacatagaagttgtctagagttcttatatacgtgtaaatttaaacaattttattcaaagatgggacaaaaggaatacgtaaatggtgtttcaaggcatatttttttaaaagtttacaattgtattatgcagttatgcataatattttttaaatgttatttttaaaatttcagatcttcttatacatgtaaatctggttagcataaataagaaaggagtattgtgttctatgacaagcagaattaaagtctgcagctacctaggggaaaatgtgtttcgcccttaaaagccatttttcccatctaacgtacaacctaagatattaatatttaaatgctaaagttaaaagagatatgagcattttatgaagttctcatattttaaagtgtcttttaaaatattctatttttatattagtgtcctttaaatatataaaattatgcatagtcagtattcatgttaatcaaaatgataaaatatcactgttagtaattttggaggacaatattttgattttcatagaaatggcataaagtatgcatatggagcaactaacactcattagtgtagtttgtaatctacaataccagtcattcaaaaagtgttagaatgttgaatttagataatatatccatttttaaaattaatgaaatcagttttgaaatacttgtaaaattttagtgaaattcaagccaccaacctagatagcacaatggcaagataaaattcttagactctttaactgtaatctggtcacttaaggaggcagttttcaaagcagttatgtcagatttttaaagttttactgcaatttggcctcaataatttttttactgatattttaggccaaatatatataatgtatcatttaattttttaaaatcaggcaaaatatgtttaactatccaaaataaccaaaccaattatgcaacctgtttttcaaccatatttatagataaaagagcttatgtcatttcagcagacagatattaatgtaatctgtttcacagtgctcaactgttataccacaaaaattgaggcttcaccacaaaatgagagaaaacaaatgttaaacttgcatcatgatggagtagctgagccaatatggggatatacagcaaataaatgataactgaattatttgtttttattatagtgaatcccagtctgatctccaaaataaaatatgatttaaatcagcaactagtaattgaacattgttaggggtctccaaaaggaaatagatgatcataaatcagggcacatacttgtattataaccaaaaaatttcaacacaattgaggcattaagtgacttcctaactaaaattctttgagagggtcatatgataatgttaagatcccttaccccttagcacttcacatttgacttttctgcatgtggattattgattggattttagataatctggtttgatctccctttgccccatcgtaagggaaaattgagaatgggttagggctgagtgtggaaaggtatgagtatgcagggatctgggaattagcatctctggctatattagcaaaccaagtaaaaaattacctcccataaggtgctttagccacccttttccttcttcataaccacatagagatacttctgagagtaactctatattcctatacatgagtgaatacatatggaaacactgaagtggcccattaaaagcaagaaaagttgttattgtatgaattaaacttttttttatttttttttctttcacagactcagtgtacacagaacgttacatgggtctcccaactccagaagacaaccttgaccattacagagtaagagatgaggacctatacctattttataacctatttataagtggtttaagaaccttcttaattgtatctattctagaaaatacatatttttatttccaacaaaattcttgttaaaagaaataacacaggtggtttagagatactccaatagcttcccttactgtattctgcataattacagtctttatcgtatgctatataggtcacaatatgcattcatttagaaatacaaagcaacatcagataattactttaattataaaatttcagttaagaaaacctattagaaattcaacatattcctttagagcccagaagactctctaaacctttagctatatattgaaatttcttacagtattatcataagtaagatatatatacgagactataattttcttactcatagccaattatgtacagttttttttcacaaagatttaagtaaagcaggtgagaggtaggtacagttgggcagtacccttaaaaagccctaaacctaaatcactgaatagcatccaacaggctggttgcctgatggaagaaccagtgggcaggttgctctgcagatgggctatagcatttaaaatatggtgtgggtgcaactatcattgacagcccccatgtgctagtgtggatgccacggcaaagccagagcattgtctctggtgccacattgatgcagctggaagtgctagcataagtactagggacccttctggcactttgatcattccaaaactttgctgattctgtttgtcatgttaggttgaaaaaaatttttttaaaaccctgaaacttacagctgacaaggtaaatcatttatgatgtttacatttttcaaagattgttcacaattcttcacaagacagtgaattaaagagaaagaaaaacaataagaataacttaagaacacaatttcttttcatctgtgtcatgacttcatattaatacattgctctgagcaatatccatatgtttttgtaagatgtcatccctattactatggatgctgaagtcatctgatcaaaatacagtaaaactcaaaagtttctagttttgcaagacaagtatagacaatttagttttaccaattactttcagcttacttaatgagtaaggtgtatgtgtgtgtgtgcgtgtgtgtgtgtgtgtgcagggagctgtgatagcaatatttttgtgttagtggctgtatgacggttttcatgtctgtttctcagtcaagatagaaaagtaacaatctgcaaagtgagatgcacaaatcatctacccctgcaaaacagtcccataattagattgtccccatttctgctaagtgtcccatttaatacttagggctcaattcttcccattctttctcctccacctcccataagctgctttagacactcatttccttcttcataaccacattgctattgtcacataacctatctccttttataacaataacccgatttgtctccccttatcttgtcttctcacactccagtctattgttcacagagctgggagattaactcccacccacaacatgttcatggttccttcttgtgtactcaactaagcccagtcctcactctttacccaggtgttcggcacccttcctgtagtagcctactttgtctggaatgcttgctgttctctgaatgtttctgtggctttcccttttgtgcctttgccctctgctccttccacgtggaatgtcatttcccctccatctccacccattcagaaacttacacagccctctcagtggagtagcatcccctttggaatccccttttgatagtttccttgtatatctctgaatcctcattttattccaccttgaactaataggtatcttgtactgaattttcccctcttcagtactgttagttattcaaggtgtacaagctattcaacattgtattctttgccttcgcctttaggaagtataacctttcctgatttaacttaaaaactttttgaagggaaacattgttatacaagaatttctccatcaccgttttcattttccagttcaaattttcttgttaacgacccaaccagaatacttaaatttgattgtcaaagagttttctcctacaagattctgaaagttcccgaaacattagaggtgcaactgcctaggatcccaatccctcacttgaacatggtgtatgatgaatccaaaacgttcatttaaaaaattatattttaaaaagtggaggctggaagcacaagatcaagcccaaccttgacatctaaggaggttcatggcacctaccctacctcctcaaataacatcagccaatggggtatttcctcttcatccagccctccctatataatgagataggataattagttgtagtctgccatttcaacctgcataaatttccagtctttcctataggctcctcgttcccaccgagttccccctcttctccagctctacccctgactgcggtggccatttccatctccccctttaggtgttcgctgcatgagatagtcatgtaaatagaagtcacttcctcctgccaatggcaacacacgcacactgggtgcacaaagtcactctttcacttcactgcacagatggcacccgaggactgtttaatccttccacgccaggagtcgggttttcttggcacaaaattcattgctggcaatggacacattaaaactgccagtaccagggagctaaaggttcccaatgtgttactaagaggaattatttgggagggcgatagttaaggtgggcaggatacaagtgaggcaaatgcactaactgaattgtctccaccgtggtaagttgcttcctccgaaatgtggagaactgaatctatgtggagaactgaatctaagtgcctatttttggtgcacagcaggctttagaataaagctgccctcctttgttttttaaatgagcctgtgcttttgtctctggcaggaatacattcaaagattctattttcctccaaggccccagctgcccctctggaccccatcttttacttttctttcccaggttgtttttcttttctcctctctctctcctctctctctctctctcttcctctttttccttctctccctttctctcttcctcacatcctttttgaaaagacaaaggagacaattccttagaggatttcaccaccctgtgcatttcagtggatcagaaggaaatatttttaaagcggttcacgtttagtctggatcagtgactcttttcagtacactgaggattaggaatggccaaagtgtgtaacaagtaaggccttgatcttagtccatgttttcagctaaatagccactgatacgtggctatttacagaattacagcctttggaagaaaatgcagtttttaataaaactcaaataagtaaaggatttattattaggtgattgttgatctggatttggaagaatttagagaaatccacatcaccaagagaagcacatgtcgttaaatcaaagtcctactcaccattgaggaaagggaattagaagagccatttgcatacatgaatggaacaggcggggatgccttgtgcagttgttcagcctgtgccctgctgaaagccagaccatactccattttctaaggcctacacctccagggctgtgtcaaaccaaacagagcaccctttcctattctttcaaagctgccatgtggattaggggaccctgagactaaggcctagacccaatgcagtgagtccataagactctttttgaagataatcatccaactactggcaagaggcaagggagaagcacttttaaaggatatccagacctcaaagatgaaaggagatgttcatcccccccacctcaaggagctgataccggaagctctaaatgggcagccaaagtggaggggtgacaaatctgagctaaagggtagtatagctctatggaaacatcttttctgcaatatgtctcagtcccagcagacagaaatggtgacagatttgagcaaaggaatcagatccaaagaggcaaccctcaaaaccaatgtcaatcagcagacagcagctgtagccacaccttgcggagtgggctcctaacagtgaggaatggtctctcatgtggtcagtcacaggtcttttagtcaaacttgtaaaaaatgttaacgtggtagactttcattcacccattcaaggtgcctggcgttttaatcattcggaagtttattctttgtcagttagaaaaaacagtattttggaagagaaataaaagagagtaggtaataaaagatgaatttgaatatgacaaagtatccaatatgtgtgaaaaagacttgtggttttcaaattgtgactatgaagccccaggaattctataccttaggagcatgtagggaggggaaggggagtggccaagaagttagagtttccccttctctgctccctagccagagggggtctagtttcatttatttcattcatgttttcattcatttattaagtgcttctatggcaagtcatcattctaagctctttacatgggttatcaggtttaattctcctccagatcctccaagtactgtgtttctattttacggacacacaaactgaggcacaaaaatgttatgcaacatattgatattgagggttagaaaagggagagagggcacttatctgaatcattagagaaagatttcggaagatggggaggacgagcatgatgctctcaataggttacgtattgggggaaggcagatcagcacagtagacaaatgaatagcaggaagagtggttttctggcgatgtgtgaagcaggtccgatgaactgagggataacagaagaagggctctgagtagagcaggccaaatgctggccaagaagacaggacataagcctggggaggggatagatttatgaatacacacagagagaagtatcagatcaagggcaagagaaataggacccaagtcctgagccttgttgccaagagaagagggcagcctggaacacacagaagggactgatttaacttgtagaggagatttattttgcattttgctcaaaatttgataggcttttggcaagtgtatgaaacagtcatagatttggcagtcttctgctagcagatttgaaatgttcaatccttaagaactgctgcatcgttaggttatgcaaaacagggtgcaattttgtaaatatgccatcttgtactgatttgacatttgttctattatcccagaatatgccaaagggagagagaccttcagatttaagccaaaccttaacttgtttgttgagtgctgataaaatgttgactgctgtgtgatctttaaagaagccagtgttgcttggtgaggcctgaggtggagccccctgtctggggttgatgggagctctctccttggcatcccatgggtacagttgtttgatagatgtacataagtaaaacatctgttttagtgagttgaagtcattcttttcttaaacattttctgtggcccctgttgtgatattaatggtgcttcccaaaatggcatcatttaatattatttatgcagctttggttacaagtaggagaatgcatagagcaagccgctaaacccaaagtcgtatcttactgaagtgctgggttgctgtccgttagacccaatgactgtgtgctctttctataagatcttataaatgggatgagttgtttggttgtgatgtcaagtgccagtagaatatgatagtcagggacatgagcttttggggttaggccaacatgtccgcaatttctgtttcaaccacttaccagcagtatgagtttgaggaggctacttaaccttactgaatctcagtttcctcatctggataatgggataatcagacctacctcacagggttattgaaatcattaaatgaggtgcttgtgcctgccatgaaggaagctttcaaaacatggcagctgccaccattattatctccaggaagcaaattgtccttatggttcctagatggcactaggggtagtttaaaaattgttataccttctgtttctcatagtactctcctcctcttatcagctctctcttttaattcaaaaatacaaagatttatttgttggaaggtaactgaggaaccagcatgatccaacgagcagctacagatggttcttcttggggactgaaggaaaagctcctcagagatgctgtggagtcggcactgccactggaccgatccttcccacttctccttgccaggctgttgctggcagcggggctctccggaagtttctagcctcaggagagtgccaactgcaccaccattgcatccttgcccatttatcactctgagtttcctttttagtagttggtgatagactattcggcttctaacttagtcatccatttccttttttatttctgtttccatggataggcaaagagggattatcctcttttggtaggttaaaatagcacaattaattttttttctaatcattaatcataccttaaattcatgcctgttatttctttttctggctttgtatgttatctttacagcttaaagtgtgccatacactggactgtaaagggtgttaattgagaagccagggtgcacagttgagtagggaatgatcaatggttccagaggcaaggtgacacagctgcctttttctggggaaaaaaatgttctgtgtagcctgagagccttaaagtgggtgtatgtctctcagctgcctctctccctctcacagagaggtccctctggaggcttctcccagtgagcaggggaagtgcgcatttgaaatggcacacttatcttgcagttgcaggggaagcttttgttttatttttctcttgctgcattaaagtatttgtctttctttctttgtagtgtaatattgttaatgtaaaacaatttgcatcatgacacttttatcacagttttcgtctttttctcagtatgttgcatttctcaccatgtctagttcatcacagctacagtgtgtacatcacaacatttatcttaggctcagggttttacttgtttataaaaattgtcttctttcagcctgtattcactccatttaagaaaaaaaaaggcagccagaaactgttttggtccaaactccagtagttatcacattccttgctaactgtcctgcgtatttatatgtctcctaactattactctatgtttcaatgacatttctcagtttcatggctcagggaggttgtaggagcagcttttgcttttcaagctgccaagcaaggcaggcccatgaggcttttggaggtgaggtgaggtggcacagttgtatatttgggtcaggtctgagtgttaaagttgactgtcttccgcgagcaaagagctaaatttaatttggagagcaacaaggagggaggaagtcagtgcaggctgagagcatggctagtggaaaggatcaccaaagaggactcacatgggggcacctcagcctgcgattcaggcaattaatgtttacggtcagtactcaagcctcagcctttcttgtctccagctttgaatgctgcgcaaaactgtcttttagggagatttattttgaccctttcctctctgaaggacagaaaattgctcagagttctattgccccattaggctatacgtcacttgcgtagtcacaaagtatgcctcccaaatcacccagggctgtgcagagcaatctctcttctgattagtgcagtctgagacggcatgggtcttaggaggatctcaaaggatacccattattattatgcacttcaaattccaggacagttaattaacattttatttcacactgtttctttgccagaagatcacatcataagcagcttggaattttagtggagacgcagtgcaatgtaggaagtaaaaagggcttgctgtcagactttgtccagctctgacacttgctgtagttgtgaccgggtgcaggttactcaccttctgagtcttggtgcctccatcttgaaaggagaattgttctagacctattttacgcaaatattgcaaggatttgatatagcagtgcttttataaacccttatttatatgtgatgcttaacacagcgacaggcacagagtaaatgctcaattgaatgttagctattatcatgaatggtatggtgtatggatagaaagtgggcaaaatatatctcaatacatttcagaatgagcatattttattttgcccactccagctgataacacttgattctgcaaaactagtaccaaatatagtggacactgcaagtgcttgatcatttatttcatttactcatttaattgataaatattttgcactctattagatgttaagagtaatgcataatatagacaaatcttttttcttatggatcttatcatttagtggagtacataataagtaaatattgattgactagatgaaaaaaatcaacggagggataaatggtgatgttgggatggatggacagatggatttatatttagatgtatttatctgagacatcttaccagacaaaaaaagtttctcaaaaataaaaggagtctcactcaggtttttattctgagagttcatgagtaaaattttcaatttgggtgagaaatggaatatggtcagaacaagtgggaaccagcctgcacagaagaggaagggcatttgttttaagcctactaggccaggatgaccttgggacattcattcgactgaaacattttgggtggctctgtcctgaaagtcgtagataaaatgtcttttttccagaaacactgttaaagaattctcacatcagcatcagaaatttaaccccctaaaaatgcttttgctatgcctcttagttcctattattgtgatggagtaagaggagttacagtagcccacccttgtttaaggtgaatacattccaagacccccagtggatgcctgaaactgtggatagtaccgaggccttttatacattatggtttttttcctctacatatatacatacctatgataaagtttataaattaggcaccataagagattaacaatagctaataataaaatagaacaattataatgataaactgtaataaaagttaattgagtgtagtctctctctctcaaaatatcttattgtactatactgaaggtaactgaaaccatagaaagcaaaactgccaataagcggggactactctattccaatcttatagaaatcaaagctcaaggagcagcatacctccagttgcatagctcactgatattgaaactggaacttgaatacaaacactgttactttagccccatccccttcctgccagaccaccaaggttcccatcaaaaatataagctgatatgagctacagagatatctgtgaaatataaaccttggctttcataaagttgaatttgattcaccaagatgctgcaggacgagctggctgcttttaaacccatggagatgctgctgcccctttcctgcccaacacataacaggaccatcaaagtagactctagctcaccccctcccaaaggcactacagtattttatggcatttttaccttcatcccaactttggtaaatatcctcaaattcagattagatgaccagctttagatgatttcaaatggctttttcatccaagactcctgaccctcattctaggagccctggctcaggccacatagcagtctcaaaaagctgacttcccaatttttttttttatcctatttcttggctaatttgggtatgacttgatcaaatagtatctcctctaatagacagaatgaggcagacaacagcaacccactgattttctaaggccacttttgatcttttttacccccttcccctcccatatgttacatttgcctaggtttttaacatctgttcccaaagaggtaatatttgcttttcattcagagctcagcaatgtggaccaaagttcacatgacatattgcagagtatgtttagttgcaaatgctatgtacaggctctttgaaatgtagcatgtatggcaccatgtgacacatggttgccatggcaatacactttttggctgaactacagcagaagcccatggaacatacattactaatatgagactctgccctgtgctaatgcataggacacagccaatctgggatctgggactcaaggggttttgcatgcaggctgggtggcaggtgccctcttcctgcatgttcagggaagatgtggcatcctcccttccagtcctgtctcccaggcacagggcatgctgtgcattctgccatgcatggagacagcatttgcttgaatatcggtttgctatattttgtatcaaagggggccccagctgaaaacattttattttgtaaactgaagtgaaaaatcagtttatggcagatccttttttgaataatgacattctttctcccaattccagaattcaacagtcatgagcagagctgaaaattttaaacaagttgagtacctccttattcatggaacagcagatggtgagtttcagttaattagactttttagtatcacagacaggtttgcaatttcactactgacaaaacaaaagcatgaggggcaagactgttacatttacttcaataaaacagtgttgctttccacaagtcacttgtcttgggctaaatgggatgctgagtcctagaacttcaaacagtccctttcttcttgtgcctttcccaccccttggtaccagaaaactggagtggctattagctactttatgtttcctttctctccctgcagataacgttcactttcagcagtcagctcagatctccaaagccctggtcgatgttggagtggatttccaggcaatggtatagaaaaactttgtgcaaggggagggaagttgctggtggggtctagtttcctctttctgggctaattcttttagcagtgccacagacaggacagaataaaaacattaaaaatttttttttcaacgtgaagtcagaagagtggtatccttcagccatgcacagagtaatgctcaataatattagcgagtttggggttaagaagcacaatatcgcatatgctgggagtatcaagacactgctctcctgttcatgtgattgttcagtctctccctattttgattcaaaagtaatcacttgttcagtaaatgtgtggcagagtaattctaaagtgaaaccagcatgataatagctcagctcaaatatgaaaatccatttctgtctggtatgtattactagctattctaacaacagtgggatcttaataatcagcatgcttcagtttttgcaattacaaggtgatcttttgttgaataaccacaggcgataaacaattaggattgttttataaagtcaggaatggctagagctgttgttgtctatgcagaggatatttctacgtattatgtcaaattcattttctgcattagagattttcagatgaaggaaaacgtatttttaatgtgtgcatgtatgtatatgtatttatgtgtcctctaacacacatgatttgctctgtgctcagttcaaatggtgcccaatgcacaggagtgggacagttacttgatactgagaaaaactggctatcttttgggtcagtgttttataagaggttgaagtttatttttctactattcaaagaaaagacaaatgctactttaattaagctttttttaaagttaacttatgtctccataatttatgtttgcccggtaatgacttcccaattatttaacaaggtatgaatcaataaatttttgtcccagatcattaattccttttacataaatgtcaaatacacagatttcttaaaataccagtttaaaatctaagtgtttacaaataatacatctgatttttgacttcacttctattaaacatatatatgtaatattgaaatagagtttttccagtttctaggtgctatatattaggcaatattgctttaaaaaaaatcatttagtttaatacagtttatcttactagagtacagagaaatttaacacttgataacagtttaattaaaacaagtgggcttaatgggataatcattccttcccatgcatgctgtgtaagcgccctttgagtcaaatttggaaatggattgggtgttttaattaaaatgtacgtatctttaaagcactattcaataaagccaaattcacagtgagttctctcagcacctgcaaaagaggatcagagacttctgcaggacagaacaacgtgccctggaaaagctctgggggaaaattagaccccctctttgaccccgtttcagtttataaactgcctcaggaattaaaacactctgttttataccatgtatgctcgtgagagctcatttgaatttacgtatttttttttttaagaagagtactgacttcctaattctaacttcttttctttctctctctagtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaagtaatgacttgtgtcttgaataagacctaaaccgcactggcatatggacacatttatctagaaaggctcttgtttattttgttagtaatcccagactaccttgtaaacatggaaagagttcagctttggtaaaaaaattagatatataaaaatgtgttaagctaaacagttcataggtttttgcctaataatgtgcaatttctcttatcataaatacatacagcttttgagaaatcaacttaaactaattttagttacttatatcatacacaatttataattttattccagggaactatgatgaggcttatataagaacgaataagatcagaaatatcattctggcagttcttatggctcagtagaagtagtcaattatttaagtggttgactatttgtggttgacattactataaaaatgaaagtggccaggcatggtggctcacgcctgtaatctcagccctttgggaggctgaggcaggcagatcacgaggtcaggagatcgagatcatcctggctaacacagtgaaaccccatctctactaaaaatacaaaaaattagctaggcatcgtggcgggcgcctgtagtcccacctactggggacactgaggcaggagaatggtgtgaacccgggaggcggaagttgcagtgagccgagatcacaccactgtactccagcctgggctacagaatgagactccgtctcaaaaaaaaaaaaaaaaagaaaaaaagaaagcataaattttttttttttccgagacagagtcttgctctgttgcccaggctggagtgcagtggcatgatctcggctcctgggttcaaacgattcttctgtctcagcctcccaagtagctgggattacaggtgcgtgccaccatgcctggctaatttttgtatttttagtagagatgggtttttgtcctgttggctaggctggtcacgaactcttaacctcaggtgatccgcccgccttggccttccaaagtgctaggattacaggcgtgagccaccacatctgaccgaaagcaataattttaaatgctgaatttggcctagcaaagcaatatccagataacagaaaacatcatttttttcaattatttgcaaaacagcctcatttttaaaaatttgactttatgagtttaaacttagcttcagaccatttgctagacaaagttttcccagacagggtgagctacagcataaaaacctaaaaatggaagaaatggaaaaaaaaatctaccaattgaacatgagactggtgagtcatgcataggaatggacagaggattgtgaaatccatcttcaactacagcttcagagcatgccattgagtcacttcaccttaattaaatctcaactcccactcctccattggaaccacaaactgaccttccaatctgtaggactcttcttgtcaaaattctgtttcttaatacagttcaatcattgtgagtagctggatcaatctttgcagaattgtatatcaagaagcggtagtaatatatgttcacatcctggacagcattaatagtcataaaagcaaattaaatagaaattctccttttatcttaattgaagccagacattgtacaatgtcagatattgtacaacatcatatatcatacaagtcagatattataatcgtaatatctaagtcagatactatttaatatttatacaatatcaaaatgatatggattaatatttctttagtttctaagcatgtgcagtattttctctggagtgaggtaatcccagcacatatttttcaagcattgaaggctgcaaaaagtaataatgtgagtaaagtcgaagtagttttcatttgaccctcataggacaagttttcctttccaatgagagttttaaattagcttatggaaaaaagaagaaaatggacaaataagttagagataaacttaatctgagaataagtttaaaacatacaggaaccagtcataccactaagatgtgcagacttgtcttgacattcatagctgc

SEQ ID NO: 16322 - DNA, 6202 bp, Human
ttgctagggagagatattggttcaggtagatgtatcacattctaaatttttcctccagtctagagaggatggctaaagattacactcagtgttgatttctgtctgtggctcaaatttctttaaaaacaaattttcagggtgcctcatgtgaatggacagcactcttcacactcatatacacctaacgtggaaaatctctttgtacctcttcagggtgattccagttagaaagctaatatgatcccctttttaacctcttttcctaaattagtttaaagattagtcccatataataggctttatgtggctaagcattaagtgactatccatcaaatggatatattccagcatttagtaactcatatgagtaaccagtatgaatgaagatagaattgacattccttttcaagtgtctccaggcttaggaaataattttccttgtctgcgttccagactcagttgtgagaaggctgtttatactgctctttgaaaaatcaactaaggtgcaccagctgaaaaatccttgcttttgcatgccaatatgaaaatatttttagaatggtgactatgctagtttacactgctttaatttaggctgaaaagtagaggatctagatatgtctactactcagaaaagaaagggagaaagcacacagcacaaataaggcatcagtatttacttcaaagatcaacattaggtggaattaataagtaatttatttgttaataatggcgtaattagtgtacccatcaaatttcaattaccaaatagcaggcaacagtctcctctccctcctttccggagcttctgatatcgttaatacgctaattttcagcaattcagaaattatagactgtcctgcaaatataactctagcctcagatactgcctgagaaagcaggatctaaaagagaaaacatgaaattcttagctggaaaagacccatcagcgatcagacccggcaaggtgtttattctacccttagcttgtttttgtttggggatagttctgaaataggaagttattgttttcaaagctcggttctgtggaggtgttgcttctatccattcccatccttgggccaccttctctctcacaatcgcacctagtaaatgcgggcatatttagctctcacatcgacaacccccgtcaaattagatgctattacgaaggttccaatttttcttaggaaaacacgaaacagattgtctctgaaagaaggaaaaaatgaaaagtgtccatccagttataatggaatggcctcgatttacatccttgggtcgatttctcttagctgcccgcccaccctttgcagcttctgccaagcttctcaaagcaagggctctcaggctgacacgcaaggagcagggtgtggggaagggggatctgcggttgagaaaatgtgtctggtggcctctcagtggcgtacataaaaaccaggatgcccctcggtcccaacgcccttcctttcgcctgttagcctagaacccctgaaggacacgaagcctgactgggttgcgcccgaggtcagcgctgagtcgcggccgccagacagcccgaggcctaggccagcagtagggcaggcagagggctcccgagaggacctacagcctgacagggcctgaattcccagcgggaaccaaagttggggggctggggtccaaagctcctgctccctcccccagcccaggggccggacagcagcatccatcacgcacccgcgcgtttcctgatccgggtccgcgcgcgcggtgcgcccattggtgggagcgctgcacgtggggcacggggcggggcgcgcgctgggctggggaggagcggctcgaactttggtggcggcgtctgcgggagggggaggagtgggcacttgacagcggggggaggggaagggcgcagaggaaagggggatgggaagcgaggcaggagggggaggggcctcggcaagcccagaaaaaacgacaacgcgagaaaaattagtatttttgcacttcacaaattaatgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagcccactgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagctgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccggtacgtggcgccgcttgggaggcgcgggaggtgggccggggctgggcctgggttcgagggtcggggtcaggagggagaggctcaggggaagggggcctcgggaggggagcccccatctgacccgggctgcggtgagatgtgggtatgtgcgcgccagccagccgcctgatcccaacatgagaacccttttgtacccagggtccctttatcaggagatttacgagacgccaaactgttagggcagtaattatagcccccataaatttaattgccctggcagaggcttcaggccatgtgtctttgaagcttttcttcagccccaatgcccagcaccattctttatggctctcgggtgtttcccgttgtcaatagcctgtgaaacattttctttgccgttttatgtatcttgcgtgaacttggtgtcaggttattatataatgatgatgtccaattgctcttccccaccccaccttctctctcctcctcctttccctctcttccgctccctcctccttggccttctatttcggggttctgggttttcagttaaccccagttataacggaggggagcctaagcgctctcgaaccgcctacacccggcagcaggtcttggagctggagaaggagttccacttcaatcgctacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtaaaaagaataatcaaaaagaagacattatccggttaagagtctgtgctggttgccacccaagagagaacagttgtccaggatgctggctggtggaacaacctgctggcccgaaacaaggctgccaggtgtggatacctgagaaggactacttggtatcaaatacttttgagatggctacagtcagctagctggacagcccatgctgactggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtccccttctggggcacggtctttggggagaggggagtgcatttagacttatgtggaactgtacaaattgtgatgtggctacatagaaagccatgtgctaagaataaactccatttaaaaaacattaaaaatctaagattcatgtgttttctaagcttttcattaagaaaacaaaagtcctctggattgagatacttgaccttgcatgtaaaaaccttgtagatagcttgagctggattcacttggattctgacggctcacataatttgtgtgtgagagtgtgtgtatgtatgttcaacttgagctgaactcttgtcaagcttggcctactgtggaaaagttccaaagagtaggaaggctcttgagctctgagagggctcctcttcttcccaaacttggccaggctttcaggcttcaagtctctgtaaggcatagaaacgtgtccttccctgcaatgaaagttgaaaccatgcagtgctgtgggcccaggagtttctgcagctgttctacacactgaactctgagcacacttggaaagaagtggtctctttggtatttggtatttgttgcaccttcacacttaatctgcctgtttcccaggagataaaaaatagtttgtgcaaagggttgagattagtttttgtttcctggctgttcttaaggtcctcttcactaactacagactgggaatttttgtttgtttgcttgtttgtttctcttttttgaagaaagagctttcaaataaactgaattttacaagtacactctccaatgtctcttctgaggaaaaagcataatatacccctaaagttcaccccatgcaaagtagacctgggagagtttactgctggaaaatagccaaactgggtcactttcctcaaatgctttgtgatttttctgctcgattccagagatctagattcaaaaggctgaaaatcaaaacccacttctcgatctctacaaccctagtatttgtttactgatttagatttgatgcttactgcagggagttccctacaataagaccacaaaaacctgtgcacactagccccagaatattagaactgtcacctggccttgaaaaagtgcaacttttaagtaatgtagtaattttagcatagatgggagtaagtgctcacctgcctctgcaatatcagagaatttttaaacacatttctctcattagtggcaaaaccctttagccagtgtcagagctggtacccctttcacccctgctgccctgtgtgtgatacaaacaagggtgatccgttctatacctacaaatcagatttgagaggaaagtgatagataccagtctctgaagagccaagaaaattcgggagcaatcaaatacacacttaccttcccaaatcaggataaacctggcataaagtgcattttataaggtgtgaacgggtgccagggatttctggaggcaatgcaactgctgctgaaacttattaaccctccccctactacacacacttgtaaaacaaaattaaatcacgctgaaaataacaattttcccaggaatcattaatcacctcaaacaataaatacttctttgtaattcaacagcaattctgaaaggcattctctgggaaaagtctgtggaggagagagggatcttcttgcaaataatgtggtctcaggcaaggacacagcatcttggctgtctgctaaaaaaaaaaaaatgcctagactctcagtggaaattgagtgtcaagctgcaaaatctcaaatggcagactatcatcatttaaggtaaattcttatatttctcctttgtgggaaaagaggggtatgggaatattcattagcttcatgctgcaggcagttgtatgaggatgaaaggggtgactttctttcacttgcacttataagtccatccagaaagggaagagagaggattgagatcatttttctgatattccaggacaagatggcatttttgtcccaactgtattgattattaaggtattggtgagttttacaaaacccagattatagaaaatgatccaaatgattgccatttcttaagtgttgttttgcctgcttcaaattggcctttaagggagcttgttataagagattagaaaatcccactttgtgcttca

SEQ ID NO: 16323 - DNA, 10059 bp, Human
agatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaactataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaattttacctcttttttgacttcttatcttcaccttccactttatcccgttcaccacttttacaacaggaggactaacccgagcccctgcaattactttaggcatctatttaaatattacctagacggtcgtaatttgtctgggccctatagccctggtgccgtaaggtttgtcggcttttgttcagttttatggcttgctagtatatctggattgtggctgtcttggaccagtgatttcagttgagaggggagctacatagacagaggaagccaaacaggatttctttcgggagccccagggaggcttgcagaggccggttattttgcgggtgtctgggtcacagatgaccctcaatctgaatcggggagcaggcctggcccacagcgcatctctagccgctggaggcagcggttaggtggacccgggctggactgcatgggggcctccccctcccccagtacggcctcccccacctggcggcactccttagggccacgcgtttcctgcttgccagagtggggggggcgggggctaaggggagggggcgcaggagcgcgcgccccggcgggcgggcagctaggagggagagggggagagcgagaggcgggaggccggggccagacagggagccgggatctgtaccgtccctggcgctttcgagccttccacggctaccgcctcttggcgccggctcgctgggctgcaagatttgggaaagcggcgcgcacactgcttctcggagctgctctcgtctcgcctgctccccgcctttattcctctctccctgcctttcctccctctcttttcctccctctccctcccaggaataccttactggggcctgtggcttccccttccttgacgcatttgcggccgcctggggcactctgttgcactggcgggcgcaggttgcctaggggctgggctgggccgggccaggcgcgatggcagggttctctccttggcggcggcggcagcggcggaggcggcggcggcggcgggcgaggcagcccttcgcgggcagcaccagaactggtcggtgatttaggtagtttcctgttgttgggatccacctttctctcgacagcacgacactgccttcattacttcagttgaaatcgtctccaggtacctctgcgcgcgggggtcgggccgggcggggcatcacggccctggtcgtgccaggcctgcggtggcaacctcggctttccctgctcaggagcctcgtgtctttctccgcagcgctttgccagccggccggctttccccttccaccacacacctccacctggtcacagcaggtagggttaggttggctgctccttcgcggacgccgggggcgtggtaggaattctgggctttgggccattcaaggtcaggggcgcccgcttccatcctgagcctcccactggaggcctgcgcctgcccagggacctcctgccattctcttgtaaggctggaacacacacacacacacacacacacacacacacacacacacacacacacaccagtcccgggtgtgagctcaggaaagaacctccttccagtggagactcaggctggactaggaaggatagggcaggctgggatcctggccttgtcacttacccttctctctgtaagctcggccgctgctaggagtcgcctctcttttcttccttcttttccctgtcttcccttcctcttttatctcttctttctttttttcttctttcctttgctccttcctgctttcttttcttccgttggtctttttttcatcttccgtctctgccagattctatctcacctccttatctccttcccaaagcatccttggggaggggcccagagctggcttcaggagagcctagggggtctcactttcctctgcggctcaagtagaggttgggaagtctgccgaggaagggcccgcgtggggcggctgccgagggcggtgggtttgggcctggtgtgttactctgcagacaaggcctcggttatgatcacgaccggatggcggcagccttgcgtttcttcgcctgtcgctaacggctgactaggagatctgattaggggacattcgctgcagctttgtgtgcccatatcgagggcagggaggccttcgccagcctcactggggactggagctgaggcccaaccagcctcgctggagcctggccattcgctgggaagctcttagctggctcttcccggcctgccggtcacagcttggggtttgaccgcattgagggagactggctagggcaaagcttgactgcttgcttactagtggcttccattaggtacaaaatatgttccatacagcacctttgtgcagctgggtgctggagaaggggacccttccaagagccagtatgttttaaatgggcaaaaagaatcccaaattccagagccattgatataaacttgagtcatcgttccaaattgtagtctacagatgggagccagtctgaccattttccctacagaaaacagaaaacaaactatctctccctactcccaacacacacagttacagattcgtgcccacaaagctgtttcctttccctgcctggactggaggcccaggaactctttcgttgcacagccaccgacctgctgtctgaaaggaccacacaccccattcccttcaactcctccctgccattttctggaccagggcattggatttatttcagagatcacagtttcagaaatctcagtcgagaaggggccgttttaaattatactcatttattatttctttatgcatacgcaatctctttcacttcgaaaataaaagcagacaaaaaagtcagactattctggctccaaacctttgggctgaaggaagacaatatttggttttctgatttttctccgctttctaggcaccagtaacatctgcttaacactcaacgcctgctaattgttcagtaactctcttattttggggctaaggctgtttaaaggaacagcttttttacttaaaaaatactgaaataatcagtgtcttctcaggcataaaacgtggaaaaggcatccagacatgcccagcccatttgcagacacttaaaattgggagccagggtttcctccagggttaattttttaaatgaaaatctcagaggcctggcggactgcggggtatttaggacacggtggactgtggtgggggtgggcatgacctagaggaatttatggggcaaggaaaatattagggggagggagatgaggcggacaggacggggccatttcggagttcattgtgtcggccacttccctcttccaggcgcgggtgcaggaaggggcacccagtcggtatccgcgcggcttggcagcctcgctggtatttgggagtcccagccggaagtgtgtcagggtgtttgagggggggattactggaactgctggtgaggatgaaggcaaaagagagagagagagatggaagcgcccgaggccgccagcctcgccgccagggaagtgggctaatgaaaaacacactgttgcaggcacagtatccacacgtgaatttgattacccctgttctaggagtcgctgctttctgttaggaattgggggcagggggagtttccttccaattaacggagtggcggcgaccttttaatttacccccaacgggtgagaaataaacttccccaacgtggccaggcccaggaatgggactggagtcgatgcccttttacccctccccgttctaatttccagccctggccttgagctgtggctgcctctctttgggccttgtacctctccgccgagtctccgggccccgtaggtaaccaaggcgaggcccggagtagcagctggaaagggaggaaggagccctgaaaggctcacgcggccccgggacaggccacatcggtgcgggcctcccaggttccggagctgcggggtctcttaggcgaggctgccttttcccaaaccgaacttgccttccattcatgccacttgtagttttttccccagctgggattcacggagcgcaaccaggcttgcagcgctcatggttagagcctctgaggctggagcacagggctgggtcgccagccgcctgcgcctgggaatcctgattgccagctgatgagaaaggcgggctgggcgcgcgtgtgcgtggggtcgagggccggggaccgagcgcgccgcacaaccaaccaggccctcaaacccttcgccctggtggcggctggccgctccctcctggccagctcctccgtggggtcctcgtagcaaaggcgaatttaagggttgcccgggcgcccctcgctccaggcgggtagctgtggggacctacacccgcggtactccctgagcggccggtccctgcctggagtgccctggtagggccggcggcggctccgtttgggacggatcctgcgttgaatttgacttttcgagggcggccgcgggtaaactcgcctctcccggggaccgcagggattatttacagggagctcgccaaccaaacacaacagtctaacctttccaagtcctcgtaaatttttacagctgggagccacggcgaggcaaacgaatctgttggtcgtttccgacttcccgccagcctgtgtggcttctgaaacaataactccttatgaaatatcataaatatagatttaaatacagtagagcgacaatgcgatttggctgcttttttatggcttcaattattgtctaattttatgtgaggggctccgctggccgcactcgcacgcgggacccgcgccttcttgatggcgtgattaattgtgatataaaatagtccgcttaagaagtgtgtgtatggggggggagacgggagagtacagagacaaggctagatttgatcttttaatcgtcgttggccacaattaaaacaaaccccatcgtagagcggcacgatccctttacataaaaacatatggcttttgctataaaaattatgactgcaaaacaccggaccattaatagcgtgcggagtgatttacgcgttattgttctgctggacgggcacgtgacgcgcacggccaatgggggcgcgggcgccggcaacttattaggtgactgtacttcccccccggtgccaccaagttgttacatgaaatctgcagtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcgggcgccaacgctgtacccgctgcggtgtaccaccaccatcaccaccacccctacgtgcacccccaggcgcccgtggcggcggcggcgccggacggcaggtacatgcgctcctggctggagcccacgcccggtgcgctctccttcgcgggcttgccctccagccggccttatggcattaaacctgaaccgctgtcggccagaaggggtgactgtcccacgcttgacactcacactttgtccctgactgactatgcttgtggttctcctccagttgatagagaaaaacaacccagcgaaggcgccttctctgaaaacaatgctgagaatgagagcggcggagacaagccccccatcgatcccagtaagtgtctcctcccttcaaatccgccgccgcctccacgccggcctcccggatctgctggcccgccaggtttctctcgagcctgccttcgtcctcgctggaagcctctcgagttggggccaggagccagaagttggtgtttgggacgcctcagatagggccccaagtctggagagcagtgaagagcggcccgcagggctacgggagaggaggcggctgctgcagcgagagggggcggggcgggcacttcgggacgagccaagactggccgcccctctccttggctgcccaggcccaggaccgagatactttgggccgttcttcgaaagcagtgcagcccagagagccttttgtacaactagattgtccgtgagcggcggcagccagggcagccggagctgggacgctgggggagacggccgattccttccacttcttgccttcggccagtggcggcgtaaatcctgccaagatgaggctgcgggcgacccgggccacaagggtccccatgacagattattcaaataagccacagacgtgatcagcggccttagggcgccctgacggcttgcccagctccgaaggccttccaggaaggttaaataaggagtggggggcgtagagggacaggttgggaaagaaagacgaagtcagtgaacgggacagaggaatcctaatcttgctacagaacacaaggcagcatgctttccctctgcgtggcaaggagacctgtttccaaatttcattctatacagcgttttgagagtgggaggaaggagaagggggacaagaggacagagtaggagaaaggaaggtctcggaggggagggcgagccaaagttttactgcgtgcaattttaagtgactgtctgtgcgtctgtctgccagggttccattgtgtccgaggcctgactgcctttcctaaccagttcagcagagttctgcacttcggccagagaccccatgcaggaggctcatttgccccagcgggatgtgcgtcttctgctcctaaacccagtgtttctcttccccgcagataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttctctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaattggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttctattttttgcgggtctgctctttgcaccttcttctctgggtcaggggagcctatgtagagtctctgggtaggggcgggttggggtggtgagaaagagccccaattttgcctctggctggctttcaggagcgggacctgccacaaccagtccgccgagctaagctctcccaaacaggccagctgcctggcggcgagaaaaagctgggaaacccggcggaggagccaggctcccggccttgtgtctatgtgcgggacggcggagaagcccctgaggagctggtctggtctggccagtagcagtggaaagaccactctcaccttggtgcccccgagaaaattcccaaacctgggccttcgttagcttggtgaggaaaagggggagagggtgacaggatagagagctgggagccgccttctaagcaggctctgaagagggaaataggagccccaccggcccaacgtggccatgcaggcaaacattttgggggcttgcaaaggaacaaagccctgcatcctcgcaccgcccgccacccccgcggagtcctgccagcctggcccaagagaatctgggtcctgcactgcaagcacctctcgagcacaaggcctaacagaggcagggctgaggcaattgacgagcccctaagcgccataaaagaaaatgagggctgttaccgtttatggggtgtaaagggctacgaggggcgggggggggggaacggccacaacttcggaggcctgagcgctttccagatgtggccggagggttcggcctcgcttccacccccttgcttccctcgcccgacccccttcccccactccacgacttctgcaaagttgg

SEQ ID NO: 16324 - DNA, 94593 bp, Human
  misc_feature (1)...(94593): n = A,T,C or G
ataaaaattagcccagtgtggtggtgtgcgcctgtaatcctagccactggggaggctgaggcaggagaattgcttgaatctgggaggtggaggttgcagtgacccgagatcatgccactgcactacaccctaggtgacagagcgagactctgtctcaaaaaacaaacaaacaaaaaacccaaaccctactcccccaaaacccagaaattcaattaaatactaagagggtatctatttatcttggtgggaaaaacttggtctaaaaattaaaggatcattattaaaatgaatgaagcaagctaaaattccagaacaaataccttcctggggaaaataaggtctaaaaattcaagaaataattaaaaataacaaagtaaaaatacctgtgaaaatgtcctttgagaccagcctgaccaacacggcgaaacctcctctctactaaaaatacaaaaattagccaggcgtggtggctggctcctgtaatcccagctacttgggaggctgaggcaggagaattgcttgaacccgggaggcggaggttgcagtgagccgagatcgcgccactgtactgcagcctgagcaacaagagcgaaactccgtccctctcagggcaaaaaaaaaagtctttcaattatggtttttattaagcatactgtttttctgatttcattaactgaaaattagtggtaattaaaaatgtattacatataaataggaatgtgatttaaacaaagagtgacatctctgacaaattgtgcttataaaattcactgctatgtttacatttcttaagggacacagttatttctactaccagaaggttgctaccagtaacgcaagtgataacttatgctgattattcacaccgttttcttcatccataaaataaggagactgggactaaatggcctattaaggttcttctgaaattctatgatcaagtataatacccagcacaagaccaagttcaaaaatgtcaatacacaggaaacaaatcagtctgtaaatattgagaacctatgttatcaaagctaatgtcttctgaaataactggaagtaaagatgaaagtatatgaaagataattttgaatgttctgtatttagaatgtgcttcaacatttaatgcgatctaatttacatatcctttctggtgctattgcaaggtttgtcagggttttacggcaacagaagactatgatgaattcgaatgggacacatttgcttctgtggagttacgattcaaactgaatgtccaatataggaaggcaacatatacaacaagcaaaagtgattttagaaataacagaacgcgggagaaaattcacacacggaaaatgatacggataacaaaagcaggtaactcacagaaatgcggctagaaaagaggcctctgctggagcgagagcaaatagaatcagagggcattagaactgaaaagctcctaggagctttcagtgaacaaaacttcatagccaaaaaagcacacgactgggccaggagttcagagacagtcttggtgctcaggggtttgcagccctagccgtgtggtcactcccttgcttctctggctatttccttatctataaaatgagtgggctagtttaggccgactgagacgcagacagggatacggtactgtccatggacctctgagctgccctttccacatcgctggtgagttacttaaacctcctgtgtgtttccccctttcgtatgtcaaaataataacataaaatcagaatgtaaatccagacgcattgttttgctgcgattaagttgaacgaaaatagcaaggacgaagtaaggagagagccagcctacccgcgggatgaggcgtcccgcggcggagtgggctgggggcgtgtcgtcgcggaggggagcggcgaaccaggcaggaggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactgggtaaggcgcctccccggtccaccccagcgccttgtgcggggcggcctccagctgcatctcttttagggctcgtgctacacccttcagcccctgtactgtaggggcctggccggtctcgggagaggtctctgtggtgacgaggctttccttcccgaagacaaaccttcctttccagactgcgattgtgacgggggtgtgggcgactcggatcagctgtggagttttggaatggcaacgggtggccgccccacgcggtgggaggcccgtgggacaggccttcgcgatttgggggaggcgtgtgggacgggggccctttggctggggacgagtgacgctggcgacccccgaaggaaaagcttctggtgtccaaggctaaactctggggtgactgttttgagggcagtgtgggttttaccggcgcagtaagctgagaaaacacgtaggtcgcgtccgagaaggacgctggggtttgcctttgcggagagaaacccagctgttttggtttgagtcgccggtggcgaagggggcggagactccctgcgccgcctacttttgagggccgcgggcggagttggcggttctggctgatggcctgcttcacctggaatccattccccaccccgccccgttcgcaaggtgtggactagtcccgaccgacttgcactcctggcttagggaatctgtggctagagtttagcgtgcgcgcgcgcgcgtacaccttattagtaaaaaattgagcttagcgtgcgtctgtgtgggtgtgtgtacacaccttattggtaaaagttttgttagaaaacactggcatttgactttagacatacacagtgttagatttccggtttcacacagtggttatgaattgctattatgttaggctttagatgggaaaataaatcttgatttttcagctgtctgcattctgctaatgttaaaatttctacgagctgtgcacgaacaattaatagttacaagtttggtgctcaattcctaaaggatttaaagagatcatttgaatagaaactaaaagtgggtcgatcgtcctcaaagtgcttttcgggtttagggaaggagcttaggacagcctttctctttcgttctgttcctttcaagggtaaacttgaaggattgtttgatgatgccgacttctaataaggttttatttatttttcaaactgattgttcaacttcaaagaacattgtagtttttgttttctagtcatcacgttctttttttttttttttccttgagatggagtcttgctctgtctcccaggctggagtgcagtggcgcgatcgcggctcattgcaacctccgcctcccaggttcaagcgattctcctgcctcagcctcctgagtacctgggattacaggcgcgcaccaccacactgaaggggtgggttgcccctccacacctgtgggtgtttctcgttaggtggaatgagagacttggaaaagaaaaagacacaaagtacagagaaagaaataaggggatccggggaaccagcgttcagcatatggaggatcccgccagcctctgagttcccttagtatttattgatcatttgtgggtgtttctccgagagggggctatgtcagggtcacaagacaatagtggggagagggtcagcagacaaacacgtgaacaaaggtctttgcatcatagacaaggtaaagaatcaagtgctgtgcttttagatatgcatacacataaacatctcaatgctttacaaagcagtattgctgcccacatgtcccacctccagccctaagggcggtttttccctatctcagtagatggaacgtacaatcgggttttatactgagacattccatgcccagggacgggcaggagacagatgccttcctcttgtctcaactgcaagaggcatgccttcctcttatactaatcctcctcagcacagaccctttacggatgtcgggctgggggatggtcaggtctttcccttcccacgaggccatatttcagactatcacatggggagaaaccttggacaatacctggctttcctaggcagaggtccctgcaggcttccacagtttttgtgtccctgggtacttgagattagggagtggtgatgactcttaaggagcatgctgccttcaagcatctgtttaacagagcacatcttgcacaacccttaatccgtttaaccgtgagtttgacacagcacatgtttcagagagcacggggttggtggtaaggtcatagattaacagaatctcaaggcagaataatttttcttagtacagaacaaaatggagtctcctatgtctacttctttctacacagacacagtaacagtctgatctctcttgcttttccccacacacacccggcaaatttttgtatttttagtagagacgaggtttctccatgttggtcaggctagtgtcgaactcctgacctcttgatccgcctgcctcggccttccaaagtgctgggattacaggtgtgagccaccgcacccagcccatcacgttcttaaattgtagaccgctgtttatagttctcactgcagccatgtttgtagaattaaccagcaaataccttttccataacaaaagtaaaattttggaattcaaagtttcaacctttttaataatgttaaaataatcatgaaagatcctaatgatgctccttgtatacttcttttggggactttgttgtattcttttggaatggatatgttaaatctgggctttatgcatttctgtctttttaaagcttattttgtcccaaataaacctttagaagaagataaaaatgtcctctaccctaatatgtgtgggccaatatcatagcattttagaaaccaacttataaaaatctaaaaagtaaataaaagtggtgcgggtgatacctgggcggaatgtcttggcactcaggtgtaaaggattctggaaatagggatgtctgcaagggtgcaaattaatagactggggcttttgctgttgcctcctagaaaaattgctgattacattttttgggagcagaggtctgttgagagttgttagtctttctttttttgagccacagtgtgaataattggaaactatttgaatgctggacattttttcctttcatatgtttgtgtgtcctatcggattaaagtttggagataattctaaaggttttttagctgaagatgtgaaaaactttcagtaactctatcaaccattacctgaattacaacacttctaagggtacaaagcgttcatattctaaaatgcagtgtttctgctacagtgggtcatatgtggagtgttactaatctgtttcatttctttatttgctttggttttactattacagaaattttcaaacatacacaaaggagaatgaacagtaaaatgaaccgacactttactaatcttgttttattacccccctctaacattaattttttcccctggagtttttaaagcaaatcttagacatcaagacatttcacttacagttagtttagtatctttattttttatttttatttattttttatttttgagacggagtctcgctgtcacccaggctggagtgcaatggcgtgatctcagctcactgcaggctccgccccccagggttcacgccattctcctgcctcagcctcccgagtagctgggactacaggcgcctgccacctcgcccggctaattttttgtatttttagtagagatgggttttcaccgtgttagccaggatggtctcgatctcctgaactcgtgatccgcccgcctcggcctcccaaagtgctgggattacaggcgtgagccaccgcacccggcctagtttagtatctttaaatgataaagactagaaaaacacagaatcaccataattatattatcacacataacaaaattaccttatttttgaattctaattgttaggactggcaaattatatttagtatttatctaaattaaaaagcttaatttggcttcatatgtttaatgtacagaagttcttactatggtctatttttcagtaagttcactaaggcttacatttttgggctaaagtaaaacaagtattgggaaccactggaaaaatactaccacaaaagtcaaatctgctttgggcttgaaaaagttacaagaggagtaagtaaagataacattgaaatgcttccctgcccccaccccatgtttattttagctgtatacataactgagtgcccactatatattatttatcttttttatagacattaatgcattcgcaaaataataaaattggaatttagaccaaagactttataatatacagtttacagcataacacacataaagaaattctagaggcattggaacttggggaagtgtagtaggaaacctggaagagggcactgtagccagcatgtataagcatttctgattttgtttcccagccaaatgtgtctggccccttaattgttgactggacgtttcatacttatccttggcttgcctacttactatactcctgtttgtagaggtgcactttagagaaggggaatcagaatttgacatggtaaagctgcttgcttctactttcctttttgtgtagggagtgtacttctctccaactgagaggaggtttgtactttttctcaggatgttagtgaagctacacttcccaggcattaccacaaggtgatgcagtgactttgcatattatttctccactcccgtgcgaccttgacattctcagtgaattccaacatttttgtaagcttgcctaagtctgttatctgtaggaggagtgaaccagaggaactatgtgggaattagaaattttattatttaaaatgggttgataatgacataattatatttgattgcattcatccatgtaaactttttaaatgattagtagctatattgtaatttaataagagtaaaaaatgacaaggtactggaatgacttttgtaaaatatttctataattatagcaatgaaattttaaaaagattggagtgttggagagagattaatgaaggccattaataggataatcacaaattattttacttttcagacttgtaaccattgtgaatactatattttaaagtgaaatactagtgttttctattagaaaatgtgaaattcaggggagggtttaaaaatggaatttcttgttaatagggctatttaaaacaatagaaataatacatttatatatacttgtaaaaattcaaacaataaattgatgtaaaatttaaggtccttaagtcttctttttacacacatcccttataagactattaactctatagtgtatacttcttgagttccttttgatgcatttgtaaacatatacaaatacatatatgtatacctatgtgctattttgtacctcaaaaacttcagtgaactaaaagtataaggttggattgtggatttttaaaaaactgttataattgaggttaacagaagttgaaacacttttgccttgttttataaaaaaaatagttacagctttgttggtttaatttattttaggaaatgatatgttaaattttaagaaaaaagtattatccttaatcagcttttgattaaaaacatgggacgtttattctaagctagtttatttccttcttactgaatatctttcttaaaggaagcgtgactattcactcacttcatagaaaaatattattctcttaattcagttttggtagttgtatctaatagatgttggttctgttgatttagctatagtttcttttgttggtgtcttgtaaccagtagtgagttttttttttttcttttttttttaaagaactggaattggtgtttttttttttttcctttgtgaagccagtgacttgagataatcattaatgacttcattagtatcatgacctccctgggagcccaaattagctcagacaactcaaagaaacaaaataataaaactcttcagttattttaggcagagttctccagtgtttgtaaatgctacctgttcatttttctgatggctttaggttaccaggtagagagtattcatagttaagtctttccatgaaatatggttgctggtagcaaagtccctttattagtgcagaggtaaagggggattgctactgaatatactctttatcttggaatgcttgcaaacctcaggtagggagaggctgacaactagcctgatactctacagtggtttccaggttcatgattgacagtctctttttgggatatccattatattcagtaaagcaggactttggccataacagaagcagaggggacacaagaagaaagttgatattttttaaagtgcttattattacaaaactttaaaaatttgccttagtatttcaaacaggtcagcaaaagaaacagttgtaaaagcacactgttttagatcttagcaataagccttcttactaatggctaaaatatgagtagagccttactgctgtgcttgctctgtagaaacttcattgatttgtgaagtaaattagattaatttggttagcaaaaaccttgccccagttttccccattattacagagatgcctgttttaatgactcaagcaagtgcagtcaggacagtcatagtttcttatgtgtattgtagaattagtgattgtacggagcctgtgacaaactctacagattgcttttttgggtaaatcctcatttgtttctgttttctcaaaagtagagcacaaaatagggaaaacatttggatcttgcagtttttataatctgctttcactattcatctgctatccagtgcttggtgtttactaagccagtgagcgttcatgaatctctaagagattttcaacagtgtgtattttattaacactacacttttatttttatttttaaatataagtttattttaatcagtaaacatgtggaaagggtacgtgaatactagaagttgaggtaggatcattgattggacctatgatgaaatgataggtttgttataggtggagaagaacaaataggctgagccatttcaagtagaccagctaagattttacatggtttgagagatttgaacaagcttgtaacagaagcccaagaagacaggctgggtctgggatctgtggaaatgagtgagaggtagaagttgttggatagtggttctcttttctggttgcatacaggattgagattacttggggcgatgtaggggcagggctatgtatattcgtatacacacccacagacacacatgcacacactcccaggccccaatcccagaaagttgttgtcatctattttttttttttaaaggcccctaatgattctaatgtgtaaccagggttgagaaatgctggtccaggggattagaagggcaggaatgtaggcacagagatgttagcgtcaggtttagttataggaccccaaaacctagggagaggggaagagatgaatgggatgggctaggttagggaggagaatgatgaagcccaagggttctacataggaaggaaatgttaattgacccatagccagtaaaatactgacttttaactgttcttgtttctgtttcttagtgtttgttactaggagccagcaggtttatattggcagcgtgtgcacaaaaacacctctggttcatttgcttttgatttaaatagaagcagagggctaggctttccaggagagttaatttttggttttggttttttaacttttaaatgcccatataactttctgagccaaatgggttttagttatttttccagtttgtctgtatttttatatttaatcaatttttaagaagttccagtatttacaaagtatatattttcttaattatgacatgcaaatattcatgaaacttatattaaatattatgtattttctgaaggcataagtttattcttagttggtataatttaacttgtatgaattacttgtttcagattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggtaagaaagctttctgaatatgttctccatgtaaacacttaaaattttcttttaaaacagattgataagtagcttttacttgccttaactctgcattaagactcatttttgtaaacatcaccatgaaatatttaacagtggggagtagataaaatggatgttgggaactccatttcaccagattttcctctccctgatcagaaagtttaccttcacttaaggacttgtgaaaattttttcagaatcttcttttcctattttctccattcattacctgcaataaaaaaagatctttttctttgggttcttatattatttaccattttttccagtcatttgaaattaattttatacagcttgacagccatgttattatcccttctactgtcctgcatggcttaaatattgctcagattgtattacacagttttaagagtattctgtttgtattacacagttttaaagtattctgtttaacatgactgaatagtaaactctttgatggcaggagttctagttcttatattttaccagtgattttgtataatactttcttgaaaatgaaggtgatcattacagtggtacacctcactgtgcaggactttttctggcaattttaactcttcaaaatgtagtggaaaaccaaaacataagaatgtcctctgagcagtcaaaataatgtcacgaatgtccaaacagtaaaacacattcacttttctcctgtgttattctgtagtcttcctcagaatcagtttgttttattttagttaagatttttatgggcttgaaattttgattgtctaatctgtataaagttaaacaacaaggaagaaagaaatgaatagctgctagaaattaggcacattgaaagtgtctagaagtaaaagtccagcctgacgggaaggcagaaaaacatttggacaaaacaattttggcatttaatgacttagttcctttctttgaattcctcatttcttgatgtttctgaatacaacacaatagttatttactgtttactttttgtgtcagttttttaggcttgtcaaatcccaaaatggagaaacattcattgtaacaattttatgaaattaggagtagtttttaaattttatttcttattttttgagacagggtcttattctatcactcaggctggagtgcagtggtgggatagtggcttactgcaacctgacctcctgggctcaagtgatcctttccccgcagccttccaaatagctgggattatagacacaacaccacgcctggctaatttttaaaattttttgtagagacagggtctcactatgttgcctaggctggttttaacttcctaggcttaagtgatcctcctgtcccagcctcccaaagtgctgggattacaggtgtgagccaccgcacctggcctcagtagtagtttcgattttatgggagatactggtatcaagttaaagatactgattgagaactgatgttttctgtagtaacagagcagagaggaagaaaacagaaatgtgactgaggaaaaagaagggcatttccagcaggaaaatggtacaggttgaacatcctaaatctgaaaatctaaaatctgaaatgctttaaaatccaaaactttttgaatgctgacatgatgtgcaaaggaaatgcttattggaacattttatgttttggatttgggatgcccaaccagtaggtataatgcaaatactccaaaatctgacagatttagaaatccaaagcacttctggtctcaagcatttcggataagggatactgaatctgtataagcagaggcttagaggtaggaatgttcatgagaatgagtaagtcagtttaactagagcataagcttcagttagggaagttgtgggagatgagattggagataagtttcattctgtctatggacgaccttcagtgttagagagtttatggacttttttctgaaggacagtgggaagtctttgtatatgtataggttgtttgaaaaagtatgtttcaggaagatgaattattacctttttcctgcagactacttgtttatttcttatattttttcatttttttaaagccaaaagactgtgactttcccttcaaatccaaacaatcagttctaaccattttactgcttacatatttctaaatccttaatatcactagttcatgccttccatattttttaccaagactattgcaataggtcagctgttttacccactttcattcttgtcctctaacctttgttttttaactgctctatataagctgtaaaatggaaacctgaacatgtctttctgttgtttgaaactcttcattggttcttcatcatctgtagaataatgccaagaccaaataacctagagccatacagggctcctgtataagattttatttccagcttcagttttggtcattcctgctgctgcctttttgctttggtaatgctaaactatacttctttcattgtgcactttaaggattgtaagttttctctcagcaaaaaagaaaaaaaaatcttctgtttaataccctttccatcctttttgccagcataaaactttaaaactcaataggaagttcaggcatgtagtaaagatttcaggtaatacaggaaggctcaaggaagaaaataatcatgcttaacacttttacctactgttaactattgttaacatattggtatatagctacatgtaataaaattacaaataattatacacatgcataatgtgtgtataataaatatatacacacatactactgatgcatcatagtgtgtgtatatattcgttgaaccagtttcttactattggaatttacattgttgctaaatgcttatcattaatacttaataaagatctctacctatctttattttgtctacttatttcataaggtaagttcttggaagtagaatcaccatgtttatggcattgtttgtttttaagcactttatgtgtactgcaaattgccctctagagtgattttgatagacaccatattgacaagcaggcaggaagagagtgcctgggtagcaattgtaagggaggaggaatgaagatgggaaagtagtatgcttgagaaagtgttaaggaatttgatttgcctgggacagctatcaattaaaaatttattattattatttttttagagactgggttttgccatgttgcccgggctggtctcgaactcctgggctcaagcgatccacccgcctcagcctaaataagtgctgggattgcaggcgtgaaccaccatgcccagctacagataccagttttagaagatgaatgggaaaagttagtttggatcatgttgtagattgttttaatatttgagggatagtttttaagtaaggagtaataaagtttagaagtgaagcttaatcttatagtgctgagtaagataaattggaattcgaaaggaatggaggtaaagagaacgtttagactatcctaattttctatgtgagataatgaaagcctaaagtggagaaggaagtaagttgtgtgtaataatccataagtagaattcataggatatgtcaacagtcaattgaattagaactggcactcattctatggcatctcagtaaggaggagcaaggtcatatgttaaaagttggggagggcttgagtatagataattggccttgctactgtggaataatgtcatagggaatcggagtggcttaaccagaagattactaagcagcaattttatgactttttccagagagattcagcatctggagttgtgtcaagagtgccagaagtggctgtcattcaaattgggtgttggaaaagggtgggaatgggaagggaagttaagaggacaaaggatactatggtggttttgagtacattattgaaatgattgactgatagtgaagtccaggttgggtagggaaatgagtgaagccaaacaagggatatagactgggttggaggtttttgttccttttagttttttcactccctctgaagtattgattgattagttttaattataatgaaaataaacatttaacatgttgggaattttatacattcacctctcatctgagcattatactccctgttttacagatgagggaactgaggttcagagaataaagtgacttgttcaaagttatccattatacgttggagctgagatttgaaccttatgtaaattggcattcaataattattctctggttgtttggttaagtgagagatctgattattcaaaattaacaacagagttgctaataagttcagcatggattttctttagtgacagaattgaagtaaaattacagggaaagatttagaactgcacctgatgcaggctgggcacagtggctcacgcctgtaatcccagcactttgggaggctgaagtgggcggatcacttcaggtcaggagtttgagaccagtctggccaaaatggcgaaaccctgtctctactaaaaatataaaaattagccgggtgtggtggtgcatgctggtagtcccagctactcaggaggctgagacatgagtatcgcttgaacccaggaggtggaggttgcagtgagcagagattgtaccactgcactccagcctgggcgacagagcgagactccgtctcaaataaaaaaataaaaagaactgcacctgatgccatatctttattattaaaccaacgttaattgcagtaaaatactatatgttacattatatttgagttttgttccgttttgtgtttatgaatttgatttggtcttagttgtataagtacataagcatgaggaattggtgtatgtttagatttatgcttagtacaaattaaattaccttacagttaaagatccccagtggatgcctgaaattacaggtagtactgaactctatttacactgtacttttctgatacagtcatacctatgataaagtttaatttataaattaggcacagtaagagttaacaacaataactaaaaatagaacaattgtaacatgaaattgttatattacctgatacccagcctgcatcattagcaactctgttgctaattttgaataatcagatctttcacttaaccaaacagccggagtaaaagttatgtgaatgtggtttctctcactctcaaaatattaaaatatcttattgtactatactcacttattttggggtcttggttgaccttaggtaactaaaaccacacaaagtgaaaccttagataaaggatgactactgtagtaatgttaaaggtccatgagtttttgttttttaaactttagagtcttagaattctcacatctctgagatactgttctaattggaattctcacatctccgagatacttttctagttgaggaaactggaagtgcaaagtggtcatgtgacatgttcaaagtcacattgctaatgcataacatgtcctatactagacaaacaaaacctccctgtaaggtactgttttcactgcatcctgctgtcaagcacatcaaaaactaagttgcctgattagaaggtggatccaaacagtgattttatgcttgaatatcctgtttcaagcttttgtttctttgttccttgtttttccttttcaaatttttttcctccttcttctcttttcctgccttggtctccccttcagtcctgtctcattccactcattttctgtttttaaaaaaagtcctctggttgtaaaaaaaaattacaattataatatatataatatataaatatttataattatacttatttataattataaaattaaaatgtcctacagtcccactacccaagtatatccctacctaattaatatcaatggttagcactgttaatgttttaagtatttccttccagccttgttttattaatggaaggagactttcagtcttttttgttttttgttttcgtttttgttttttgagacagtctcgctctatcgccgaggctggagtgcagtggtgcgatcttggctcgctgcaacctctgcctcctgggttcacgccattctcctgcctcagcctcctgagtagctgggactacaggcacccgccaccacgcccggctaatttttttaaatttttttttatttttagtagagacggggtttcaccgtgttagccaggatggtctccatctcctgacctcgtgatccccccacctcagtctcccaaagtgctgggattacaggcgtaaaccaccccacctggcttgtcttttttctaatgcatatattttgaatgttgctggcatatctcatgccttttttaatgccgtgattttttcacttaatcacttacaattagttctgtaccattttatctcattgaggaatttatgctgtttatgatatttctcttttgaatcaatgttgcatactccctgtgtatatctaggcatttttgcagtcatttttttcctaaaggaacttttctagtaacatgatttttagaagctacattgtatacagaagaaggaaaatgaatgcttctacccattgtactcctaccttccccagtgatgtctgttgttgtatgtttctggattagaaaaattcataggctcatttgatacttttttgtgggcgtttttcctcacttaattatatttcttgggaatcctcctatatccatatgtaatcagctcatttattttcagtgcctttcctactccaaggcttgtctccctttattcatctccaaacatcagtcccctcttctctatttctttctttctttccaagtggtgtctcatatgctttcctcaacctaatgtttctgtctttttctcaatgtttctccaggatttattatcttgatgtttttctaggtaactttgatgttattctggtcttctgtatgttctttctcagaatttcctttatgatcaaaacttatccaacatgtttttctgaaatgttaatcctatttaaaaggaacactttgtggctttctcccttctctgtcacccttgtttaatttccattttctcatttattttgctgttgcagtagtaacaagaatgatgcccactgctgttgtaattcttcaaactaaagtatgtgacatattcattgctttagtttctctcttaacatacatacagcctccagtggtatctgtgactacaattaactggttaactagattcaggtatatctcctagaagcaatgtattttggcagttttatataactggtattttgtcccattgtccaaagtgttgccatgttctccctgccatttttcaatgtttgaaaattgctgttattaactttaagtgtaataattttctttacacttggtaatggtggactaaaagacaagatttcttgcatttcagtgtgtcctgtagcattgagcagcaagttctagcccggtgaccaggaaaataaaacagagaatcaacctttggtttggacacattatggtttattgacccttctaattagatttattattattgcagtggactcctgcataatttcctgatgttcatcttttgtgttccttccagtattatccactctagcatactttcatgtgggagcttagatataagacagttacatcccaaaggagcccattctctgtatctttccaggttgagagacttctacatttattttttatgtatgcccaacatgcccctctctaagtaacttaagaactattgtttagttttagttttccttactcaaaagcaatttgaagtgtagttctatatttctgactttttactcaggattgtatcttgcccccaacttcttggtaggctcagttctcaggctgctaacaagcacttatgtgataggcactgtgctaaatacagggatgaactcacttaatacagacacaaccttttgagactgtttttgttatcagaggagaaaatagaaatgaataacttttccaaaaccatacagctagcaaattatcttttctggtattctgacctcacaccctatgctcttagttattacaaaatactacacctataataactaccattcatggagtgtttgccatggattaggcacttcagatgctgcttttaggttcattacctaatttaattcttccaacaactgtgaaaggaaaaaaatgggctcaaacaggtgaggtaaatgacttgttcactgattcctcaggtttcatatccgtaaagagatgaatagtgtcaaatgttttttaccttgacacagaacaaagtaaattgtaagatttgtcccagcatgcagatacaccagaaactaaatttcatgaaacacttacccttaatatactccagtactttctcttctatataattacaaaataaatgccagtcatgaaccactaaattggttttatcacttcttactgggtttgtaacctgtagtttcaaccattcctttggaggctaaaggtgactaaggttcgtccagcttcagtattctgttgtctacaatcaggccaatcagaatcatagaacatggataatctaaccttgtggctgatgcataaatttttgtaatattcctagcaaatggatatctagtacctgttttaaacatctccaattttcaatatttaacatggtatttagtccatctggaaaatacagattgaggtatgtatatattcatgttgtaagtagaaaatgtgttagcattaggtgagacatgggtggtctgtttgtgcatatataaacatcttggtgctaaaggtctttttacaaaatttgccaattggctgcaggcaagacttgccaaagatgagagattagtgaatttagtggatttagggggaggcagatgtctaagtaaaacaaataaaacacttacattggaggtataaattaagttttttgaattttgatatatctgaaaattcttcagaggtgaatttgtaatgcatgtctaatattttaaatattaattttctttagtctataactccctcagttgttggatctgctagacattcagtatgtgccacctttgaaaataatactctgtggtcaataaaaaataaataacaagtatttaaaaactcactgtgtttagtgaaattaaattttaatcaaaacacatttttatatttgatcatatggatagttagattatccttgagaaattggatagcaaattgcattttaatatagtagaaactctactattcaatttatgtagatttttatagcattaggctgtagtttaatttagaaataatttgacatgcttgttaaaatactcatgatttgtaaacatattaaatgtatattttaactgtaaaatacaataaataaacagtatgctgtatgagcctaatattaaactatttgcttataaatccgccttttttgttatttccctttaggttggatggagtactgctcgtgattattacacgtttttatggtcccctatgcctgaacattatgtggaaggatcaacagtcaattgtgtactagcattccaaggtaaggactgaaaactgcagaactcaatgaaactagatgtcttattgccattaaagatgttgtactccattgtaatgatttgttcaggtatctccagggtaccaaagttgaattagttagtgtctttacttagcaaaagccctaagaatgtaactgtctggtgtaggccacatgatattttatgtagacatttaaaagttattggttgttgtcttaactttcactgaagagtgggtttctttttaggtactaatttttggagatttttttttttcaagtgagaaaacaatacaatagtaataacagatattagaataatgtaacaaaaaagaggtgaggaaaatagtccagatgcaaaccacaaacatgattaacagaacttatagttatttgaattctgtcatgtgtaagttcctttattataaaatgataaagtaatataaaattcatttttgtgttagcttggcattatttacaaaatttaaaaaatactcttattcaggtaattctgacatatgctacaatatgggtgaacactgaggatgttatgataagttaaataagccaatcacaaaaagaaaaatactgcataattccgctatatgaggtacttagagtagggatagacacagaaagtagaatggtggtctgcagggcattcaggttccctcaagggaggaatggggagttattgtttaatgagggtagagagtttcagttttaaaagatgagaacaattttggagataatggtggtggtggttgcacaacaatatgaatgtgcttaacattgaactatacactttaaaatgcttgagatagtaaattttatgtgttttttagcacaacttaaaaacttgaaaaaaaaataacacttattcagagatctatcacagaatttgctgcagagtaattttgtattataattgtactgactttaggattgtattaaagtgaattcttacccttgtatatgtcatagatttcttttggtctggtgaagtttatggactctgtctcagaataatattttaatgtatataaaataagacataaaattgcaaagaaaaccaattatattgaaataattaaaatatcacagtaacaaatttttgatatattaatacatgtgcttcaaaatctgtgtgttaacaagatgtattttattggcagatttaatcactgccatgatttccaagtaagataacattgagatacctgtaacaattgtaatgtggtattaacatataagtaattcctgttagtgacaaaaatcacaaatactgatagtaatcaaagtacatgctaaaattttagttagatgttagtaaaaataaaaatataatgtttttctccattaaagttgatggatgacctgaattttctgtatcctttaaccccaagttgaacattccctaaaactgcctctttgctattgagaactttatttgcctttatgtttaaaaaaaaaaaattctaggactttattgctttcccctggggctggctattaataattaagactttttcctctgggtttctcatatctttaagcaatgggctctgttaagaatgttcttatgttagcagaaagaagtttacattgtatgaatcactactttaaaaaaatgtgctcaggattatgagatgaatgatttaaaataaagtttattgtctcacacattttcacatattttaatgcaattttaaaattttgtaaatcttttttttttttttttgagccggagtcacactgtgttacccaggctggagtgcaatggtgtgatctcagttcactgcaatctctgcctgctgggttcaagcgattcttgtgcctcagcctcctgagtagctggaactacaggtgctcaccaccacgcttggctgatttttgtatttttaatggagacggggttttgccatgttggccaggctggtctcaaattcctgacctcaggtgatccacccgcctcggcctcccaaagtgctgggattacaagtgtgagccaccatgcctggccctaaatctttaaaatgaaaccccaaatcatttctcccttatctgatctggtttaccatattcagaatgttaaaaattaaatttgttttaacaaactaaaagaaaaacctttaaaaaaccaaactatactaaaatatttatttaatgaaaatactttgttagcatgcaaatacttacttcagaaaggaaccaaaaaacagtttgaatttgggataaacatttctagtattatttattttagaatttttttttttttttgagacggcttcttgctctgtctcccaggctggagtgcagtggcgcgatctcggctcattgcaagctccgcctccttagttttcgccattctcctgcctcagcctcccaagtagctgggaccggaggcgcccgccaccatgcctggctaattttttttgtatttttagtagagatggggtttcaccgtgttagccagggtggtctcgatctcctgaccttgtgatccgcccgcctcggcttcccaaagtgttggaattacaggcatgagccgccgcacctggctgaaaaatttttacagtgatccctcccttgagtttcagtcagtttttgttatagtcgctaagagagagcatcagcctgttttaagggcagcataacttggagcctatgcacatagctttggtatagtgatttccaaacttaactttaatttggaatcctgcgtgctttaagacacacagaaatttatgtcccacctccagatgttgtgatttaattggtctgtggtatggcctgggttttagaattttgaaaagatcaacaggtgattctgttatgtagaagtttgggaaccagtggcatggcagacagttttcagcaaataattgttaacattatctaattgatatggtcttatctaagttaaaatgtcctgtttttttatcaggcaatatctgacttggattttggtgacatgtgcagagcagccttctaaaataactaggctcagattaatcagcttcagatagtttaattttaaaaaattaacatacttttttggagcagttttaggtttacagaaaaaattgaatgaaaagtagagttctcttgcaatcccttacaccacccttccctgctttcctttattttaacatcttgtgtgctccatttgttataattgatggaccaatattaatacactattattgtctgagttcatagtttacatcagggttcactgtgtgatgtaaattctgttgattttgatgaatgtatgaagacatatacctactgttgcagtatcataaagaacaataacttcactcccctaaaagtctcctgtgtcccaccaactcatctctccttccctcctggtaaaaccctggcaaccagtgatgttttactgtccccacagttttgccgtaaaatgtcatagagttggaatcataacgatatgtagtcttttcagattggcttcttttacttagcaacatgtggttaaaattccctcatgtcttttagtggtttgaatagctcatttcttttattactgattaatattctattgaatggatgtatcatagtttatgaatctattgaaggagatcttggttgcttccacgttttggcacttacaaataatgctgcaataaacactcttgtgcaagtttttgtgtggatgtaagttttcatttcatgtgagtaaataccagggaatgtaattaattaattgtataagagcatgttcagttttgtaggaaactgcgaaactgtcttccaaagtggcttgtaccattttatattcctacctgcaatgaatgatgagagttcctgttgctccacattttcagcagcatttgatggtgtcattgctttggattttggtggtctgtttgtttaaaaactttttttcactttattctgaattttgcatatgtttggtctaaacattaattggcaatgtgagttcatggaacttgcatatataaagaaatttccttctgttctgtgccaggaaaccagtatgcagaggataaaacttgtggtgaaatatgggcaatgatttaggtattcatagatgttttttggataaggaaatgttgtaagttatatatgtagtttatcttttaatagccttttttagataataaaatttaggtgtgtattggaaccggttttgttacatttaaaacttctttcctgaaagctgttggtttatttttagtcatttttattgtgattggtttccccttaaaaaataagttaactgccaggttaacttattttttaagtggtgactcacacctgtaatctcagctgtttgggaggttgaggcaggtggatggcttgtgaccaggagttagagaccagtgtgggcaacatagtgagactccatctgttgaaaaaaatttattcaatttgttatagtgactattgcttttgtttattagggacttaggagtaagtttaaaagtggttaaaaagtagagaaaagcatccagtttatttctgttaatactttaaaaacatttttgggccagacatggtggctcacacttctaatgttaacattttgtgaggccaaggaggatggattgcatgagcccaggaatttgagaccagcctgggcaatttggcaaaacttcatctctacaaaaaatacccccaaaattagccaggcatggtggtgtacacctaaagtcccagctacttgagaggctgaggtggggaggatcacttgagcccaggaggctggggttgcggtgagccgagattgtaccacttcactccagacttggcgacagagtgagaacctgtctcaaaaattcatgggcactaagcctaaatgcaatatgttttacaagtttctgaaaattcaacagttcatttttattttgaattttgaaattcagaaataaaagcatctccgtgcctagaacttttttgttatataaggaagtcagggaaagcttagtcattgaatattagagttatagaagggctttcaagcataatgcaaatcactttgctcattttgtggatgagtaatgagaatcctgaaatgcaaaacccaaaacatctaacaatacctaaacgtgattgttttcctaaatgaacccttatttatttattataatcttgttgaatactaaaggcacagtctgtaaaatttgactcgaaaatttagttttcactttttcccattttattttcagtatccatctgacaagtttttccaggcagctttaaattgcagctctgaataattatgtctatctcaaatggttttgaaccatattttttagcagtttattttagtgaagtttttgttttttaaagaatcagaccttgaggccgggcacggtggctcacacctgtaatcccagcactttgggaggccggggcgggtggattacctgaggataggaattcaagaccagtcttgccaacatggtgaaaccccgtctccactaaaatacaaaagaattcgctgggcgtgatggcgtgtgcctgtaattccagctactcgggaggctgacgcaggggaattgcttgaagcagggaggtggaggttgcagtaagctgagatcaggccactgcactccagcctgggtgacagagcgagactctgtctcaaaaaaaaaaaaagaatcagaccttgaatacctagtttgtacagtttctaatgtcttgatgccagagctgattaattatgctatatatttgttttctagttaagcttttaaataagcctagtggctatttggaagttggtatgaattagtaagtttttagtagctattaggagggtggatttttaaaatctttaaaaatgtatgttgccagatacatgtctatgatatttatttaaactttgtattttgaagtaattttagatgtaaagaaaacttgcaaaagtagtacacagaatttctgtatgccctttgcccatcttcgtgtcatgtgagcatcttacatgaccatggtacatttatttaagaaaccaatagtttaacagtggtacagtactattgactaaagtacaaaccttactcagatttcaccagtgtttccattactgttctttttctgttcttagatccagtctttaattcctctttgtatttaattgtcatgttgtcttagtctccttggtttcctccttatctttcataacctttactttcttgtgaagtactgttagcattttgtggtgttgtttgttttggtagcttgtctctcatcttggttttgctcgatgttttctcatgattagattgaagttatgcatttttgggaagaatgccatagaaacagtattgtacctttctcagtacattttatcagggagtatgtgatgtccatacatcttattactggttataataatcttgattgcttgtttaagattgtgtcttctggatttctccactgtaaataaagttattatttttttcccttgtaattaatgaatattatgagggagctactttgagactgtggaaatatcttgtttctcctcatattttcagccactaattttagtatccctctgtgcatcttgcctacgattattgtggtgtttgcctaatgaagttcattacttgtatatttattagttgatcattacgttagaaagaattttcttcttctccatggaatcattaatttcttctgtgaaataaagtctaataccatattttttttgttacttaaattgtttcagctttagccatttggagcttttcaagtgggctcctgtatttttttttgacatgctccacccctctcttaattcctttttgtggactgctactttgctttaaagcgccacaagaatttctcttattttatagattgtctgcctctcctctctgttttttttttttttttttttttttgaggcggagtctcactttgtcgcccaggctggagttcagtggcaccatcatggttcattgcagtcttgacctcctgggctcaagcgatcctcccgcttcagcctccctagtagctgggactgcaggtacatgccatcacacctggcaaatttttgtattttttgtagtgacagggtttcaccatgttggccaggctggtctctaactccaggtgggctcaagcgaatctgcccaccttggccttccaaagtgctgggattacaggcatgagccaccgcactgggtcctaaagcttatttttaccatactgcactagcagacctcatcttttctgccttcatatagttcacatgtgcagcatattactttagttaatatctcttatttacatgtaatgaatgtcaaattggagggaagatttctctaaatgacatattcccacccccactcccagtcctcagtagacttttatattggttcttcccttgctcctcctccagcctctttcccattgtaaagtatatacttgcctgtcctaaatgagtgggttttgccctagtgaagatacaaggggaaaggatattctgggaatataagcttaaacctaagagaagaaaaaatttaactttgagtaggaaggaagaatctagttttgataatttgcgaaaggaggaaggacatatcccagattcttgtcaagaacagtgtggggaatgagacatggcaagtattgttaaattgaaataacatgaattttataataggaagtttaataattttgtttgttaacttcctcttaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgaggttggtgttcacagtgagatagtgattcattgataattttaagaacagagctcatgttggttggcattttaagaattttaaggttatgtgagagttgccacaaaaatcgaatgctttggctgggcgcagtggctcacgcctgtaatcccggcactctgggaggccgaggcaggcagatcacgatgtcaggatatcgagaccatcctggctaacacggtgtaactctgtctctactaagaatacaaaaaattagacgggcgtggtggcaggcacctgtagtcccagctactcgggaggctgaagcaggagaatggcatgaacccgggaggcagagcttgcagtgagccaagatcgtgccactgcactccagcctgggcgacagagcgagactccgtatcaaaaaaaaaaaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaaatcgaatgctttttaactaaaataataaatttagagtgtctttttttgaaatgcttaaaaaaatcttttggccacaattatgctgttggttccactgtggcagagactttccctagggcctatccttattttgcgcatagtggatagtgcagtaagtaccaattgggagagtttaggtctaaagctttccttatgttcctttgcctaactttttgtggtggcgtaatcagttcattgtagaatgttaccgatttggggatgaagctgcttgggataatggtgtaaatcaataaatctaactgtaattggatgtgaactttgtttcactaccatgagcattctctttctaaagtgtggcagtgagtcaggggagcttcccagtctcttaatttagattggacatttttagaatgattcctgttgtacttctgatgaaatgaataagcctagattaaccataatttaaaaagaaaatttaaaaagctatttactccttactgtttttgtaaatagaatattgtggagtcatgatcatggctttaatataaatttactatgtagatggtctaataatgccttgtgtattaatttttagtagtcattgacagaaaaaatagagtgacattcttttctcattttaagatcacatttttcaatatctttatcctatacctaaaaaactacagtgttatatttgagttattgtgattaattgtatatagtgccctctattataataataagaaaaatagtttctcaaattggttcagtatacatttttggctaatttatattcatatttcttctattgcagctattgctttttctttatagttggatagatttttttaacatgtaaatatttaatacctttgattttacttttatttacctcaaagaactgagactggagtaaaaagacaagaggttacagatagaatacttttattagacagtcaaactaggttaggaggaactaatgattttttattgtgaattctttcatatctttccttcccctttacagaaattcctctcttatcttaaagaaatgtaacttttatagggtgactaaaacattttgtggtgcaactgcctgatgatcaaggtttttagctttgtatttgaatgccagtcaaagatgctgaaacaaacccagatcttaagaatgcagtcagtatttatattgtagctttttgaatacttattagaccaccctcatttcagggcctccaacagaaaagtgatgggcattttggcattcacatttatcttgtactttttcttcaagtagattgagacatatctcattctgtttcactccttcctactccacaaagggtactttataaagaatatgaaaattgctgtttcttaagtaaatatttctgagattaaatgtttttttaacaaatattttggtgagtctttaaaattctcacattcattaaaatctttatctaaaactgcacaaaattattacaaatgtgagacattatctggggccctgttgacattaaaagtgattagtgagacataattttgcaatctgtggaccttgattgtgtcctagatttaaaaaaaaactggggggatagtgagggatatttgactatggcctattggaggatataaaattattcttaatattcttagctataataatagtggtggtttaaagccaactgtccttattaggtgatgcttgctctgaagtatttaggagtgaagtgtctgcaatttcacattaaatggcttagaagaaaaaaggatacataaacttaggtatataaagagataaacatgcaagatattaataatcagtgaatttaggtgatggatgtttggatgatcattgtaaaattttaactattttgtatgcttaacatattccaaaatacaaaattgaggcaagaaatgagacatatacattcttatctaatttgaattcttctaaaaatgtctacttaagctttagtgaactcttgagaaagtatatgtgaattaaataaatcactggaaaaggtgattcttttataaagtctatgttgtgctatgtcaagatatatctttatttttaagttgccagagttttgagccagatttaatgccaaattaataatgacattaacctttatgggtgatatacttgcctggttctaattttctgttgactttattgaatgccatttattgcaaactatttcaaatcattttttaaaaatagataagatataaaaaaattcaatgattgaataaataaacttttcctggcattttgatttgatttgttggaacaggtagaagagtcattcagaaagtttgcagctattcaactttgataagagccattttagaatttaatcagtttgatttcataatcccatgaccctggaaaaccaatttggggtgtatggaggaaaaacattttaccaattaaatgtataataccacctttgttaagtcttccctgtgagtcttcattcttcctgtaagagaaatattaactttgttttactatcttatgaccatttatttagtaatcttttagaatattgaagtttatattttcctgaactattagctgttcccataagaatcaggtatattgttaatatgttgttacagtctgcatgtttgtcctaaaatttgtatttttacttatgaagagtgttttaatttagccaagtagaggccattttatatatagaaactatacatttcttggtgtcttaaggaatcagcacttttagtagtaattccatagatgaaggccttatataccatatagtaagtttgtgatagattcaaagatttcctataggtttgcattcaagaagaggtacaacttttcctcttggagtatctgattattactgtggataagaaagccctgtaattaacgggaacattaatatgccttatttttagttctgatctcaaaaatgattagcagccaacttcataatacagttctctcattttgtaatattttcttctttgctcaaccaaaagaaggtttaaatttatgattgatgaatttttctaactgaaggctaaaaaaaggctgattgatataaagtaggtagaatgtaagagttctttctgtgaatgtcttcattattttttttggaaatggaaaactaaatttgtaataacatattttaggattaagcaaaaaactaattaatctgagttttttgctttatagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaaggttagttgtgtcttatgtaactgattgaagttgatagtatattgcctgaaacccacctttttaaagagctgaaccaattaagtaagtgaaaaccaggtactgagaaaagtagccttttagatagacgtttatacaagaacaggtcagttcctattaaccttctgccacagctgcttttatgtttgtaagatggttaaaatacttttagacttttggtaccaggcttgttgaggtagtccctgacaactatttccagatgttttacatctaattgtagaatacttgattttttttgtttagaaatacaattagaaatgataaacgctgaataaaggaaaaatgggatacataaattaaaattacttttcaaaaaagcataatttggtgaaataagatgtagtattagacaaaattttgaaatttttaatgggtgaaatgctatgttatcctaagaaacaaactagttaaaattggcagaatttcttgagctaagaaaaagagagacaggtacaatgaagcagaaaacattgtggcttcattagtgatagaaatagacttgtaagaagccaaaaacagtgaaaaaacagttatctagtcattgacttgtttatttaatattttcacaagaaaagcagtttgttctgaaacttacacagactgtgatcttatatattacagtctcatgtacagtagagccggttgggcatatttatgcccatttacagtattgagctattgtttcctgagggtggggtctgttctgttatccttttgtccaacaaggcctccagcaattgcttaataattgctaaatgaaccgctagtgcagtgattctcaaacatttgtatactccagtggagtggttatatattgcacacctgggcagagatgttatacaagtaagtcttaaattctgaaaagattttccttgctttgttctatttgtttgaggattgctcttttgagttagagggtaaacataatgtcaagtactatgtacatttacaaatctccttataaatgtgaagtcttcaattctgtcttttctatcgttagcctttttagttaaaaatatgcaagtatttcccagttttactcctggggaacacttagtgtcctgcagcagactataggagtaggattttccatttggttaaggaactacttttttcatttgaacctttgaagcaggtataccaagtattaaaatatagtaaaatctcataatatgtgccctcgatgactattaggacattcagcaatttttttttttttttttttttttttttttttttactcatttgttgtaattctcttgctgctttgtgtagttattactctctttttctccattcttcacatatttttctcatgatttatacctggatttggtagttttccaaagtttaatgtcaatcttttttttttttttcactgtattacaagccagagggatcaaggtgagatagatgactcatgaaaaaggcccatttcaccatgtcctaagcccatgagatcaagaatatcctgaaatgtgggctttgaggttttgactctgattactttgaaatccaaggaaggaatggatgattgtgagaataggaatggcggaatgataggccttcatttgtgtgaaattacatatatatatacacacacacacatcgggccatttctctggtccatttgagtagtagctaagatttaaacagtctcagattctctgtgctctccaggtgataaaggggttaaggactacagacaagactaaagtggtagactgaggtcaggggattaatgaagcaaaacttgtaggacattgtggccttggtgctcagaagaggtcttcagcagaagtttttatgccaactcttaaatcttgatgacagtcacgaatcttggaggagactgcttctctgctgccattcttgcattggggcatattctctgggaagcacttgaaagtgattttttaaatgatattccatattatagaaaaaaattgacaaaggacctggaatggtacttgatgcatgggaagttctctctaaatgtaagtagctattattattttactgtttttcataataggaaccagagaatcatcaaggaaggactacaatataaagtgtcatccaacaggactggaaattcatagcatttccctcagattctaaaagtataatggatacataatgtaaccaaaaaaaccctctaagttataagacatatgtggtgacaattgtttatttctggggataaaacgtgttggccaggagagatagttcctctttgttactagtcaatggacttttagttttttttttttttatgaatttgcttcatattccaaaattagtctccattttaatcaagcatgcctgctgggcagctacaactccagactttcaaactggtctggttggatggcttataaaatctgtgacatttcttggcacttgttttaaatctgttccatggtgtgaatcctatagtagttctagaggtcttctatttgaggtactgagtatataaactgttgaatatctgaaagattgttctgatgtatcatctataatttcatttaaagttttgtaatggattctccatgtaataagcagagaccttcattttcttcataataggagaaatttattgcatttccattcttttataaaataatatgactagcttattacctattccatacttgacaaaaaataaaagtgaattaaattctgtaattgtttattaataaaatttttcatcttttatcacattgacttttatcactctaaagtgctctaataattaaaactaaatgaaattctgataattacaattctttaacttggtaaattaaaagaattggatatgttgggattattacaacagattggtttaaattatgtgtttgtttttaatgttattttatgaaattggctgcttgaaggaataaactaggattacaaagtagattaaaactaaaacaagataatgtttataaattgagaaacaataaattacatattgtatttcccctagatttttgtggtatctacttcattattcatgtacatcctagatttaaaaagtaactctattattaaggataattttccattcctttctggttcaactgtaagggaagatttctcccctcctctcttgaaaaaggctcattaataaaaataactcatataacacttaataaaagccagatggtgatttgagtgctttacatatgttagctaacttcgtcctgtgaagtaagcagtatcgtctgcatttttcagaggtagcacagagaggctacttacttgtccgtgattgcacagttagtaagtgatagaggctagcagtatggctccagtccgtgcttttaaccactgctgtatacttctgagggccaaagatgtgagctgatctaattgattatttttcaaaacagctttattgagatgtcatttgtgtatcataaagttcaccagtttatacaattcaatggattttaatgtatttacaaaatcatgcaaccattaccatagtctaatttaggaacaaattcatccccaaaagaaagcttttacttacttgtggttactctaccgtttaccttctgattgcttcccccagtcccagacagccactaattgaaatttctgtatctatggatttgtgtattttggacatttcacatgaatggaatcatataatatgtggcctttgtgactggcttatttcacttagcataatgttttcaaggttcatccatgttgtaatatatattgttaattcactccttttattgccaaataatctattgtactgatgagtattttttgaaaccccatctttacatttatcaaagacttctgtgaaaattagcagtttgtgtgtttcattgtgttcttgtttgtattttggagtgctagatacgtattggaaattgaaagagttaaaactgaggctcagagaaccagtgattttgaatcttgtttttcaaataggagtaaaaagagctgtgcctctgttaagtttttcagttaatttagcttataatttttttggagcctaaactatgaattgagtttttttcatataattgtattttcaacttgaataataagatggatgtgatgtacttcaaggcatttttgaactatatttgagaatattaaagtaatattgccaaaacaatgtaatggaggatgttacaaactgttaaatgtattcatactgttttgattcttaagtttcacaaactgggtaggagacatcaccaggtatttgggaagtatcataggtatgggagtgagagaatgtgcaagatctcttctctggttagtgtggacctcttaagctatctttatctttttggctgtttcttctctaaaacgtaaagatattttgtgttgttgtagagtgacagcatatactgcaaagaacaacttgtcatcagatagagttttcctttttattctcattgaaataaggtggtcacttagtttttctgagttcaggcttcctcatggataagtcgtctagttaacaagtggcaaagttgagaacctgaaaacccaagctaggtgtttttgttactatattacaatggcttataataacagatacaagtatagtatgtctctttattcatcaagtatttatggaataaatagataacaatgagttttggggcttgtggcattctgaccagctttaattgtagtcaaaagaagggtctgaaggtgacgttttatttggaatatgggattttatggtcttgaaaaatgatttaaaaaaacatatatttaaaaactatcattcttggacagtcctggtttactatatgtgagctatttacaatgttttctttttatgcatctttagtgtttttctgtggccttccagttcttttaagaagttttaaaaaagcactattttgtactttatcattttataaatattgtgggtattctggtatttaaagggatgaaaataccagtttttaacagctaacaaatgaattgaaagattttgtattactaaaactcagcagtcatttgtctccctctagcgatcacataactgtgccacattgcccatttacttagcatgttttgattgaaaaccagaaaaaagaagtttaataccttttaaattatgttgcacattttatggaatttggtttacatttatttaagattgtcctgattacaattttaatagaaaatcagtagttcctgcaaagattttgggaagcctttaatatcttgcttcattgagcctgagaagctatggttatacatcattactgccaggaaaaaaataatccaagtaaactaagacataccgttgattgtaagatgcatctccatttcagaaaggataaattgtgggaaaaaatcagcatatagttttagtacagtaatgtaatgtctttgtggatattagtcattgaaatggttttctcatttatagaagaaatttttcttatcagaatataccaggacacataatggtatggttagatgaaactcattgataatacaattgaaggatcatatgtattaaaagtttaaagtttagaattttgagttgcgggaacttaagtcaaatggagttctttctgataaatggaattttgtggtggtagctttgtaatatgtcaccttgctaggctgaacttattttccagagttctcttctctgtaatttgtttaggatgagacacaagagagattcttgcatgagatttgaaggcagaagtgaagcagcagccatttttgtagcttatacaagttgtggcttctctcctggctcaccttgttggtatgaggtagtagtagccaggctgcaattgccctaccttctgtggaatcctctttcagtttctccatctcttgggttaggtctgtcaggaaggaccccagcatgctcaagacatcttgagactatcagggtcagaataaaaaccaacatggacttcagttttcagtccgttctggtgggcttcatctggtgattgtggatcctattttgttcttgcttttcccactttatgatgtctttcttgattgcctgccttacacaagctagttccagcttctacagttacacaagatcaaatctcttagtgtctctctcagtctgtctgttcgtctgtctgtctttctctctctccccagctgtttgcttatctggtcaagcactgactgataaatttaccatggtacataattcttagggagattttatgcaacttcaaatttgaaattctagtaatgtaaattaacatttaggaaattgaattaaccattttcccttcaaaatggtagtggtaccttttggagtacttaagtattcttcagtgtattgtaagtaattttaaggattcttataaagaaccaacctggtaaaatgcatagataaaggtttctgtctggtataattttccttctacctgaaaggactttctttaacatttttgtagtgcaggtcttctgttgatgaatttgttcaacttttgtatgttaggaaaagtcttattttacctttagttttaaaagagatttttgttgtgtatagaattctagatagatagtttttgtatttgagtattttagaaatgtggttcttctcacgtttattgtttttgatgagaaattcagtgtcattggtatttttcttcctttatatttaatgtgtttttttcctcttactatttttaagatttactctttatcattgaatttaagtggttgattatgttgtgtcctctttattttctttattttttatgcttggggttcagtgacctttttgtatctgtatacttatggttttcattaaattttgaaaattttaggccattatttcttcagctgttttttctgtctttcctcttcttcagggactcgagtacacatatgttttgttgcttaaagttgtttcagagttcacttgtgcttttttttttcacttgtgctttttttttaagtcccttttctctctgtttcattttaaatagttaaattttatttgtctccaagttcactaatcttttctttgcaatatttaatctgccattagtcccatccagtatatatatattttttatctcagacattgttgttttcattcctagaagtttgatttgagtctttttcatgtctttcatgtttctatgtgtttactgtgttcaattttcttctagcttcttgaacatatggaatacacatgtttaaatgtccgttcattaacttgatcatctggctcatttctgtatcagttttgattgattggcttttctactcattatgggttatatttttctgcctctctgcatgcctagtaatttttgattggatgtcatatattgtgaattataccttgctgggtgttgggatattttttatattcctaaaaatattcttgagctttgttctgggatgtggtttaattacttggcaacagtttgatttttttgagccttgttttcaagctttgtttagtggtaccagagcagcatttagactggggttactctctccccactactgaggaaagacccttctttcaattagagaatactgtaattgttctcccatgaattatgagtttttccactctggctggtaggaataaccactattcctggccctttttgagttccaggcactgttccctgtagtcctttttgggtgattctttctccagcctgggttaatttcctcacacgcatatgctgatcactaatcagctcaagacttgagggggactccttgcagatctctcgagttctttttctacatgattcttctctggtactctctcctgaaactattctccttagctttcctagactctcagtttctctccataactcagggagaccactggattctgcctgagtttgcctctttgccctgtggccttaaaagtctctctagacagtaataagctggagcagttatagaggtgacctctgttgtttcttttctttcagggatcactgaccttttatcctgatgtccagtggcttgagagctgttcttcattcagttttttagttttcaggtggtagagttcatttggttcttgttactttatcttggcacgattttagttgcatctaattgtgtgttttagagtcgctatcaggagaaatgtttatttagaggagccaagatattctttctcaagtgatttgaattatctggtattctaggtacccaggtttaaaagcctgtatggtttttctgcacgtatttggcattctgttcttagttttctattccatggtactcaaagtagctggttcagaaactttgttactggtctgtgttggaatgaaaaatgtacactgcaatgtatgtaaatgcattactttcttcactgagaaagtattgctatgaaaagctgttaggtgaacccaacagtgtggttagtgatgtagttgatttatattttgtacaagtgtcttgtcttgatatagcctggtaactgtcggtggtctagtactgttcgcctagtcacactcttgagtagctgcttgtactttatattacgtagtttaacaaacgtggacttttatttaatatgctttttattgtactcaagaatatagataggttctgtaagattgtatccaggattattcagttgcagatataaaagaaagcaagcatccaaaagccaacctatattaacttcagttaccttgatttttaaaaaacttatacaattggccaggtgcggtggctcacgcctgtaatcccagcactttgggaggctgaggtgggtggatcacaaggtcaagagatcgagaccatcctggccaacatggtgaaacctcgtctctactaaaaatacaaaaattagctgagtgtggtggcacgcacctgtagtcctgctactcgggaggctgaggtaggagaattgcttgaacctgcgaggtggaggttgcagtgagccaagatcatgccactgcacttcagcctggcaacagagtgagactccgtttaaaaaaaaaaaaaagtatacaatttggatggttttttgtatatttatagagtcatgccaccatcaccaaaatttaattttaggatgttttttatcatcctgcaaagaaaccttgagtccattaacagtcactccttacatacccctgtctccagccctaggtaaccttgagtctactttctctgtctctatatttgccttttttttaatatttgtttaatgattttgaggttcatccatagatcagtactttgtttctttttattgcttaataatattctatatcttgatgtaaaattttctttttaaaatatagagacaaggcctcactatgtttcccagctggcctcagactcctggactccagccatcctctcaccccagcctctcaagtaactgggactacaggtgtgcaccactgtgcttggctcatatctagatttttgatttttgaggcaaatatcttgaggcactttctgacaagtgctttgctgttttgagatcctctaccatatgtatttgttgcccttcaaattggctgtttttggattaagtgtactcagtatcatagcagtgtttgaactagctttgtaatttccctatttttggcttttagttgctacattttctcttcaagattcagatatttaaagtaatttacaatagtagttgaatttgggtatgatcagtgatgcatatcttatactttattacatagccaatttaattttttgtcttaatggcagtgtatcagatgagttacttgatttgaatactagtcagggataaataatgaattagagtgaagacaaagaaacccaacagtgtaaagtttttgttgttcttaatgtaacagtctatgtcataagtcattgaagtctggggaggggatcgcagatttgctttgcatgattattcgggggccttgttaccttttatatcattccactgcccacccttagattcctagagaatttatgtcttcgtgatagaaacttggtcactgacatatcctggtttcagctggatgaaaggggaaagagatcttagacaaggcatgatcaatagtgtaagttatagaggtggaagtaatatatatcatttcatttatatttaactgatgataatttagatgactataatgcattgcaagagaagctgggaatacagtgtagttgggcagtgatatgtagttactatggttgaaaggaggtcataatttggcagacaaccagcagtctctgccacaacacacaacaccaatatagtagtctttgaatttagcagtttgtgaatgagatctggaagttatctttggagagtatcttataacttaatctatttattagtaccactgttaagaaaggtcatatcaagagtagataaaaatcaaattaccaaaatttcagtacctcaattattaaaattttcagttattattttagaaaacttttgtttaaagatattggaaagttgaaatcattctcagttcttccatttactagctgtgtaacctttgataaactacttaacttctctgtggctcacttttctcatgtgaacgagccttatagtcgttcctaattcttaggccatgtgctcatcaaatgagaatgtattatacataaagcacataacatttcctacacagtagctctcaagatagctgttattgttatcatagcattaggtacctggttttggacagaggcagtttaaggcatttagtatctaatacatggaattgccaaaaaccagttttgaatttatgatctcattgaatttgtttttgtttgtttttgccaattgtcatcaagaaaagatacaaaaggcttaattttaatacatggggtgatgattataacttatgtatacatagcaatatatttctttcaagccaattactttaattttgtacctgctttacaaagtaatagttttaagaaactcataatatattatttctacaatatatttatatacttttaaacccataatttttgtattgataagtacagaactgtacaatgaagcattttcatagtttatttcataagactacatcattgagtagttcccattcaatttaattaaaaggtaattttaagtaaagttatactaccctaaatttttttacttattccctaactctttaaaaatgtatatgaaacctaatgttaaaaaaaaatcactagtttgtggaataaattcatattcaggaaataatttagacactaatatatttgtagcctgtctctcttccccctcctctccactccaaccacaaaaatagtgcttggatctgttattttctgtaaaagttgaatttaagtacatttgttcatagcagatttttcagtgaattgaaggtagccctcacattttttactatagtcatgcaccacttgacaatggggatacgttcttagaaatgtgttgttagatgatttcctctttgtgcaaacatcatagagtgtacttacacaaacctagatagtatatcctactgcgcacctaggctatatggtataacctgttgctcctaggctacaaacctgtacagcatgttagtgtactgaatactgtaggcagttgtaacacatggtaaatatttgtgtatctaaacatatctagatatcttagaaaaggaaaggtacagtaaaaatattgtataaaatgtaaaatttgttatacctgtatagggcatttaccacaaatggagcttgcaggactgacagtgctctaggttattcagggagtgagtagtgagtgaatgtgaaggcccagggcattgctgtacactactgtagattttataaatattgtatacttagactacactaaattaattaattaattaatttttttttttgagacggagtcttactctgttgcccaggctggagtacagtgcagtggcgtgatctcggctcactgcaacctccagctcctgggttcaggtgattcttgtgcctcagcctccggagtaactgggattacaggtgcacgccaccacacctggctgatttttatgtttttagtagagacagggtttcaccatgttggccaggctctcgtacacctgacctcaggtgatctgcccgcctcggcctcccaaaatgctgtgattacagacatgagccaccgcacctggccagactatactaaatgtataaaatatttttttctccaaaaataaattaaccttagctcactgtaacattttcactctctttttaaaaactttttgattcttttgaaataacatttagctcaaaacacaaacatgtacagctgtgcaaaaatattctttctttgtatccaaattccataagatttttccattttaaaaactttttgttttcttttcttgttttattttattttatttttttgagatggagtctttctctgtcgcccaggctggagtgcagtggcataatctaggctcattgcaacctccacgtcgtgtgttcaagcaattctcctgcttgagtagcctctcaagtagctgggactacaggcacacaccaccacgcccagctaattttttttttctttggtatttttagtagagatgggatttcaccatgttggccaggcaggtcttgaactactgacctcaggtgacccacccacctaggccccccaaagtgctgggattacagatgtgagctgccacaccggccaaatattatatttttgtctggtggatttgtagaaaccagagaagatgtctttatagtctgtgtagctgtcatcataacttggtattatagttgatttcaaaattaggtgtttgagaaaagccagattaagtaaaatgagtgatatttgatttaaaatctgactagcaattttcataaataattgttttgtcaataatttgttatttaaagtgttcaggtgctagtttactaaattttactctgtgtatgtgtgaatctagaataccataccttttttctagataattgttagtgatactgtatctggtttcttcatatgcttttgtttataatcagaattttattttttaacatgagaataaatgtgctctgttattttaaatacttttaaaatgtgtttagccacctagatgaatgattcataatctttttatcgggttattcataagtgagagttatgacttgtgggaattggtaatagtggctcatggaaacagtgatttttttagtttaggagtgggaggaaagtccctgcatgaatctgaagtactcaaatctctttatctccctttgccccaatttttatgattgttttcatatcggcatacaatgtagcaggcttaattatctgatggaggttttctttgttttaatattagaattatgatgtccttttggcatgatttacaaatgactaaaagtgttttagaaaaattgtcttttagattttatcttttaaagttaatttttgaaagcatgattcctagttgtttgaaatggcaaagctcttagctttttcatgctaagaacgacggagccacattgaagatgcttatgcttaactcagacgtgaaaactacaggcctgaagaataatccttactttatcgttttcatgtgttttgaaaggaggcttggatgctgggaagctatcaggtgcctttatgggcaccagagaaagtctaagacgcttgttgtagtcagagttaatttataattcactgtaaagttaactgactcaaagcaattagttcatgatttacattcagttgctagtgatttttttctcttttcctatgcattttgtagaatgctgtatacccgttatagggcttcattacttacaggattggaaagtaattttgtcctagggagaaatacttgggttaaatctgtagtgtatttgcagtgccaagagagcactggtggtaaaactaaaaataaaaaaaatgtgaacattatttagaaacctctctggccatctttataaatcaacaagacaaatcctgaaaatgtgcccaatttcacagcaatcattatgattgcagaggaaataaatattatttgtttttttctctggtattatggcattggaaccaaaaaagcattttgtacaacagtttttggttagtgttacaaattcagtcagacaaacatttgctttgaccaaaaataagtcaatagggtgtatctgacttttagaaaataatgtagcaatgttcatattctagcaagatatttaaaatgatattctatcaagaaaatacttgggtgagttcttttatgtgaattaaagtgaattataaatactatataatctttcatacttttaacttggcagaacggtgatttttttagtttttgttgctgggtaggtaagtattactgttttggggagaaattttaaaattgttctttaataaaaataattttatcttaatttaccaattcttttataatatagttttctataacaaagcacttccctatatacactgttatatttgagtcttatgaattgtccatttaaagtagaatattccaagtagaaattcaattcaacattcaatttgttgcacttactacctcttttatatttgtcttagtgtctttgaatatttgtttaggcctctgagtcacactggcaagaagattaggaacatggctttaggcatatgttagtgctttgatggcagttagtgacctgtgctagaaaaagtgggtgttaaccttgatggtgtcgtgtaagacttgatatgtcgtgactaatttttaaaatttttttctcatttttcttgcctgccccctggtggagaaaagttagtaaaatcaacatacagggtacatgaaaagtctgaaggtggggggaaaatgtatataaataaacgaatcattgctcatgcctgtagtcccagcacttttggaggccgaggcaggaggattgtttgagcccaggagtttcagcctgggtgacatggcaaaaccctgtctctattaaaaaaaaaattagccaggcgtggtggtgggtgcctgtagtcccaactacctgggaggctgaggtgggaggatcacctgagctgtgattgtgccaccatactgcagcctgagtgacaaagtgagaccccaaacaaaaaacaaattatcgattaatttagtatatgaaaatttaaatatatgttatcatttcaggttttatagtcttagcttctcaaatttggagggaacaaatgtgggattaaaattctaagaatacatagttttcttaaagatatgcaaatttgctttactgattatgtttctgtgttttctcaaaataccttgttgtcacttctcagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacaggtatttctcatgcttttaaaaaataaattcaataaaaattttaaaactttaaaacattataatgttactttatcatacctatcttagtttaaaggacaaactcaagaaggcacaacatgaaagagaacaacttgaatgtcagttgaagacagagaaggatgaaaaggaactttataaggtaatttattttttaccatatctattgcctgttgcttcaaaagaaatgaccccagaacttaggggctgtaggtcagcaatttaggagcagcttagctgagtggttctggctctagcctcttgtgtagttgcagtcaggatgttggcaaggggtgcagtcagctaagggcttgattgggactggagggtttgctttcaagatggcttactccagtggcttttggcaggagaaccttcagctcctcttgaagtggtcttttcataggctgcttgaatatcctcacagcatggcagctagcttctctcagagtgagtgatccaggagagagcaaggaggaagtcacagtcatgttgtatatcacccctaaaagttagttttcagggaattaatttgctgctgttttagatacttaacaggtagtgtgtaataagttgaagaggtttaatggaattaagatacttgtttatcacaattcatgtaactatttttcctttttaagaacatatatatatatacacattggggagaacattaatttagtaataatcccattttagagtttgacttttagaatatcttcagagatgtcattttgtaaaaatatcctcactgctaacaaatcttgaccgcttgaagttttgaatttttttttttttttttgagatggagtctcgctctgtcgcccaggctgaagtgcagtggtgcgatctcggcccactgcaagctctgcctctcgggttcacgccattctcctgcctcagcctcccgaggacctgggactacaggtgcccgcgaccacgtccggctaattttttgtatttttttagtagagacgaggtttcaccatgttagccaggatggtctcgatctcctgacccgcctcagcctcccaaagtgctgggattacaggcgtgagccgccgtgcctggcagtttttatttatttatttttttaagcaaccctgaaatatagggtagttagcttaattgtcagtaatgctgtgggtgcaaattgagacttatttttttaagtggctcataagcatttcctgaaggcaattccagatgaggaatttcaagaacattctgagttaagtccgtttcttgttaagtcaatttaatgagctgatgattatgaacatcaggtagcgttttaaagtgatgctgcaagggtgttggttgctgatgtcttcagagaatcaggagttaatattctatccttgtgaacaggaattagtccttcagcattctgtatatttaaagagtaaagtgcaagaagtaagttaattcatttctcctcagtactcttaacgaaagcaggatatacttgatagtgtacactacaggtctgtatttataattccagttattgaatttgatttgtatgtgtgttaggagcaaatcagcaatagcgagagtcatgggaaaatcaatatagttgggttagtcaacaaatacatttttcagcacattgaaactaaatgatatcgtacttttcgcctgcagaaaatggaattgtttgagatgttgtttttgaatgcaccccttctagttttccagagtcttgtcgtgccagatttgaatatgccaaataacataatttgtttccccaaaagaacaaccaaatctatttgcatttttaaagagaacctgaaaccattaaatcaaaggaaaagactttagagatcaggtgatgttgttagggcttagaataatctctctggaaaataaaaaagcttagaaaagctgtgttctgctcctgcatgcttaactagtcatttggcagaacctgggtctcctaaatcctagtctagtatgtctttccttcctttcgttgtctttgggttagaaatataatggtattttaaactttgactaacttaggtcatggagttagaatattcttgacattttcaaacaccattacaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagtaagtacttttgctatatatatttgaagattgtaaaacatacctatgaaatgtatgcaatatgattttcatttttaattcccccaagcttttgttctaaaaaagttcaaacttacaaaacagttggaagaacagaacaatgaatactgatgtaccctaaaatattttgccattctttgttttatctccctcatttatatgcctttttttctgagcgatgtgagttgcaagtattacgataatttactctaaatactttagcatgtctcccttatgaacaagtgcattcttcttcatagccatgacaccgttattacacctaagaatttagcactgattgaataacagtcattctcatagttagttcacaatcacattgccccaaatgtattcttatataatctttaaaattttgtgattcacagttagtcaaagactacatattattttgattgttgtattttgagtcggtttcagtctagaatagtgtccctacactttttatgacattgatatttttggagaagacaggctagtctgagaaaatgttctataatctggatttgtctgttgtttctcatgactagattcaggtgagacatttttgcaagaaaagacatagatgatgttttgtccatcctgttggagtcatatcaaaagttatataatgtcaatttgttccgttcttgataatgttaggtttaataatttgtttaaagttatgcctacctgtctctatataggtgcctttcttttctttccctgtttgtgattattaagcaatctgtataaacaccctgttctccaacagcctttcctcaatgtttttattgtcctttgatgctcctcacctgcatcagctattatgttggtaataattaatgatagaaaaatggtgatttaaaaaattctattatgccttctacatttatttgtaggtaatcttttatcatgaggacattcctgtcacccttccctcttttttaaatataactttggacttactgattttttgctgcatattatgcataatcatcattattctttttcatacccaaattgttctgaatttaaccaggggaaccttttcaagcctgcttttttgtcctgatatgttcctataatgctttgaatactttcttgctttatggcacaactgtatgttctaacttcaggttgttcccccagacctgatattaccatttctccaagaaactctgttttttttagtaggtaatggtattttgaaaccaagaactggatcctattgctactatggggctgctgctttgcacattcagtgggtattttgcatctttaatttatattgatagctccaattcagatttagtaccttaggattcttccttcctttgctccattccatatttatatctctcttcttgcaatgtgagaactcttgtttcccaaacatcattattactcatgtgtttccatccagccgtacacaccagtgttttcacaattattacatcaatgccacttccaacaataaatgtactaaataaagctaaggtatttttacagctcttttttcttagaatatgtttcactaaggatgtatagaaacgccatgttcaaaagttacttgaactatttttttgcatacctatgttataaatttgtaatataatttcatttgcttgtatttaattttaatatttgcttttattcttctgtttgatttatttttattgtttgaatatgtaaaacagttgctttgttcagaagtcaaaatgatagaaaaattttactctgaggtctcaatctcttccttgtttttttaaacccttttcttacctatgcccatagataaacattttcataagtttctagtttattcttatgtttctttttgtaaaaataagcttatatatgcatgtgtacatgtacatacatccttctttatcctcttcgttcttaaaaaaggtagcgctactatacataccattttgcacctttttctcactgaacaaaataagttgctagttactccatatcagtttgtagagatcttcctcatttgaaaaaaatggccacataatattccattatatagatttaccttgattgattcattatttcttatgatgttatttttagtaatttgctattaaaaatactcagacatagttaatgtaatacctaaaacgtcagaagcgcatgacatttagaattaatggttaatccttgttactttttaatgtaacagattgccagtgcaaacatgagaagtgtatttgattatttgttatttaataagatgctaaaaatttctctaagcatctttttcctatttaagcaagacttctgtgaggaaaagcgtagttatggaagtacctgagaaaaatgactactagttgctaaagcttttaaaagattgtgaaagtagtttgaggtgatggttataaaaaaatttaaacagtacatgaggatacaaagtaaaatgtaatcctcatcccttctcagataagtaagttattattgaatttatgaatatacgtatatttatattttaacacaaattagaatttatacattttttccttttaaaaaaatttataaatggatatcttgcactatgatacacatgtggatctttttcattcatcataacaactgcctagtatttcttctcttcatttaacaactgtgtagtatatgttttttgattgtttttgattgtttatagtcttcagcttttataagcatcctgcagtaaacatccttatagcaatatgtaggcacatttataatccgtagaataagttctttcaagtggaattactgggtcaatgagtatttaaattttgatagttattttcaaattacctttcaaaaaaatgttctattgatttttttattcccaccaagagtatatgagatatgtattgtttgtaatgtctgcacagactttgattatatagaggtagtatatcatagtttatcataaattctcatgttggtagacattttaggttcttaatgatttttcattattttagtattttattgaatccttgtaaagctaaacctatgtctataccctttgataattttcttggaaacttatggaaataaaattgctagatcaaaagctgtgagaatttttaaggtgctgatgaatgttgtaaacatctgatgagaaaagatgccagttacagtttatataagcccacctgtttgtgaatgtgccagttgccctaaacccatgcaaatattggaatgttactgtttttttgatctttgttagtttgaaaggtgaatggcatttgttttaacttatttgtttgattgttggtgagttgaatttttttactgcataatcgcatttatttctttagaaaattttgtatgttcatgacttttgacttttgttttgtttctccttattgactagaaaagttatttatatcaagtattattatacctttcttgaatatattacatataattttcttctagttctttttcttctcctttgacatatagaagttggcgatctttttataggtagatctattagtgtgatgcctccgaagattttgtccatgccaacactgcataaaatcatcatttacatttccttctaaggggctaacagtttagaaaccaatattgggttgcatttttttcctgattttacattatttttagtacagagattaaaaacaggaagttgaataaactaaatttattgtgtttataatgtttaaatgttataatgtttaaacattaatattaaaggaaataatttcaccatggcaattttagctttttaaagatacttttaggtttgtcaagcagtatgaattacttttcattttcccaatgcctcgtctttactatttgtatatcaatattttgtttttagaactaaggcctaaatctgttctgtgtttttataatgatatgaaatagatttatattatattggatgtctcttggggtagaaagtaggaaacatcttttaaccaaaatttttggtgttacaaagaagctttcggaatgatttttactggtagtcatacaaaatgagggtcagtatttctagctgaagagattctgggggatgggatcttttgtttgagcctcagtttgggcaggtccttaagcactgggtatgttgcctgactcgctgtactttagcttccttgtgtataaagtagtagcagtgaaaccaagtacatagggttgttatagagggaacctaaaacaaagttacttcttaagttttttgtaggcatatactctgtaagtcatgagtagaaaaaccaatatctaaaattttggccctgttgaaatatgtgcgaaaattgtttctgcttctgttttttacttgagtggttgaattacaaatatatttatctgctttcttcaggaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggtaaaacaagttaattttgaatttgcattttgatttaagaaaccactataatctcacaaagtagtaaattgtgttaagataagacaggtcagatttctgccttattttaaatttaaaattttcattccttttgtttagtcattgtgacttcttggcttacagttaatgtgtgctgtaaggaaaacttctgtaagcagaattcttaatggttggtgaaagctgccctattgattaaatatattgatgtcagatatgtattgttttgtttggaatttcttactagctgtataaaacagtattatggttgtttaagggagtaataattgctcttcaggaggtggattatttttctctagttttttaaatgaaccttagtcctaagaatgtaaaactggacttaacaagagaccctatgttgctctgtagccaaaatcccaaaataaaaaagtggccggggacagttgctcacacctataacctcagcactttggggggctgaggtgggaagatcgcttgatcccaggaattcaagaccagcccgggcaacatagtgagacctcatctctacaaaaattttcaaaaattacccaggtgtggtggtgtgcagctgtagtcccagctagtccaaaggctgagacaagaggattgcttgagccaggaggtcaaggctgcagtgagccataattgggccactgtgtttcagcctgggtgacagagcaagactctgtctcaaaaacaaaaaaaagaaaaaaagtaagattgaagttggggttactattaacattaggaggtatcagatttttatttttttcttcaaatgtttgtttctttctaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagtaagtatcattaaatttacacatagtaaaatgtgttgttagtatttttgttcgaaaatcaaatttgtaatattccaaatatcaaccttttaaatattatttatctctgcttgatttcaagtcattggccaaatattgtaataactcttctttaaaaaagtctggaattttaatttactggacagccaacaaaggaagcaagggcagtagcaaggaaaaaacagaaaaaagtcttcttttctagataatttccctcttaagttcttgataaatatctgtcactcaaaactcaatacttattattgactcttgtgaccatgacatctatcctcattggagttcaccattaatcatccctaggtcttagatggtgtctcagttgtaattggcaagttcttcatactcatattatgaagattcctattcctattagattaggaacagttaaagagtgttagctaattcttttttattccatttgagaataggtaggtagatttgtaatataccaaagaagatgtttttgttttgaggtatgtatgtttcaatgtgggtccttaaactgtgcttaaatacaaggcttactatctgaggaactcctggaaatgtagaagaaacatatttaaaacctgaaattgaaagtggtactatagctctcttttactatgtgatgcatatgatactttcctggtcctacttttttaaatcagaggagacaagcaaggaatgcatgtagtaaagtaggaaggcttttgtgaaaaaatatgatactttaagtatgactcactcacatgtatgaatttggcctggggccttttgagtacgttataactttgtagtagatttctgtgaatgacttattttggtggtcttttgatgagtttataagaaaaagcaaaatatagtatatttcttttgcaacatttaggtcagttagcaaaatgatgtgtataactttagtctttgttggcttttaaaacaagagcagctttgtggacttcttaggatttcctaaagtaatatgtaaaaatattatttacttagttactgcaaggaggaaatataactaattcattgactcatttaacaacttattaacattttgaataggctaataataataatgtcttcacaaagaaaacggggaatcagcagaaagtgaatgatgcttcagtaaacacagacccagccacttctgcctctactgtagatgtaaagccatcaccttctgcaggtaaaaatcttttagactttttgtgtagggtgtcctacattgaaaagtacttatactgccttcttccatgtgttagaatttcaggatgttcataaaaattttcatgtgataagtgaaggaattgaggcaacaagaaaataagggtataaatgtaaaatagagtcatgcaagtggtgaatatacacaacatgaacatataaaatgtgaatgtaaactagtagttatcttcttgagactattcacacatgttaaaaatgagctggtgcttgtgagtactcatttgggctacataggacaaaagccacgaattgaatttttactttatgttccattaaatctatggaattttgaagcattttatttgtggattttaatttttaaattctgcaggggaaaaaatcccctattattctcatatttttctatttattcatttatttttggctgctttggatcaatgggggtacttcttcccttgtcaatgtacctgttggctgatgagttaagtttttattagtttattaacttatagaacagaatagagagacatagtgagaacattaataacatgaaaacttggattaactaggttttcatctgtcctgattttttcacttttatgtaaatttgacagtaatgacgttaaatactagagaaagtatattttcttgtttagtgtgtgtagtaattgatcttttaagtctttttaaatgtaaacatcttagactattaaatattaggtttatcccctgtaggacagaattgagccttctgtttccatgtatcctctgtagtacctaaaatggtgttatagggtatttacttaataaagacttagtggtaatgaagggctagaagaatgatttaaaatgtgttcttggtggggtatggtggcatgcgcttgtactcctagctactctggaagctgtggcaagaggatcacttgagctcaagagtttgaggctagcctgggcaacatagtgagaccctggctttcagagaggggaaagagaattctcagagtatggttttcctacttaccctgtctattcagttatataaggagaacaatttttgtgctgttatggaactctttttagcaaattttgttttgttttgtttttgagacagagtctcactctgtcccccaggctggagtgcagtggcgtgatctcagctccctgcagcctctgccttctgggttcaagcaattctcctgcctcagcctcctgagtagctgggactacaggtgtgtgtcaccacgcctggctaattttttgtatttttagtagagacaggatttcaccgtgttagccaggatggtctcgatctcctgcctcggcctcgacccgccttggcctcccaaagtgctgggattacaggcatgagccaccgtgcccggccgctttttagcaaatttttaaaaaatcaaagaataatcctttattattgaatgcgaacttggttctggccaaacacacatttaacaattctcaactagagtttatatatccttctttgtatatctaggatatgaatagatatttctgtccttcagcattccatttactatattttacagtatactgacctttaagttattctgaacaggaagataatataaggggcaaaatactttttaacagtcttatattctgcctttctacagcagaggcagattttgacatagtaacaaaggggcaagtctgtgaaatgaccaaagaaattgctgacaaaacagaaaagtataataaatgtaaacaactcttgcaggtaagttaactaccttgtaagtgaaagagatttataaaatgttaatgacttagcttacctttattgtttcaattgattggtatctttgagtttcttttccatctccatatagtgttacttagtttcactttggcttttgggatgatgaggtgggcgttttgtgtacctgttcacataggcgtgtgtgtagcatcatgagacctaaagttactattttcttttcacctaataaaatgttcttgtttgggtaatgggcaaatagttaattgaggttagaaattatctgtcatcgtataaagatgcatgaaaaatatttgaacttcataaaagggaagtgctgtttttaaatttactattatcggccaggtgcggtggctcacgcctgtaatcccagcaccttgggaggtcgacgtgggtggatcgcttgaggccaggagttcgagaccagtctggccaacatggtgaaaccctgtctgtactaaaaatacaaaaattagccaggctgtggtggagcatgcctgtagtcccagctacagtctcctgaggcaggagaatcacttgaacccgggaggcggaggttgcagtgagccgagtttgcacactgtactccagcctaggcaacagagcgagtctctaaaaaaaaataataaataaaataaattactattataatagcaaagatttttacatcttaaagtgactagacttgcatagtggaaaagggaatgttaaccaaatgaattgtctcttacggtgtttattttgattattattattttattttatttttttttttgatacggagtctcactctctcgctcaggctggattgcagtggcgtgatctcagctcactgcaatctccgcctcctgggttcatgccattctcctgcctcagcctcccaagtagctgagactacaggcgcctgccaccacacccagctaattttttgtatttttagtagaggcggggtttcacgatgttagctaggatggtctctatctcctgacctcgtgatccactcgcctcggcctgtcaaagtgctgggattacaggcatgagccaccgcgcccggcctattttgattattttaaacagcttcattcagacttttctggtttgcagccttcttggtgtagtattcagtactggaatatttaaaggaaaagggaaaatgcttctcatttatatcaatttggcatagagaggaaaaagtgttgtttgtgcaagtgatttttgtttgtttttttaaatgtgctttgtgtgtttttgtgtgcattggggaggggaggggcattttttagagctatagaataaaatttacacattagcttcatgttactgtaatttaatttacagtaattatttaaaatattttgttgcttataaatagcaaaatcttttaaccaaagttaaaatgaatttttttttttgcttgagagaatcctgtggaagggttgattagaacagttttactcttgaattcagggtagttttttgtaagagtgaactacattttcgttaaagatgaaacaattctggatgaatatttcaagatttttctatagaaatagtattgaaaggaagatagaataatgttcaagcaaaaaccttcctcagggtgcttttttttttttttaaacaaccatattgaggtataattgaaatccaatgaattgcacgtacctagagtatacagttggatcagttttgacatacacagttgtgaaactatcaccacagtgccatcactctcccagtttttttggtacctgtttgcaacacatccctttcgttatccttatctctaggaaattattggcctgctttctgtcactatcaattagcctaccttttagacaattttataaaatggagtcatgtaatatgtacttttttctacccactttcagcatgattatttgagatttattcatattattgcatatatttattccttttttattttatcatttgtttatccattcaccacttgatgggtagttggggttgtttttcggctggtacaaataaagctgcttatgaacatttgtttagaagttgtttatggacatatgtttttttttgtttcttttgggtaaatatctaggggtgaattgcctgggtgatattgtagttgaataactctgtaagaaattacctcctgggtgcagtggctcatgtctgtaatcccagcactttgggaggccgaggtgggagcatcacttgaggtcaggagtttgtgaccagcctggctaatatggtgaaaccctttctctactaaaaatacaaaaattagctgggcatggtggtacactcctgtaatcccagctacatgggaggctggggcaggagaatcgcttgaacccgggaggtggaggtcgcagtgagccaagactgcaccactgcactccagcctgggtgacagagtgagactctgtctcaaaaaaaaaaaaaaaaaagaaattaccaaactgttttgtaaggtgtttgtaccatcttacatagccagcctaatgggtgtgtactgatagctcattgtggttttaatgtgcatttgtataatgacttgatgttgagcatcttttcttatgcttatttgctctttatctctttgtgtgagtggtcgaatctttttggtagtttaaatatagggttgttcatcttgagttgtgttttttttttttctgtatatgtcttttgtctgatatatgtaaggtgaatattttctccaagtctgtagcttgccttttcatttccttaatgatgtttttagaaaagcaaaatttaaattttgataaagtacagtttatcagttcatttatgttttatgctttttaccttctaaggaatgtttgcctaatccaaggagataaagattttctcctgtgttgtcttctagaagttttataatcagcttttctatttaggtctgtgaatcattttgagttaatttttgtgtataatatggaatgtatggtatggatattaaactgacctagcgttatttgtttaaaagattttcctctccattgaattgctcaaagtatatttttaagcgttcacattgaacaaaatgttccaaatggaattggcctaattacctttttgtcatgatttgtaagtcctcctttaagataatctgggttgtagagaagagcaatgtataagaagtcaacctaaaaattatcttggtcagcaaatcctagagtttatcactgcatggaaacaacagcattataaatatgactttatttcctccctttgcaaaagtaatatatacttattgtgaaatgttgtagtgttccagaaatgaagagtagagatggcaaaaattacctctatcattctgatcccctgagataagaactattaatattttggtttatatttttgtatacaacacaaacatatagatattgtattataactgtgtaaaacaacttataaacaaaaatggattatatattctattttagcaacttgctattttcaattaatgtatcttaacattttttcttgtcaatttgtacatctgccttatttaaaaatatatatactatttcattgtgtggatagaaaatgatttatccaattgtctattaatagacatttgattattccaatttttatgctgttacaacagtgttataataaatgttcagcccatatctaagtacattagtatagattttcactctacatgaatttaaaatcttttggtaattatactaatttcatttaggatgagaaagcaaaatgcaataaatatgctgatgaacttgcaaaaatggagctgaaatggaaagaacaagtgaaaattgctgaaaatgtaaaacttgaactagctgaagtacaggacaattataaagtaagtttggtactccttgtatgtaaacttaaggcataaacttctgaaaattagttatgtataattttattcaatctaatgtacattttaaatatggataattgatagttttttctacaaataaaaatgtactatatatttagttacataaatactgttcattaactttgaattgagaaaatggataccatttgcattgctattgtggctttaattctgtgggttcagatggctattaaaattacatcttttaattgtgtttatttttaaagttgaaaagtgatcattatcctcctgttcattttgaaacaaacatgaatgcatatgtaaaattattttaggatggctgggcatggtgacccactcctgtaatcccagcactttgggatgccagtctgggaggattgcttgagtccagtagtttgagatcagcctgggcaacatagggagatacccacccccctaccagtctctaaaaaataaaaattaataaataaaaataattattttagggccttgactttttttggagtacaataatatgtcatcagtaattttaaaaatttggctggagttttaacatttatcactaaagtatgtgactgtgatcctaaatgaaatactgtaaaagcaagtgatgtaatcttaactgatgaaaattatttttgccaatataatcttaggcaacagacaagcccaaatgataaatgatactgtaagaatgttagagaaggtcaggcatgatggctcacgccggtaatcccagcactttgggaggctgaggcgggcggatcacgaggtcaggagtttgagaccagcctggccaacatagtgaaaccctgtctctactaaaaatacaaaaaattagccaggcgtggtggtgggcacctgtaatcccagttactcgggaggctgaggcaggagaatcgcttgaaccctggaggcggaggttgcagtgagccaagatcatgccattgcactccagcccgggtgacagtgtgagactccgtctcaaaaaaaaaaaaaaaagaatgttagagaaaaaaaaaaaaacaggctgtccagctacttaataagtagaaatatgtatttcttctaaggaataaagtataatttaatatattttaagaaatgtatgtagatataatttacatttttttttttttttactgaagaccaggaattctaaatggtttaaatatcatagctaattgtatctatgatctaattttaaagttagaattactttagttttcccttttaggggctggagatgtagcacattacaggctaagttacattagcttattatttctgtgatccttgtggatattcttttcaataactggaaccttccttaattatttattaagtgtgaatcatgaattcatatgaaaagaattttttgcatattgactaggaaaatggtttagtaaatgtctattgaagcctattttacataaagtgctatgttagatattatgtgggcgatcacataaggcacagtgctatgcttaaggagtttataatctggtagagtgctagaagtgtaatggtagtatgcacaaaattttcacaccaccctaggtaatcatctataagccatgggaagctaaacaggtaattttatttcattaatgttaaaagtaagcattgagatcaaacaacatatctaaaattacgtagttggtaaatgtgtttggctttttatttagtttcttttgccctattttgtactgttttgacacagactaacactgaccagacaaggcaaaatgtgataaagctccacatgaatgataagtttaattgccttagagttgtgtccaatcaaatatttagggggaagacattatggagtaactagacctttgaaagaacaaactggaggggaggagaagcagagctagggaaaggaagcagcagcattctaagtagatggaagagcattaagacacgtttggagttcagaagtggagcgcgtagtctgcgaactgtgagcagtcttgatcattaggacttgagtatctataatggagtagcttaggcttgaatgatagcttgaagccaggttttagaaggcctaaaatggaatttcggtgctagttctgttaagaatgttctaggagaaaagagacccaatcacagcgagtctttttgaaaataatttggcagcattgaagaggatttagaggtgggaagggtttgaaggtgaggaaatcaggtaggaatattcttagaatgaattgataaagaccacctccttttgggtaccttccctgatcacctgccattgaatgggtcatgtgtctacaagagaaagctgtgaaagacatctttagggaagaaccattgaagaatgattttatttgtatttgtatccattaatgcttaaactgtaataggtgaccagtgggtgattgctgaatgaatgaatgatttagagactgaaagtgttggggagtggagaaagaggaaaaggaaaaagtattccaatatagtttctaagctttagtcacagtgtagtctgagattgaattctgttaacagaagtacgaaagtaggcttgggacattaaccatcaatttaaaaggcagatttggaacttgggaaagagaaagtggtacacgagttaatatttgtgatttattcccgggggcgtgatatttgaaggtttggaagaaggtgagttttcagagagaatattgagagaagaggccaaagaagaaactttggagaatactcatatttggactgggaagaaaaaaaacacaaaaaaagggcatgggatgatgaaaatattcatgcaatttcacataaaccaaaggaatagttttaagaataaggcaagttggtcaataaatgacaagtaattcagagaagtcaaagaattagctgaggaaaatacgtggatttagtaataggaattattttcgtaaaacagtataaaccagatctcaaagttgcaaggagggagtaggtaaatgaaaaaaaataaagaaatttctttctttattcagcttcaattggcagagaaagacaaagaaataagtggtctgatttcacatttggaaaacctctccagggagaaggtattgagcaatgtagttaaacaaatgtgtatcacatgaaactgaataataatagagctttatgaagagacacattttgaagttcatgtgacagtacaatgttcaaatttaggaaaacagtgaaatttctaaaaattacgtgaaatgtttatctggttttcttttgtaataggaaacatttttgaagttgtttaatgacttacagcaaaacctcacattcacatagagcaatacatttgtaatgtaaaagatactatagtgcagcatttctgaaagtgtggtctgtggtccttttggtggttcccaatcccctttcaggggcctgcaaagaaacaattttcataataatactacaacattatttgattttctccctgctgtgacatttgcactgtgtgaaagcagtgtggaaaactgcttgtgtattattatgaattaaggcagtggcaccaaactgcattagtagttattgtattcatcaccaccatgtgctcacagtagagaaaaaaaaagccagttgcactgaagatgttaaaacaataaaatgtgttaattttattgacgcttgatccttgggtacatgtctttttagtattctgtgtgattaaacggaaagtacccctaaagttcttttgttgcctaatgaagtatgatggttaataaaggtaaagtgcttgtttgtttgagttgtgagttgaactagtctcttttttcatggaaaccatttttactttgaagaacaatttctatattcagacttgggtatttgacagatattttctcaaagtgaaatgaaatgagcctgttatatcagggaaaaacaattgataattttttttgccattgataatatttgagcttttaagcaaaaactggaattttgaaaaacttgttatcttccagtgtaagcttgatgctttccaatgtttacaaacttttctaatgagatggttgtaatatttagactgtattttttaattgtatagcaaaatttgtcagcatttagaagatccacataactcagtgaaccagtagttttccaaatgaccagcgatgttacaaaatcatgtatcataaaagagccattctaagtgcaagttagatttcaaggttgtatgaggttactgtgatagttgtgaaattctgatttttcaactcatcactttttccacatttgtcctttggcattctactataaggacgaaccttcctttgtccttgtttatgtatgtctgtgtggtattgttccagcaacgattttctgatgccaaaactggtattctacaattcagttcaattctgatactaactaccatgagttagcatagacccctcaggttaaggctcagtcccacaggactgctcccactttagatgccagttacaagtgaggtcctcaggctactgatagcagtcattttctcacacttattcacacgtaattcacacataagtacttaatagcaaaaactattatgtaccattaataacagtgaaaaaataatgtggcagatggggaattgtctacttgtggcatcatgtcagtgctcaaaaagtttcagtttggaacatttcagattttggattttttatcagggaatgctcaacctgtgtatgctttttctcagcactactatattctgaaaaccattccatatatgaagctcatagaaatcctccatctttttttaaacagctgtgtagtacttcattatacataccataatttattcaaccaacttcctgtatttggccatttaggtagttgctaatattttacaaataatactgcaatgaatgattctatgcacatgtagttttctggtgttggggtggtaccttcaaggtaaattcctagaagcgtgattgctggtttgaagggtaaatgcatgtgtagttttgttagagattgccagatgccctttcatagaatttgtattatttttcgtttccaccagcaatgtatgagaagtggacctgtttcccatataaattgtaatcaggctttctaatttttgcatatgggagagattaggaatagtaccttagtgtagttttaatttgcatctctattatgagcaaggttaaacatcttatcttttttgtgagttctttggctcattattctctgatttttggtttgttttacttatcttgttatatatatatttttcccctattagagatattacccctttatttgtgatacatatgtggtaaggattttctctcagtttatttgacttttgactatgctcactatacttacttttaccatgtaaatgttctttatttttgtgtagtctaaagtgtggtactgccttgaccagcaatgttagcaccatctggaaacttgttagaaatgcatatgctttgccgggtgctgtggcttacgcctgtaatcctagcactttgggaggctgaggcttgtggatcacctgaggtcaggaactcgagaccagcttggccaacatggtgaaaccacgtctctattaaaaatgcaaaaattagccaggcatggtggctcatgccatgagcccagctacttgggaggctgaggtgagagaattgcttgaacccgggaggcagaggctgcagtgagccgagattgtgccactacactccagcctgggcaacagagtgagactctgtatcaacaacaacaacaacaacaacaaaatgcatattcttgggccctgttctggtcctgctgaatcagcagctctggaagtgatgccccaaaatttgtgtttgacaaaaaccctccaagtgtttcagatttatgctcagctttgaaaactactgatgtgttgcatttgaatttttagttttccacagaaagcattccctacacccaggttatagaggagttcacttgtgttttgttctaatactgatagagtttcagtttttttttttttttgaggtggtgtcttgctctgttgcccaggcaacagtgcagtggcactagctcgactcactacaacctttgcctctcaggttcaagcaattctcctgcttcagcctcctgagtagctgggattacaggctcccgccaccaagcctggctaatttgtatatttttagtagagacagggttttgccatgttggctaggctggtctcaaactcctgacctcaggtgatccacccgcctcagccttccaaagtgctgggattacaggtgtgagccaccatcagttttttttttttttaacattaaaatttcttatccatttagaatttattcttggatatcacagaaggaatgcatctaagtttatctcgttctaaattgctatctagttatctcaatccattcatcaaaatgccggttttatgtcagtgatttgagatactacatttattgtataatagatttccatatgcagttgggtctctttctgtactttgagtactgttccattgatctgtctactcatatggtagtaacatggtgttttaattgtaagaactttgtagtctattttaatatttggttgggttagtcctttctcataactctttgttttcagtgtttttctagcttttctcttgaagggttagttttccatagcaattttagtaccaacttttctagctctagaaatgattgttggtgtttttattgatattgcattaagtatatacattaacttagggataactaacatcttggtgatatttctaccttttaataaagaacaggcaatatgggatgttttgttcaaatctgttttgtgtctttcaggaattttaaataattttcttcctatgggtgtggaagaattctttttaaagtttattcctaagtatttttgtttttcctcttgaaaatgggattttctctttcattgtatgttgtaactggttattgtttttgaatatggggctcttgaactttttgtagttttaaatttttatgtaatttcaaactcaagttgaaaaaatagtatagtgaactctcatttatattctttccccaacatttgacagtaactggaggtgaagacataacagtccctgcatattgtatcctcagtacaaggatgttctttcagccatgttaaagttaacagatttaggaagtttaacactgacacagtattatcatctaacctacaatacatattgaaattgtatccttagtactttgtttattgtttatagtcttttcctccctgatctaggatccaatccatgatcatacattgcatttagttgtcatgtgtttagtttccctttatctggaacaactttatagcctttcttaaccttgacatttttgaaaaatatgggccagttatttaatataatactaattttggtttaatatttcatcatgatgaaacttaggttatgaattttgccaggaatactatagaatttaaatatccttctcaatactggtgatctttcattatttggttaaggtattgtccaccaggttttactgatataaaattaatattttccctttgtaattaataagtaatttgtagggagatactttgagaccatgtaaatatcttgttctttatcagactttcacctggtattttagtatctattaatgatcttctaactccataattccttctatattgattagaatttttctgtaagagctatcttttctttctccccaatttgtttatttattcattgatttttatcattgtagactcatggattcccgttttagtcaatggattacagtctatttttataatcattttgatactcagattgtatcagatttaactaataagagcccctgcatactagctcttgtggcttaatgtgtctttcattattctttgagcacttattactttctggtgcagaaggatgttccaggctcatcttgttattttcctgccccagcctggaatcagtcttttctccaaggagccctgttccatttactggtgtatgtagtttagaaaccaagatctgggctgtaggtgtaccctcattgattcaaagtccttagcagacagagctggaaaatatgtttctccccctctctttccctctctgtatattaaaaaatagcaacacacacaaaaaactatgagtaaatacttatacctccaattgtagtctaaaactacagcataaattctagtcttctctctttccataatataacttccttttctaattagactaggaacctggtctgagtttccttgatatatttactcaagtgttgaatacacagaaaataatttcagaattgctaacccatagcactgtgaaaagcacatctaactagagttcaacatttgtttcatttttttggtgggtagggtggagggtgtaaaatttacatatttagttgtcctatggtgtactctccgcgctcctttactctcagaacattcccatgatggcagagaagaggaatatattatttctcctatttaccagttggagtatcagaaacatccttaacttgtcaaataatttgtaaaaccggggtcactgtgagccattttgggtaccgaagaaaaaaagtatttaggcaccctggcaaaggcaaccagctaaacagacttgttcctgggagctggaacagtaagagatgactacttctgacaaaatctctttcttaaattgtggtggctattttaggaaaattatgagtcagcagttaatactgttttgctcagttaagatagctacacttatgttatccatgcctttgtaagtaggagaggtcccccagggattcttgaccatttttgtttctagaaccctttgatattttgacaaagtctattttcagaaaatgatttaaaatgaatagagcaaaatgtgtagaatcacaaaggaaacacattattgtagttatcaaaatattaagacaaatttgtgatatatatgatagtagagtatgtgcttattcttttaaatgttaaataagatttaatagcatgtctaataatgactgtaattttgaagtggtgatcaatagaaaggctattttgagatggctacaacaaatgtaattcgaaacaaatgtaagatttagcagcatgtctgataatgaccataattttgaagtggtgatgaatataaaggctattttgagatggctacaacaaatgtaatatgaaacaaatctgtttgatctctgtaggtggccaagttacaggtactacaaccattactgtgttttttggcctacattcctaatggaagaaaatcctaaattttagttagaagttagtgaatagatacaattttttttgcccatgtaagttcatggacctcctgaaatctaaacatggaccccttgaggggctttgtgaatgcaagtttaagaaccttctctaagtccaggtattatgttttggaggggagagttcagtcttctgatttgcaaaagaacctaaccttaactatcttgtccatgtgcatgcattctctgtcccccatgaggaatcaaagctgcttgtcaccaatcctattcttaccctgaatcctatttgcaaataatttattgtatctttgatggtagagtaggcatattagattaaactctctattaggttggaactctataaagttgcttgactgtaccaatgcagcctaaatcttttcatgaaacccttgactctatttcagtagtgtattatttgcttacagaagaatttaaactctacttctttaatttgcataaacttttgaataagtattttattatctctaacttcttttgtgcctttttttttttgggagacggagaatcttgctctgtcacctaggctggagtgcagtggcgcgatcttggctcactgcaacctctgcctcctgggttcaagcaattctcctgctgcagcctcctgggtagctgggactacaggtgtgtgccaccacgcctggctaattttttgtatttttagtagagacaaggtttcactgtgttagccaggatggtcttgatctcctgacctcatgatccacctgcctcagcctcccgaagtgctgggattacaggcgtgagccaccacgcacagccctttttttttttttgaatcgtgtttgaaatgtttcttggatttaacctttcttttttttctgtagtcacatgccagtcttgaatgactacagtagcatctctggggttttcagtcatggcaagagatgaaggatatcttttgaatgcctttcttgttctaaatgtatctcctatttctcaatagccctgtaaggcttagaaaaggtaaattctttagggttattagtgctgatctgataatcaaatctaggtcagcctgattccaatctaccatgctgtgctgccttcctactaatttgcttctggttttgagtatgcccattattgttttgctagattaaccttaccaaggaccatttttaccgtgttgttattgttaaaaaacctgaaggcccattgtaaattgtatgacagatttgacacatctgaccttcaacttgtcttttcagctatatctcctgcctgagacagggtcttgccttgctatgttgctctctaactcctgggctcaggtgatcttccctcccaaagtgctgggattataggtgtgagccaccattcccagctcctgctgctcttaatatgcatcctttgctctagtcatattttaccaagcctgaaatacgttattatttctcatatgttctgtatctttttatttactttatgtcagaatgctcttcatctgcttggtgaaaattccttaggatccatctcaaatggctcttctctatagtctcttcctagtatacagtgtttccattttgatacattgcattttaccttcatctctatacgagaccacttaccacaattaattgctaattatttatctagagttgtaccttttattagactgaattctttgcaggcaaaatccatttcaagttaatctttgtatctctagttcctagtacggcacctgttacataatagatggtgtgctaggtatcttgaaagagtattttccttttttgcttaaaatttcacaagtcttatttttgcagttaaataatgagtggttgaaaggcaggaatgccatcttaacctcacagttttacacagtacctggcatagttgatatgtggacgtgtatgttatgtatggacttgcttagaaagaacttttaattcctgcatctcttatcaaacctaagttgacttgcatttttcttaatgtttgcaagttttgctcttgatgatgactttcattttaaggttacttagtccatttattggatcatttatataggtaaaaatgtgttaacttagacacagtctcatctctacccccaagaaatgacaagcagcaaaaccagctcaactttccagactaaatttttcattcttatatcctttgttaataaggcctctggttgattttttttttttaacagctctgttaaggtgcagtttacatgtaatagaatctgttcatttaaatagagtttgatgacttttggcaaatgcatgtagttctgtaactaccgtttcattcaagcagtgtaacgtttccattactgcacaaagttccctcttgctcatttgcattcgtcccctcctgctacccccctgtcctagaaaacctctggtctgctttctgtccctgtcgttttatggcttctagcatttcatgtaattggaataaagcagaatttatccattcattagttgatagacattaatctaccagctgatggacatttaaattatttctgatattttgctattacaaataatgctgctatgaacattcttacgtaagtctttttgtggacatatgttttcatttttcttgagtagatacctaggagtggaattgcgggcttatatggtaagtgtatgtttttaatgaaacggccgaattgtttttacaaagtggctgtaccatttttgtattcccactggcagtgtatgagcattccaactgctccatatcctcaccagcacttggtatttttgtcagtctttaattttagtcatcctagtgggtgtattagtgttatctcattgtggattttagttttaatttccctgataactagtgatgctgagcatcttttcatgtgcttgcaggccatttgtacatattcctttgtgaagtttctgttcaaatctatttttttttattgagctgtctgtcatctttggttgcgacagttctttatatatcccagatataattcctttgtcagatattttggtgttattttcttccagtctgtgatttcttttttccttttttacaacattatcttttgaaaagcaaaagccttgaattttgaggtagtccagtttatcagtatttgtcttaatgcttcatgctgtttgtcctatcttaaatttttgcctaaatcaaggttatgaagatattctcctatttttttcttccaaaaggtttgtagttttagctctcttactttagatttatgatctatttgttttttatatggtatgatatgtagtcaaagtttattttgtatataagtacccagtttttaaagatcatgttgaaaagaccatccttttcctccatagaatttcctctacatcttgaggtattttaaatgttgaaaatactctataagtatgggtctacttttagaatctatattctattttattgatttttatcaagggtcagcaaactaaggcctatatgctaaatctggctttatataaataaaactttattagcacatggccatgcccattcatgtaggtatcatctatgactgcaattgcagagacagatttcagtagttgcaacagagactgtgtggcctacaaaggtgaaaatatatactgtttgaccctttgcagaaaaagattgccagctcctcatctatattcttatgccaatactataccgtcttgtttactgtagctttataatacgtcttgaaatcaggtttcataagtcctccaactttgttctgcttttttttttttttttttttttttcttaaagacagcatctccctgccatcttccaggctggagtgagtggcttgatcgtagttcactgcagccttgacctcgacctcttgggctgaagtgatcctcctgcctcagcctctgaaatagctgactacaggcatgtgccactgtacctggctaaattttttcttgttttcttttcttttcttttttttttctttttttttctgagacagggtcttactctgtcacccaggctggagtgcagtggtgccatcatggcttactgtagccttgacctcccagactcaggtgatcctcccacctcaggtttctgagcagttgggactataggcacatgccatcacacccagctaatttttgtatttcatgtagagaaagggtttgccatgttgcccaggctgggctcaagtgatccacccagagcctcacaagtgctgggattacaggtatgagccacggtgcctggccattttaaaattttttattgagatagggtctcactatgttgtccaggcttgtctcaaacaggcaatcctcctgctttggcctcccaagtgccacattgtgaaaatcagtgagaaacaggaaatgaaggtggcttgtccaatctgattcaaaggcttgaggagttgtacagtggccaatagtcacacacatcccattagtaactacttatttaggaatgaaataaacacattaattttctttcaatttatgtgtagttttttttttaacggtcactaaatttgttagaagacaaatacttaatggtcagtaagtcctcacttaacatcatagagcagttcttagaaactgcaactttaagcgaaaggacttacagcaggttgaaagaaataactcctcatgatccgcccgcctcggcctcccaaagtgctgggattacaggtgtgagccaccgcacttggccttttttttttttttcttttttttgaatcgtgtttgaaatgtttcttggatttaacctttcttttttttctgtagtcacgtgccagtcttgaattactacagtagcatctctggggttttcagtcttggcaagagatgaaggacatcttttgaatgcctttcttgttctaaatatatctcctatttctcagtagccctggagttacaggcataagccatcatgtccagcctgttctgctttttacatatgggctattacaggacctttgtgtttctgtgtacattttagaattattttgttaatttgtacaaaagcctactgggattttgtaggcattgtattgtatctatagttaatttggggggggaattaatagcataaaagtactaagttttctagtccatgaacatgttatatgtctccctttgtttatgctcttcttaatgcattattttgtttagtgtataggctttgcacatctttcatatatttattcctaaacattttatctattgattttactctaagtagaattattaaaaatatcattttccaattatttgttgctgtatgtagaaatacaattgattttacatattgatcttgtatactgcaacctgactaaattatttacactcatttttctagtttttttttttgagacggagtctcattctgtcacccatgctggagtgcagtggcgcgatctcggctcactgtaacctccatctcccaggttcaagcaattctttctgcctcagcctcctgagtagctgggactacaggtgtgtgccaccacggttgactaatttttttgtatttttagtagagacgggattccaccgtgttagccaggatggtcttgatctcctgaccttgtgatccatccgcctcgggctcccaaagtgctgggattacaggcgtgagccactgtgcccggccattttcctagtttttatagattttttgggattttttacatttatcctcataccattgtgaataaagattgttttacttcttcctttccagtctaccttaattttgccttgatccactggctattttgaatggaagtgttgagagcagacatcattgtcttattattattgatctcattttgatcttcagtagaatcatttagtttttcaccattaagggtcacagtaggtttttatagctgccttttatgaggttaagagagctcctttttattctttagtttctgagatttaaaaaaaatcatgaatgacttgaattttgtaaaatatttcttctgcatcaattgaaatgatcatgtttctttttcccctttattaaaaggtaaattacatttattgatttttggatgttgaactgcatttggtttttggatgttaaaatgactttttttgtgataaagtccatttgatcatgttttattttttaatattgggtttgacgtgctataagttaaggcttttgcatcaatatttatgagggataaggtctctagtttttttgtgaaatccttgtttttggtatcagaataatactggctttgtaaaacaagttaggaaatgtttctttgtgttttgaaagagtttatacaggacacatttttataaaaaaatcttaagtgatagaattcacgtttttctttttttaaggagactttttggccgggtgcagtggctcatgcctgtaatcccagcactttgggaggctgaagtgggtggatcaagaggtcaggagttcaagaccagcctgaccaacatggtgaaaccctgtctctactaaaaatacaaaaattagccaggtgtggtggtgcgcatctgtaatcccagctactcaggaagctgagggaggagaattgcttgaacccgggaggtggaggttgcagtgagccaagatcgtgccattgcaccccagcctgggtgaagctctgtctcaaaaaaaaagactttttattcatacctaagttgtaagagattcacagtttaccctacattaactcaatgagaatgatgtactttcttggcacaaataaatttgaaaatacatcggctttatcctgctttctgattttgttatatgtggaggatacatttatgagaagttgagagccagcttttctaactgtgtttccaattgcattccaacttcataataggaaataattttattgttatattttgactaaatgtttaatactgctgtatttatgaaatattttattgctttgcttattcatctttgtttttgttaattttaggaacttaaaaggagtctagaaaatccagcagaaaggaaaatggaaggtcagaattcccagagtcctcaatgtttcaaaacatgctcagagcaaaatggttatgttctcacattgtcaaatgcacaaccagttctgcaatatggtaatccttatgcatctcaggaaacaagaggttattacagtatttttggtttgggattagctgcatctggagatttttttatggtttatattttcatggattagcaaactgctggtataatcaaccctaatacaaacattattttatttgtataattagcagttttaatatttaacactgtaactggcttcatctagaagtgatgcaccatgagatgagtactttatttacttattgcatatagttcacaatttaaaaaatcacctgggttaaaaataaaaacatctatttttttcacatgccaaagtggttctttatatcctgttcatcatatctgtatatacagatgttagttgtagtaaccagtttcactctacctttccaaaaattttattacagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagtaaattgaattttcattgtgtgagcctgtcccttttttattttttagcttatgtagagagttaagggtatgtgtgcatatgtgtatctttgtgcgtgcatgcgtgtgtgtggaaggagagtgtgtgcttgtgcctgcacacaattgcctacttgattttttgaaaactgtgcttgtatttaaatttgaaaaatctaccagtatgcttcagacttatactttaggatttatatactaaagtaaaagattaagtttagagaataatctcagaatattgtagttatcagatagtttaatcttaaacatcactaagtaacttactatattcttttgattatagatgttaggcttgaagcagcaaagtgttaatggcagtgttatgcttcagtgtacatcttttctttatagcatttatatcccactttagattttagtgtggactctttattatcttcagccagaaaaagagaaaagtgtatgtatcatatagtggttttcttttttggagaaatactatttgagatgtctttagtatttaggtaggatttcttattctctggcagcaacacaatactgatgataattgaattagtttgtatagcatgtcattatttttgtaaattttatttaagagattccttcaatatttaatgaataggtttgtttccttacagcagctctttttggatagataatatgttcttttcttcatagtagctctttttggatttcctgtgcattaagatgaatttaaaagaaatgctttatcgtgctctttgcaagtacagtggtatcatgacctgtttcttatttaatctagtttgctgcatttaattgctattaacctttgcagaaactgatcagtgttcagacaggcatgattttagccctagtgctcaacacccataatggagaaaaatgtatttctccctcctgccttttggcctcctgtgtccattactgggaataattaggaaaactgtcagaacttttgtagcctatttaaggtctagagtatcatcttactgctttttcacacctttacttcacattttgcatatttaatctgatcattcttggcacagatgttacatgtgacaagcccttctcttccgtagtcatctgcttcagtttaattagcagaatgttctttctgatctgtgtgctttgccctcctgcaaacccaggagaagcagtgttagagtcttgtgctcatttgctgacatgcttagatttggtaatgagatggaggactcttaatatgcacacctcgagtaactttattttgcagtcagaagatttttcacattagaaagtaattcttatgtatattcagaattaaaaaaaattcttgttgttacaacaacaaaaatcacttgcaaatgaagtgttttagtaagtaattttagtaagaatatggaaagcaaatttgagttgacctgttctttctttctgtttctctgccctgggagtgattaatagccacaggccccagcacttttgagtcagggttgaggtgacctacctactctttcagcctaccctagtgcctacacctgccatatctcctctcttctgcaccagaaactgtggtcaattgtcagatcaaaaaccttttgtgactcccgtttacctaatgattgtaataactttaacatcataattatgacagcagcaaacatttctatacccctctttgccattaatgctgaactctttagatagagtcacttatttgttcttcatagcagtcctatgaggtaggaattgttactgttacaactttatagtggaggaaaccaagagacagattaaatagcatgccccaaatcacttagctgctgtgggtagagacaggattgaatctcatgagattggctatagaagttgtggtcttagccacctgtcaaatggactaaaccagaggttttcatactttcttagttctagtaacccctaggccaaaagaaatacagtaagtcctcacttaatgtcatatataataagttactggaaattgtgactttaaacgaaatgatgtgtaacaaaaccagttttttccctcatcaacgttgtaatgaaccgatgaaagaatgatgttatttctttcaacctgctgtaagtcctttcacttaaagttgcagtttctaagaactgctccatgatgttaagtaaggacttgctgaccgttaagtatttgtcttctaacaaatttagtgaccattaaaaaaaaaagaaaaaactacacataaattgaaagaaaattaatgtgtttatttcattcctaaataagtagttactaatgggatgtgtgtgactattggccactgtacaactcctcaagccttagaatcagattggacaagccaccttcatttcctgtttctcattgattttcacaatgtggcacttgctttatatcacagcaactgccaaaaccagcatctcgaagataagatggcattgaaaggaatgtgtagcacatttaaagttgaatctgtgagcgatctccagtgactgtagttgttcacgtggtatatgacaaatgcagatgctcctcaacttacgatggggttacatcctgataaacccatcataagttaaatatgtgtttttgacttgaaggatattttcagcttacagtgggttcattggaacgtaaccccatcataagttgaggaaggtactgaatgtgtattgcttttgtaccatcttaaagttcaaaaattgtaagtctaaccattgtatgttggagaccaactctaatgaatatttctgtgtacttctgcatatataatatccttagaaaattaaaattatcccacagtaaccctcggaatttactgtggtgccctaggtactttcatacctagttctgcaaactatgggtctaaatccttgctcctcaaaaaagtggtttgtagaccagcagtagtggtatctcctaggagtatgttggaaatggcagaatctcctgccccactccagccttactgagaatcagactgcatttaacaaaatctttaggtgatcatatgatttttaacatttgggatacgctattttaaaactgcctaaccccaatcattcaaggccagattattatctcttcccttaattcatatcttactttctagttgcattcttgcatttcttagtgtttctcttctaccttcattcctttctcctctatcaaagacgaaagcccacacattctattaatatgtggcttatttgaaacttttcacatgagcccttcactgtgaacccctaaactgcagacattttttgttgatagacaatttttttcttttttctggtgagttctagcttttattctcagaagcgtctgttactccaaaatgattgagaaccagtgcttgagagagttgagggctgtttcccatttatcatgttgcactgtttgagtttttgcctttctcaaacttgccatttttcatatattatcttacgttttaaatttaattttaatgtgttttctgttcacaaaaatagtgtgtgattacagtcaattcatttttatcaagagagccaagacaattcaagaggaaaagaatagtctttgcaacaaatggtactggaaaaactgtatatgcagttcgatgaaagaatgaaattagactcttgattcatagcctgtgcagaaattaactcaaaatttgattttaaatgttaagagctaaactacaaaactcaaaacatacagataaatctttacgacttagattaggcagtagtttcttagatatgacaccaacagcataagcaacaaaggaaaaaatagatataggttgactatcccttatccaaaatgcttgggaccagaagtatttcagatttcagattttttcagattttggaatatttgcattatacttaacagttgagcacctctaatctgaaaatccaaagtccacagtgcttcagtgagcatttcctttaagtgtcatctcagggcttaaaaagttttggattttggagcattttgctcttcagatttttggattaaagatagtcagcctgtaattgaatatgtcatcaaaaggattaaatgaatctttgctgttccatttaaaattttttatacacagttatttccaacagataatatatagctggttggcatctcttaattctgaatattcacttttctataccatattagtataatacctttcatatagtagaggcttttaaaatgttattaatgagtttaaagaaatgtgtttgttccatttttgcctattaaactatttaaaattcaggccatcttagaaaagtaattgttgggctgggcatggtggctcaagcttgtaatcccagcactttgggaggtctaggcaggcagatcacttgaggtcaggagttcgagaccagcctggccaacatggcaaaaccccatctctactaaaaatacaaaaaaaatttatctgggcatggtggtgcacgccagtaatcccagctacttggaaggctgaggcatgagaattgtttgaacctgagagacagaggttggagtgagccaagattgtgccactatactccagcccggacaacagagcaagactcggtctcaaaaaaaaaaaaaaaaagtagttaattttttgtgatagcttgagatataattcacatattatacaatttgccatttaaagtatacaatttagtggtttttaatgtattcacagagctgtgcaaccatcaccgcattcaattttagaacattttcctcaccagcaaaaaaaaccctgtagcctgtagcggttaacctcttcccatttattcccaccagcccaggaaaccctcagtccactttgtttatagattcgtctgttctgcatagtaatataagtcaaatcataaaattgttatcttttgtgactggtttctttcacttagcatgttttcaaagttatccatgttttagcatgcatccatgtttaacatgaagaatgggttttattcttgtttgtttgggtggttagattgagcatccaaaatccgaaactgagtgctgacatgatactcaaaggaaatgcttactggagcattttggattttcaaatttgggatgttcagctggcaagcgtaatgaagtattacaaaatctgagaaagtctgaaatctgaaacacttctgttcccaagcattttggataagggggactcaacctgtcccacattttgtttacccattcatgtgttagacatttgggttatttcaccttttggctatggcatacgtgcttttgttttcatacctttttacttctttggggaaagtggaattactaggtcagttccactagcaactgctgtagtggaaatcctaggagtggaactgctgggtcatgtggtaactcttatgtttacctaaaccttttgaaaaactgcccgattgttttccccagtggctgcatgactctacattcccatcagtagtgtatgagggttccacttactccacatcctcagccacacttgttactgtctttgtgaaatggttcatcattgtgattttgatttgcattttcctggtggttaatgatgttaagcatctttcatgtgcttgctggccatttgtatatcctctttggaagaatatctgttcaaatccttctgctgttttcaaattgggccccttatcagataatagggtttgcatatatgtctcccattctgtgggttgtcttcacttttacgatggtgctctttgcagcacaaaactttttagttttagtgaagctgaatttatgttattttgttgcttatacttttgttatacctaagaaaccatggtctctccaaggtttttaatttactcgtatgttttcttgtaagggctttatagttttagctcttatatttggtttttggtctattttgagttaatttttgaatatggagcaaagtaaagcttttgaaaactaacagatgtgcaaaattatttttaatttttgaatatggagcaaagtaaaacttttgaaaactaatagagatttgcaaaattattttctttctgattttaaatgcttttaaattagataaattatatatagttcaatgttatttcttcattgatatattactagaaatgaatgtctggcaaagcataagcaataacatctcataagaagaggaggaatactgactaatactgtatagtaatacaaagttttgaggggcaaagagatattctcttgttttaaataaaagttacccagagtcattggatactctcttttctcttatgcattgattttggccttagcaaatatgtaaatttcttaaagtgtgaatactcttgaactaaagtaataattatcaacttagtaagagttttgttaagtggtgaaacttttcttcctcaatattaattactaattcctgaatgataactaaatatttcaattagtagttcctagcaaaggtagaattacaacacagtttgggaaatgctaagtagagagtcccacagtctggatactgatgatacagattatgtaactcagtcatttacccctgagtatgtattgccataacttgatcatgatagatggcattttttttattgtggtagaataaatataaaatttgccatcttagccatttttaagcatatagttctgtaatgttaactttactgctgtgcagccaatctctggaaactcttcatcttgtaaaactgaactccttacccattaaacaacaactcccattccctcttcctccagtccctgaaaaccaccagtaatttgaatttgactactctgggtaccttatgtaagtggaatcatatagtatttgtctttttgcgagtggcttatttcacttagcataatgacttcaaggttcatccatgttgtaaacatgtatcagaatttcattccttttgaataagggtaaataatattccaccctatggatatatgccacattttgtttatccgtgcatatatcaatagacatttgggttgtttctaccttttgactattgtgaataatgctgctatgaacatgggttcgtgattgaacatatctgttcaagtccttgcttttagttcttttgggcatataccctgaagtagaattgctggataatatggtaattttatttttaattttttgaggaactaccatgtatgatcatgattgcattttgaagttagtgtgatctaaccctaatttattttccaacaggttataaccccctttaccatcaggccaggcaggtgactcatgtctgtaatctcatcacttttggggaggccaaggtgggaggactgcttgagcccaggagtttgagaccagcctgggtaacatagtgagatcctgtctcttaaaaaaaataccgagtgtggtggtacacgccggtagtcctagctacctgggaggctgagatgggaggattgctggagtccaggaggtcatggctgcagtgatccatgatcgtgccactgcactcctgggtgacagagcaagaccttgtctcaaaaaaaaaaaaaaaaaaaaaaaaaattactgttcaaatgtccaaggtggtcgtatgcttttaataagaaaacaagaatgtttttgtacagagtatatcctgagcagataatgagaagtttttgagtttcaaattgaatgtcagtttatcgtagcttgtttcctttgcttaaaaaccagtttgtaatggaaagagtattgtgctgatgggtgtaaacatagatgaaaacaatagggcgtttagatctttaaatggattaaagtaatattaataaaagttttctgaaaaggtatttcttaaaatttggaactgttcataaatatatttcagtacggtattctcaataaaatttgcttacaagattattttagtagtttagctaaaatactaggtggtgatattttaaaatgtgctgttaaaccctttgggtttgtaagtttcagtgctgaaactgataatttaataatttggggtagaaatatttctaaaacagaatgcatgattctctggctttccatgctttcatttaatataaccttgatgattaaggtttatttaaaaaatcagtgttacatggtgtcatattcttttaagatctattactaatagtgaaatgcctaacattggatatttcaagttcttgtcttgcttttctttttcccagtagcttttttttttttttaactgtcagtcggcctgctttaaaagcttcatttccaaattaaagtatttttaatctactgtggttttgaaactaattaaccaggcttgttgagtaaaatagaataaatgtattctcgagtgaagatttcactcatcattttgcctgtcaatatcatgagagactttattatatgtattggctccttagagtgcttactgcatactctctgatttcaacctatgctctgggtagatggttcatgttttatttcatgagaacttattgtttctcattataacatgtagaattatactcttgagcccctctccccttttattaggtaataggtggtagaagataacagaataatcgggttatcattgccaaattatatatgacttagaaagtataaattacttctaccttttttcccctccaggtatttaacgagcagggttaacatgtctgacagtttgtctgagtctggaaccttagctacaaactctactgttagctgattcatggaagcagtaaattggtgtaggctgttagctattataaaacaggaaaaggaggttatgagacttttggttccattacatttttggcccctagaaaattgtattctattttaaatatttgtcgttaaaaattctaaaaaatataatatcaagacctgccccattttatcttttccaattattttcttcagcatttcaatattttggatttttttttcaaagatgagtgagaaaattttgttccttatcactgttttgtagttatttaagtatactcagtgtttcaaagattgttgctgggaggcctaaatctgggagctagagtaacctggcacaaaatcagaattcactgtcctacatactaagctcagcagattcaactactttctcatcttccttctttgtatctacagacttaaaagctgtctggattttagttacttgattgaatttttgaagtatataaagtattcgtgttttatctcccaatttaatcccccattaggttatctgtcccgttttccttttgctcagttatatcctatgggactcacagataaacagaagtattttaccccttcttttacttttcaagaggggaaaattgtcagaaggatagtcaagtactagaaatactcattttgtcttttgtttgttcacgttgcacttcacaccatatatactttttttggtgctccttcccatgacagacttaactgacccattaatagcagctctggggcaagcatgcctacccagtaacataaaggcttcctcagtgccggctgcgcttggggatatgctgttagttcatgacatgagagcagctaacggctgctgagagataaaaaggaaatagtcaatttagatgatgtgcctggtttcagtgttaaatgagcctgtgtgtttggctgttgatgtagcacgtacagatctctaaaaactgctgggatgcagccatgggaatccaaatcagtgttttctttctgatgaaaactagatgcacaaatttttagaagtctcacttgacaacctctgaaatatttaactttggattttgttcctctatagcagagttttgaggcttgtagtttagtgcattgctttgctttaacacgtgttaatccagttggacttgcttccccaagaatatgcatatacaaactcacacatactttattagtttttcattatgatttctgtatatcatgcaatggatgtatcttgtcagagagactgtctttcttgtaattaagcttacagttattaaatgagaacgtttgggacaataatgcagtctgacagtattgaaagtagggccaggcacagcggctcacgcctgaaatcccggcactttgagagaccaaggaggacggatcacttgaggccaggagtttgagatcagcctggctaacatggtgaaaccctgtctctactaaaaaatacaaaaattagctgggcatggtggtgcacacctataatcccagctactcaggaggctgaggcataagaattgcttgaacccaggaggcaggggttgcagtcagccgagatcgcgccactgcactccagcctgggtgacagagtgatgactccatctcaaaaaaaaaaaaagcaaaaaactggtcacccagtctgcagaatgataaagtcagtaaaagttacctacgtatataggtttgaaaaggtctactgttctcagcttcatttacacatacaggtatggtaaatggtatgtgtaaatggtatgtctctattcctctgaatactgctttttatttcaagaacaccacagtgttagtttatagtgaaatactctgcaaagtttcaaacatgtttatttgaaagtctaattaaatgatagcagagagaaaatttcctgaagtgtaatcttcttttatactgtcagtatgtgcttgattgaattaaggaatttatatttggttttacttttcttaaaagttccaaaattatttttcccctaggaagatgagaatgtgcctactgctcctgatcctccaagtcaacatttacgtgggcatgggacaggcttttgctttgattccaggtagttttcttctttactttgtagaatttgggttatatcggccagtggttctcaaaggtggtccttgggaactcattagaaatgcacatgtgtagggcctggcctagctgaaccagaaacaccaggcgtaggcccagcaatatgtgttttaacatgtcctccgatttagggagttttgtcagaaaacatttttaacttgcagtatttaaaagaatatttactgttcctaaaatgtcattcaaatgcatgtattgtctgttgtttggggatgggaactagttttgcaaaaaacacctaatgttgtataataatgcaccaatgatcttgctggttaaaaatacagtatttttggccaaaaacaaaaacatgtcctccgactgattctgatgcatacaagcatttgagaaccagtgccataaaaactttgctattaaaccaaatgcactggtgggaagttatgagttgtatttatccttacagtcttacaaaaggcattttctgttaaacgtggaagaattcttggtactaatttcacgtaattgtgattggatttgggaggttttaagggggaaaaacggttttgttaatctaattgtaaaattgaatttagaggctctataaatgggttacacaattgtctacagcaagcatttagaagcagagaaatgtttctggagtaaagacttttaaggtaggttgtttagtatgaatatcagctaactagataaatggaaccttgtcatatatggacaagttgttgttctacatttattagaaacatgtaattctttcatttttctctttaagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagttttttgagtctagggcaaaccagtatgaggcattcatatgccagctgttaggacacagcagtcctaggaagcaatagctttggagactttcagcttccagataggttatatacttaggtaaaatatgttcaacaatgggagcatttttgttggagttaataattatggaccatgttaatccaaaagtatccttggaatatttattatagtagtagacactgttcatcttactagcctagaacttattttaaaatagtttaagtaagtaagtccaagcttaatttgttattgacagaaaagtaatacagcctaatctaatctaagcaaaaatgtaagggaataaagtctacatgcatcaactgaacagccttagaatgaggaactgaatggatatattaatttccatggtaaacttgatactggttttcataatggacactaaggaaaataaagagccatatttatttttgggtcagaggcagtttattttaaatgtgatttcatttacatttataagcagcttttcttgacaggaattttgattaaattgccttcagttctaaaacaaacctctgttgctttcagacttaatgtgctctgtccccaacaaaacatatgaaaatataatttaaagcacagttttcacagacacagtacaatacattcactatacacagtataacaaaatattcccatccttacctgtttagtaatactgtcacaatgaataagtaaatagaaattggaatttatctttgaaagcattgaaagaaatttaacatgcacaatgactattttatgactgtttagctgttgaactactgatccagcctgcagtttcttgcactagaaagagcgaagctaaataataattgctggcctaaaaaattttttttggtcaattgtaggtagatatgaaatagccaagtggggccttcttatgcaccaactagttgcgtctcatgtctggatcacccttttaaacataggataacactgtatattcaggaccaagaccatacttcagatctgaggaaatttttagagggcagtgtttttataaatactttgaatccctcataatgaaggattttagaacttatgaatatagaggtttactcatctaacaaacagaactgtcatcctt

SEQ ID NO: 16325 - DNA, 15675 bp, Human
aacctgtctctacttaaaatacaaaaattagccgggcatggtagtaggcagtagcaatcccagctactcaggaggctggggcaagagaatcgcttgaatgcaggaggtggaggttgcagtgagctgagattacaccagtgaactccagcctgggcgatagagcaagactccatctcaaaaaataaatacatacatacatacatacaaatatccatggaaaagttgatatattgagaccttctatcagccattcccactatagtgtaatttagctgtttctctgacaggaatttttatttaagaagaaagaatttggagaaatagacatagtaggaggtaacagatcaggctctttccaccagaagaaacacaaataccttaaaaaacaggaagaggctagagagatcagtggggtactaagaccaattttccatgtattgtattttacaatttttgctaaaggcatgtcctaattccttaaggctgcataaaaatactcagcccaggagctaaggaaaatttactcagaggacaatgtatgtttttctggctttcttaccctgtttcacccaagtttccagtttcacctgccattgggttatgattactccagcacagatgacttgttcctcttccaaaccccatgaaaggaacttagaaaatttgtctttattatatcttttaattaacacttccccaacgggataatgatacttctgggctatcttatgttctttaaattatgtatttaatttcctagcaatcaataagagccttgaaggttttgtaagtctcacaactcctacctagtttatatttttacatttatttatttatttatttttgagacagaatctcactctgttgtccaggctggagtgaagtggtgcgatctcggctcaccacaatctccacctcccggcttcaagcaattctgcctcagcctcccaagtagttgggactacaggcatgcaccaccacgcccggctaatttttgtatttttagtagagacgggtttcactatgttggccaggctggtctcgaactcctgacctcgtgatccacccacctcagcatcccaaagtgttgggattacaggcgtgagccatcgtgcccagcctagttcatatttttaaagtttgtatagatttatagatgcttttaaaaattatgtgattatgtgtcttgccttggcaacctgggcaggcattccagacacccaaagggattattagttcatgttcgcacgtctgcccagcaacaaaactgagcagcctccaccaagcacgtaaaatccccattcctcctcttattcatttatttagcacttaatagtgccaggcaggaaggtaaaaatacatttaaaaaggaatggaggtagccgtcttgccctggaggtgcaggaagctgcacttcagtgtgctaggtagagggtacataggccgtttctgtttttcttccagctcagggatttataatgagaggaagtgctacaaaaagctgtggtgcgaaaatgacggacgctatgaatggaaaaaaaatctaaaatcaatccggtcctaagcaaacacgcttcacctacactcataactattgcagacctccgaggcctgggatccccaagaatatactgagtttgacaaacttttcaacttcaactttaaattaaaaagacagtaaaagaaccaaatccatagtacacagcaatcggctaaagttcctggggccctgcaacccagagttgaataattttgtattaaattcccaatatcaagctaaatctattttaaccacaggaaaagcagcaacttgtctggctattttaaaaatctgaacagcacttaggaagaagcaccttagcgcagggaacagctcagtgccccgtgacacaactctcccgcgggcccagggacgcctcgtctcgcgagagttgagggacgcctgagcgaacccccgagagagcgggcgtgggcgccaggcgggcggggcactggggattaattgttcggcgatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcaggtgcgggttggcggcctgggcgggtggctgcgccgcgagagcttgcgggtggggatgactagcccgccccgctgcagtcacccggcagggcggacggaagagcgccgggctgggccgggcctcgcggtcccgccctctaggtcttcccgagtctccagcgccgctcagtctcttgcaagtggcctttactgcatcctccccacctaccgctgttgcattttaggtcctcccttcatgcagcccccagcgcaatgtattttccaccctgctgctgaccatagttatggcctttgtgctttaatcaagtagcagctacgcttttctgcctgacagtcttttcacgggctgtgtacgtctccacctctcgtttctaatccttcacttctttgcaattttgtagacgactaatagtgtcccagccatagcctactcttttcccatttactttttttgccacgtgttgtcatactttacctgccacttagaattcaaggttccaacctttgctgtacattcacactatctggggagcttctcaaaaatcatcctgccggggcccacctcctgtgactgtgatctaactgctggaatcagggccactgtttttctttaaaaagctccctaggtgatttcgatttgcagacagggttgagaaccactaagctaaggtatcacctcttccaggaagcgttccctgacttaactgccctcgtgtccagaatgagttaggttcctgccttctacaccttgttaatagcctttacgtaccattatcttggcattttcgcattgtactatgcttgtttctttcatttgcttaatgaccagaagagtcattttcagacccctcctcctccatctgaggttgctaacgtattaactttctagggcagaattggctccagaatttggtggcagtgcatacgattcagagaaaatgaagaagcaggctgtgagaaagatattcccagccataatgagacgaaaagaaattgcatcagcctgggcgggggacagttctgtgtttaagttgcctgtattgaaagagggaacttgcgtaaatacactttcaagcctgtaggtgctgtagtgatgcttgaagtgtttaccaaccagagcacccactcttcaaggaattctgttgttaccagaaaagaaattgtccatcaaagacccttccccccacacccccaaatgtatgggatcctggctctgctacttaccagctgtgtgaccttaaactaactgcctgacctgtggctctgtttacttttctttaaaatgagggtcgtgattgtacagtacctaccacagaagctgttatgaagactcaatgaactaatccatatgaagtccacgttgtaattgtttgctgttcagtattattaagacttcctgggataggtgttacctcaatacacatatcaattatgcatattttaatctaatgatgcagaagaaatgtgtgaagaaggctgcggtttagtggattttttatttaactgccttttagtggtttcgattgtaccttttaaaataaaggaggggatactgatttcgtttctcgcacacagaagagatagatattagtaagtgaaaaaaaaaaaaaccttcagcttgcaccaatagccagttttttgagttcttctgataactagttaaataattttgactcttcactgactcctttgtaacacttgataaactaatgtgttaaaaaatcagcttaactcagtaaatgtgaaaaagttgttaaattggagttggtttgttgcatttggcattgaaaaaaatatatatatataaacaagcattattgggatttgattaacagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatgggtaagaacaccgttcaggtcctatttattatgttgagttacatttagagttgtggtcttctgagagcaagatgaaagaatgcatgagttttgacacagatcaaaacccctagcttattatacttgacctttctaaacacagtttccctctcaactgaaaaaaaaaaatcagagtaatagaaatatcacatggagagataggtagtcccttagaactgggagaatgccaagctaaaaaactatgtctctgaccttataaacaatcatttatctgctgtccacaaatgctgtggtttgcctgacctgaagccttcaggcccctttcaaaagccatatttaaaattagcttggagaaactgagaattttagtgctgttgtggtacatggcaagttgattttctatttttttccttaattttgtctgattgtgggaatctatatgaacttcgtggatgtgctgtcacttctgtgttaagatggtggagtttaaccgcaaaacactattgattggagaaaagcaatgtttttaatctatgaacctctgaaaactccttaattcctaactgcattctattttcttgcagcactactatggatgtaggagcagtaggagatctcagacgaattaaaaatgctattggtgtggcacggaaagtactggaacatacaacacacacacttttagtaggagagtcaggtatttttttaactacactgaaattttttctagtcttttgactatagttttcactgaaaaatagtacaaaatcatggataaaaccagatctaagttcaaattccagctgttttacttaacatctattgaactggataagtaacttttaaatctctttacttcttcatctctaagaagaaggcaatggaagttttgagacggagtttcgctcttgtcacccaggctggagtgcaatggcgcgatctcagctccctacaacctctgcctcctgggttcaagtgattctcctacctcagccttccaagtagctgggattacaggcacgtgccaccatgcccagctaatttttatatttttagtagagacggggtttcaccatgttggccaggatggtctcaatctcttgacttcgtgatccacccgcctcagcctcccaaagtgctgggattacaggtgtgagccaccgcgcctggccgggacgagaactcttataatgcatgccccaaaggttttaagtggatctgttttaggaagggcataaggaaatcgaaggtctaaaaattgagtctcttaaaactgttcatgtgtgaatattcctttgaaagtctttgtgtagctcacttaagatgctgctgacccagaatgtctctagtacatatatttttgttgaaaagacaatacttgaataatttatactttccttttttccaatctccagccaccacatttgctcaaagtatggggtttatcaatgaagacttatctaccagtgcttctcaagctcttcattcagattggcttgctcggaattgccagccaaattattggagggtatgcacacatttaatttaaaaaaataagttaattgaaaatattcagtgacatcctttctgctcagtgttgcctgcctgttgtccagggtactggttagcatcctggctgtacattagaactagtggttttagttgactctccaggtatggatgttcctgaaacacctctagctgcattgggtgcatatccagcatggagagctactggtctctcacagtagttttcaaactgaagtttctgccatgtggaggtggctgcctcaatcagggctgctctgcttgtatttctttctaactaagtctaaaaaatcagtttggaaactatgagtctaaaatatttcttagattttacgtgcagtgtatccagtatcttgttcttgacttgaggacatgtaatattacatgtctagtatgttaccagtggaataatttttctttaatgagacttttggcataaatcagtttgcctttgccgtacagggtccttctgtgggatatcttagtctctcatctatttcttccctaagtcctaattactttcgagtagccatcaagtcagaagtcccttgggttagcacttgaaagaggctaatcataaaacgaagttaggggaggcacctagcgcactgatgtgtaagacatgaggaataggaataggtttcttgctttaataccagtctacatacacaacctaaatttatgagtttgcattatattcttgagccctttagatttataaaggaatcttaaagcacaacttagaatatattcacataaacctagctttgaagaaacaataaaagcttttaaaacatattttactttaagtctcagaattctttggccaaggaacaaatttctgaaatttaaaggtccagtgtgtatctaatttctttaaggattaatatctaattttaaaaaattttactattgtgttgagaattttagatatatataaagagagaaattagggacctgtgtcatgcaatatagatacctcacctgtattatttaattcttagactagaatggatattcagtaaaattatttatcttatttgtttttatataagacttagtgatttcttagcttttaattcttatctttaagttaccagatgtctttttttggtttcttgctagtgtttagcgattgtacataatttcttggcaatttctaaaaataccctttgtaagaaataaaacttaaatcttgtttacagaatgttataccagatccctcaaaatactgcggaccctacaaaccacctggtatcttaaagcaggatattcctatccataaagaaacagaagatgatcgtggtcatgacactattggtaatttgccttttgtgcagtttttatggataaagtttagttaattatcttcctgtagctcttccctattcttctaccagaagttgattttgattgttttaactgccaattaagtgtgcctctctatagatagatccatcttgtcttaggatctgtataaaatttggcaaattatttatacaagacacctaaaacccaatgactattcacttgcggatttttaaatctttatttgacatttcattttttggcagttttatgttgctgtattttagtgaccttaaataactttttccaagttacaatgttgaaaatttacattagtctatgtcttagtttgtttttcgctgttataacagactaccacagactgggtaatttataaacaaaagtttatttgcctcacagttctggagcctgagaagttcaagaacagggcactggcatctggcaagggccatcccaaggtggaagtcaagagaatgagacaggaaatcgggtagaactcatcctttatatcaggaacccactccctgcgataatggcattaagcccttttagcctaatcgcctcttaaaggccccacctgttaataataattaataatgttaattgcctgttatagtggcagttaacaaaatacccagactggatggcttataaacaacagaaatttatttctcacagttacggaggctgggaagttcaaggtcaaggcgctggcaggttcagagtttggagacagcttgttttcctggctcatggatggcgtcttcttgctgtgtcgtcacgtggtggaaggggcgaggaagctctctggggcctcatttataagggatgaattccattcatgggggctctgtcctcatgacctaatgagctcccaaaggcctcacctcttgataccatcaccttgtggaataggatgttgacatgaatttgggggaacacaaacattcagagcacagcagttattaccagttgctcaattatttggttatatttgaggtaaactttatacacctacagtgattttttttttttaacttctaggcatggttgtaatccataagacaggacatattgctgctggtacatctacaaatggtataaaattcaaaatacatgggttagtgtttccaaaagaacagagctctcaaatatacactgaatgcagagcaatatatgccgggtgctatgggggttgcaaagcacagccctagtctcacagctgcgatgaatgagtgtgaaagaaaatgcagtactctctgctgagtgccacaggagagggagtcacagccagtgctatagggtttaggggtggcagaggtgatctctttaagctggggtagttaggaacaccagtaaagtgatgcttggagctcagccctgagtcatggtagttgaggttcagcgctcctactggctaggaaagttgtgtgtgtatatgtgtgtgtgtgttcagggctcccactggggtgtgtgtatgtgtgcatgtgttcagaactcccactggcttggaaagaaggggtgtgtgtgtgtgtgtgcgcgtgcacgcagaactactggcttggaaagaaggggtgtgtgtgtgtatgtgtgcgtgtgcgtgcacgctcagggctcccactggtgtgggtgtgtgtgtgtgtattcagggctcccactggctagggaagaaggggtgtgggggtgtgtgtgtattttggggtaggggaagtggtattggaagataagactacaagggaagactggggccagatttaaggagtcttaagtcagttgaaggcattctggatttaattttgaaatagaaaagcattaaacatttcttactagaaaaaaatctggtaaaagtttggcacattacataggaagcggaaatagattatagatgagggaaaccaattttgaacatgttgcaatcatctggaaattagatgataaaggatggtaataatagaatagtcactgtaaatctgtgccatcctggtatatacctggctgataacaagttcttttaaaaaattaattttaatgacaatgaaaattatgtgtatttgtggtgtacaacatgatactttgatatatgtatatgttgtagaatggctaaatcaagctatttaacttattatctcacagacctattttattatggtgagaacacttaaaatctacttagcagttttcagctgggtgcagtggctcacgcctgtaatcccagctctttgggaggccaaggcaggcagatcacctgaggtcaggagttcgagaccagcctggccaacatggtgaaacccagtctctactgaaaaaaaaaaaaatacaaaaaattagctgagcttggtggttcgtgtctgtagtcccagctactcaggaggctgaggcagggagaatcgcttgaacccaggaggcggaggttgcagtgagccaagatcaatgccattgcactccagctgggtgacagagcaagactcctgtctcaaaaaaaaaaaatctacttcgcagttttcaaatgtgcactctattgttattaaccttagtcagcatgatccgcagtaggcctctggaacttaccctcctgcctaactggaattgtgtgtcctttgacccgcatctcgccaggtccccctccccccagcctccagtaaccaccattttagtctctgtttctatgagttcagctgttgtacactccacgtctgataacaaattcttacataattaatgcaggtttgtgaaaaccttagttaaaaaactaatgaagacctgttctgtctttgttccgatgaagaatttacttaaaacggtatcagaggctaagtggaactatcccttatttggaacagcttatgacttaatgtgttttacactcgatttcctgccgtaaattgttaataccctctcaaagccgtgtaggagactcaccaatacctggagctggagcctatgctgacgatactgcaggggcagccgcagccactgggaatggtgatatattgatgcgcttcctgccaaggtatgacttcttagtttgtgaattttagagacctttggagaagatatttttttcttttaagatagaaaataatttttgaggctgggtgcagtggctcacgactgtaatcctagcattttgggagactgaggcaggtggatcacctgaggtcaggagtttgagaccagcctggccaacatggtctcgaactcctgaccgtttctactaaaaatacaaaaaatttagctgggcatggtggcacaagtctatagtcccagctactcgggaggctgtggtaggagaatcgcttgaacctgggagacagaggttgcagtgaaccaagatcgcgccactgcactccagtgtgggcaacaagaatgagactgtgtctcaagaaaataaaagaaagaaaacataatttttgtattgtgtaacctgaatttctgtgcacaagagcttcttagaaactgcatacaaacttgttgcctatcattttgataatgataatcattcaagttaagtaatcatagtcctgtgaaataaagtagtatttctcaccctgcttcccagatgagaatacttatgatctatttagtaattgatgtaaagctactgagtaaaggagctgtgataattgatggtaaaagtaggaagtgcagtcatcgtgtacctttaaccaccctagctagatgttgtgcccatgcacactactttcccctttgattgtagctgtttttctcattgaaaatctgtattctttttgagttctggccattacatttgactgtcggtatcattactgacagttattcagccaaagccaaaaataatattccacatctgaaattcatgggtggattagttgaaaagatagacactgtatcaaagtggacttgctttgtggatgctttaacagaagtaaccgactcttgttcatttatgtgtattctatcacatgtggcaattttggtggttttaatttctaacttcaagtaacccaatttggagttagtatttattctgagacactaaggtttcacctctgtttcaatcagctaccaagctgtagaatacatgagaagaggagaagatccaaccatagcttgccaaaaagtgatttcaagaatccagaagcattttccagaattctttggggctgttatatgtgccaatgtgactggaagttacggtaagttgtgtttggattttgtatttgtgtgaacttccaaatatttctaaaacatacactttttaaatattgttttgtacaatacactatattcaatagaaaaagagactccttaagtgggcattgagtaaatgttcattgatgatctcaagacccacagcgttaaaaatatacctaaaagcctctttggattgactgctggtagttatgacccagtctctgactagtagttcttatctttcacatgtgtcttaaatgaagtttagcttcagctccagtacacgttgacataggctaatctagtcaaatgtttatactaattaaaaatagacaaggataaattatcttccctatttcttttctattcattatttaaatgcctcagccatttagatcttctcggggctccaaagaacaaaatgtattactaattagtaaaccgaagaggttagcagaattatttttgcactgtttgaggcttgtctttcacttcatttactttccatatgagcctatcacagtttcaaagcattttaagatcagccactgctgattctcattagtgaattttcagatggggaagatacacagcttactgatcaatatgacttattaggttggactgcttattattgttctttgatcttttacttcccacagttctatatttgaaaaacttgtttgaggaatgctttattcttttttaagcactaagacacaaaagtcaataaaaattatgaaggggaaaagctttatgtatcaaataaggcagttctattgattccctcttaagaaataaaccttattagaaagctcaaagttggatttaacagaatgaaaaaaatgataattatataattgtggatgaatttacaggtgactagtttcttctatttaatgaccaaagaggaccctcccccaggtgtttgagcatgagaagatgaacttgattagacaaagcatcttgacaaattactcttgactcttcctgtgagagtagaagaatagggagcaatggtggggtatggggttatgaatgaatgatgagaatgttctagtggctagagaaataaaatgtgggagatgtgcctgaatagttttttctaagaaaaacacgtaagaacagttaaataatcgtagcagtgacagcatgtgtatagatcaacaacaacaacaaaaaccagccagttttctgaagttcaaagagatagtttaccagctacctcattcctttcatggactgttcactgctcagttctgaggaggatgacactagtgtatttccatgtggcttagacataaggtatacagtagccagtgtctagtcaaataagcagtatctgtattggttataaatatgtgcatcctatagttcaccaaacttctttctcatttttggccccaggtgctgcttgcaataaactttcaacatttactcagtttagtttcatggtttataattccgaaaaaaatcagccaactgaggaaaaagtggactgcatctaatccatctttactgtcaacatctgtatttaaagaagaaagaaacaaaggctgaaaaggctgctcactctcatcatctagtgttcctcatgtgttctaaagtctttttgtaaaataaacacaaaaataaatttatgttgaattggcactttctatatctgaaattgtattatctatttttatttaacctttcttatattatctgaagatgaatatgtatgtggctgtattttgtatatatttaagttttaagtgacacttggatttctgatcagtgttgcaaaaaattgctactttgagatttatttccacagtgatatattaaacccaaaaggaatcatcatatttggatgcttaaaatagagtatacaagttttttagacccaaagaaaaaaacagcagagtctcagcatgatcagtcctgattgaatttcattatgtcacagtgatgcatgtcttagcactgattattggttttacttaatattccctaaaaacttgaggaaggaagatgatagaacatgagatactctttgttttgtacatactagaaaatacagctatcttctgatgagcaattgtgttgattttctttgcttttttcctcttatggagctctcagtgtgtgaaagttctaaagccacaagaatcaatgatgttttagctgctaatatttagtattgatcgtttcttttaaaaatgatttggggaacttgatctgtactgtaattttactaattccttgtgcagaggtgggtatggcaattagaagtcaagaaatgggttgtttagcttggtttgtttccctaacttctgattaactctctgtatgacaactctacagaagttgtgcgcgtgctttctcagcagcatttttccttcaaaatcatctttttaatcaacagtcattaataaatgtacatgtacgatattcaaactttagaatttcagctgttttttctatgctcatcttatgttctttctaatttaggggagaaagctatcattttaagaacagtgtaagtcacttgttctgggaccttgctgtgtatcagaattgtttggggagcctctttctttaaaaatgccctctgtcccactaagtcagattctccataagtgaggacttgaaacctggaattagcaactactaatggcagccctacagcttcacactctcagagaaggaatcttcctccagggttatctgaggtatgctaacctgcttaaacctggtgctgggccttggaaaaagaaaaaaatcagatttaaacttgcggttacattaagatgatacttttgtatatttgctttccattaataaataaggcagtcatttacaaaatcaccaggaaaaggagaatgaagtattcatggcctgtcacttcccagcaaattgggagttgagctgacaaaagcaatccacatatgtttctaaaagatgttttctttttaagtcgcattcttcctcagagaaataatttccctatatttcttaagtaatggaattactttgtaaatacattcgtaaaattcagttttgactgtaatattatttaaataatatagatgtgtcttcttttgaaaagaattgtttgtgtgtccctagtgatgttgtatacggagggaacttctttgatgatgtgataccagtgttcacgggggttgtgggaaatacatgtaggaaactggtgaaatattaataacacagctgggaaagagaactgtgagccaatcagaaatacattgaatttggaagcggttcactaaaatgggaaaagcaagaaagtaacttgggaagggagccttagaaaatgtaatcatggtttaacttttttttttttttttttttgttttgagacggagtctcactctgtcgcccaggctggagtgcagtggtgcgatctcggctcaccgcaagccccgcctcatgggttcacaccattctcctgcctcagcctcccgtgtagctgggactacaggcacccgccaccacacccggctaatttttgtatttttagtagagatggggtttcaccatgttggtcaggctggcctcaaactccagaccttgtgatccacctgcctcggcctcccaaagtgctgggattacgggcgtgagccaccgcagctggacttgatttaactttttatgccagacagtagttaatggtttgcctcacatctgtcctggttgtatcattgtatagattgcatggctattacatagcataaggtaagggatctagttgcagaattttcttccccattctggcaagttgctttttgttgttgttgttgttttcctttgatcttataaaaaaatgttctatcacttgcctactgctaaggtgaaattagattgtcctaagcacatatatggattaagcaacttttctaagtgattctgagaacgaacatattgtcacttagatttttattatcagcttttgtattctctttctctctaaatggataaaaatttcagtgacaatatatatcaagtgacaatatctatagatacatgtagatatatataaagagaaaagtatatatgtatatgtatacatatataataagtatgtatatggaaagaggtataagtacttgccacctgattctattctctcctgttttctgcttacacctttcatctcataacattactattacagaatagcctaggagtgtagtgggcagtagtttgagcattcttttagctcaatttaacacccccacttagaaaaagaaactgatttttgatattagcaatattaaaatttcttgattaatactcctgagacttcagataaacatcactcaagtgctttgtgtttttagcacaataggcaaagaggaaaatgttaaccacggtatgtagtaaagattttggtagtttcatgctctttatttgctttgatcaatccctggaacttaaaaa

SEQ ID NO: 16326 - DNA, 73308 bp, Human
cagccagccctccatgaccacactcccaccgtgcactcacgtgcccctcttgaagcggctctgatcctgtgacctaaccagtttccacctggcttctctcagtgcgttgccatatagtataattttttgtttgtttgtttcgtgtagggttttgttggttcttttccaagtatcaatcaaaactacatgccaacgtccactccttggaaataattaaatgacatgacgtgcctgattttttcagctggtgatgcactgtaatttgcatctgctgaaggaatttatcttaagtcctgaagcccagccacttgagacaactgaggtgatttttctgctctgcttttgctcatgcggatggtgcgttattgttaaacacaaaagtggactaattgcttcattctgcaacctactccgtgaagaaagctgctcttctttgtgaagagaatatgttcatgttttgttcatgaattccatgcaatttcccatccccttgttaagtaatgtagcttctttatattggcaaaattccctttatcttgctgtgacctgcgctttgtcctcccgagcagagcaaatcatctgtggtttaagagcagctttggattcaagtccccttttctcctgtcgagggaagtgagtctatgaaatggccttcatctgaaagccacagcgaagcacctcctagcccaagtctagctgctgtgtggcagctccagcggcgtgaactgtgactgccctgcagacacctatcaagcgctgcgtcagctattaataataaaatcaactcttctccctcccccccgcgaggggggttccctcgtcagggcccagaacccgctggggaagaatcggggctggcgtgcgaaggagctggcggcagggggtgtaggatgcggtgttcccgaggcgacagatgaaggatttgggttgtgtgggaagtgaactgcggaattcctccccttggtttctgaggggggctctgaaggagccagattaggatgcagagcgcagcccgggcgaccgagggcgaggaggcgagccaaggacatcagcccgagggcgcctcgagacgccccgcgtggaccgcgctcccagctcctcggcctcgccttccaaccatccgcccaccggccccagagcagcgtgcccactgtgagcgccccaccctgcgtctgcaggtgggtgggtcagagaaccgcaggcacagaagagggtacccagcttcccctccgccagccccgcgaccgcggcgcgcgcggcctcgatccgggttcctaggggcggcgcgcgggagggggcggggcctgcgcggcagcgtgggcgccaggcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggcgctccgctgcaggggcccggcgcggccgggagagccagggaagatggctgaccgggctccacctcgtgggcttcggctccgcgcccgccgacagctgcgggcggagggtcgggccagcgcgccggccccgcgggagagaaaggggctgcggtcctcgcctcgccttccctggacctcttcgcttctcgggccctcgaccttttcggcgcgcaaggctcggaggcttctctccagcagcagccggccccggtggagggagggacgtggcttctgcagctaggttgagcccggcaagacgttttctcgtcccctgccgatttatgaggagtcgaggtcgttggaaggcctctgaccgttcttgtcctacccaaagttacacatctggcagaagtgatgacatcgctgaaaccactcctaggttcaggagcccgaagtgatttcacgcttagggctagacctcaggccattgattacaaagagtgcatgcttccttgagatatcttcgtggtatgccctctgctaaaaaaatcggatattcttatagctaggtctgtgttttaaagatattgatgcttagaattgtagcagttctttttagaaaaacgaagtgctaaaatgtctctctctttttttttttaacctccctcttgacacattgcttgacgaatttctacattctacagagttaccggctgaagaaggtaatcttaacatgctgtttctgttttttttcctctgttggtgtgctgatggtaagatgacagttaaaacacatgtgtttgtttcttacaggaaaaaccttgctggaacttgtgattgagcagtttgaagacttgctagttaggattttattactggcagcatgtatatcttttgtaagtataaaaaaatttattttctttccccccaaaagctgaaagtattccatagataaatcagaaaacaaatgatgtccattgggtgaaaacatatttggagttgcaagctgtgtctctatgtttaaaaacaatctgggcattttaaaattacaaaacaaaacacttgaagccattggtattcagaaaatagatgcctgacatttacagtgtggttaggagttgtcccagagtgtggcatggtcttagaaattcttgtggtttatcagcttttaatatcaaaaagttcttttctgggaagcctttaatgttttgggttcttccattgttatcgtgttgtaagatcatactaagatgatgttggactctttgtagtctgtaaatagaacttacaaaaggaatattccagttgctttcccttcctggtaatggcaaggtgacagttgttcctgacggtgacaagaatgatgacggctgtgatggcacccttgttgaccaaatttggtcactgacctttagggtggtatatttatctaaattggacccctgtcttaagtgattcttaggttgaaagaacaaggtttagtacagttggttctagatcttaaaggaaaaaaaccagcatggtgttttttcttgttctgtgtgtgcttacccacttgagtgctatatggttgctaagaaactagtgaaatgcaaagaactacagcagaaaaagggtgttggggtggcaagtatatttctaggtttttaacttttttttaaatgttcggtattaattttttgttgcattttttttcttgggcagtagattgcttgctagttttcctaaaaatggtcaggaataggacacagatgttcctaattctaatagcatgagatgccttttattcttgaattacgttattcttacaaaaaccacgataagtgaaattcacccagtgcagtacttctttctagttaaaacaaaattgacaaaacttcacggtttcagttcttgtacatatatgtatgcaggtcccagggatcagcctcagtctttgtgagaaccataccatagagggctattttgagaacgaaataaacaaagcagtgggcatttatttagttcagatgaggaaaagattaaatttatacccatcttttaagtagatagtggcagcagtaaataaatttgtggaataatttttacataaatcctgctatgatactttattatgccatattagccaagtattgtgtagccattaataattcagtccccaagaaccttttctgtggttttcattgattaaaatggggacttacatagcaaaccattcagcattctgagtcagtcacaatgtacctctgataaaatgtttcttcttgattgattaaaaaattttcccccagaaaatggctgctgttttaccaattaagggaaatgagtagacccgattaactatagtttatcaatacattgtcatggggcaaaataaatgatacatttggagctagtgtaagatttgtatttaactgggtacataatagcgttggcagttaaataatggggtccgataaggtcattgggaacttcttaaaaattaatcagctgactacaagccagaagcaaaatacatttttactgaattctctgtgttacaagttgaagcagtgtgggaaaccatgccactggtgttactattggggttgcactgggtctgttttttgagtggccagtttgagtgactttatattagcattttaaattaatgatgtgtgtgggttttgtttgttcattttttactttgaagtaattagaggcttatagtttgtaagcatttcaagcaggtttttaaataaatgctttaattttttttataagataggaccttggctttgtggagcattatagagctatattttggagttgaaatttgagctcctttttggtaactgtggagttactgctcaggaaatgaactgtgttacatttttattttatgagttggtaaatagcaaaagaataagtgtttagggagtacttctatagaattaatttgctttggtttgtttgatcaaggaattgcagatataagacctgttgtgttgattttcttcatgtggggttgggtactgctgctgcattgtctttagtgtttcattcctcctgtctgtatcttttaaaagaaagagcactgactctctttttgtgtcagtttattcctattgatgtaacagaaaaaacatggtagaatattcaggtttttttggagaagtgactaggcgattcttatatacatcatgcgtcatcaagtcatgcttaaattaaaaagaatattagtgacttacttcaaatatcaaactaagtagtaaactgttaactatagttaatattttgctgtggcatagaataggaagctatgcttgtgacctgtagggatctagtttaatttgtaatattggccaaagtgtttttttgaaacggtcacttggattgaaagaaataagcttcatcttccagtgcatatgaacattagaaattgcttaatttgacactgaagaccccccctctatcattcactttatcttttcattctcttcttgattaccaactttgttctaaatgtaacacatcgtatggttgcttaactgatgcctgtcctttcttctcttttcctgctttgttaagatatttattgagcacctgtcacagacactggggatacagtagtgaataaaacagacagagacccttacctggaggataatactgctgagaaaaataaagcaagggggtttggatatcagagtatgtgaaagggggaacagttttcaaattgggtggtccggaaagttcttgaggaaggtgacatttgcgaaaagatctgaaggaggtgggcattagggccatgttggtctcccatctgtctaaatcataaagtcataattaatatggtaataatttgcataggtttctctaccttccaccgtcgtttcccatgtcagctacttagattgaccctaaaatgctaataaaactttctagactgtggtacttctcaacctttaggttacatttgaccatttgcatgtgtgtgtctcttttcttcctactagacccccttgagttagtgcttttttttttttttttttttaaatgtagatggagtctcactcttgttgcccgggctggagcgcagtggtgcaatctcggctcactgcaacctccacctcctgggttcaagtgattctcctgcctcagcctcctgagtagctgggattacagatgtccaccaccacgcccggctaatttttgtatttttagtagagatggggtttacctttgttggccaggctggtctcgaactcctgacctcaggttatcacctgcctcagcctcccaaagtgctgggattacaggcatgaaccactgcgcctggcctaagttagtgcttttgatgtcacaaaaacttgggtgagtttgtttcagtagaattttctgaaaatacatgagatctttttactgtagtttctcagaagagaatactcaaagcatttgatactggatttgtagtgattttaattttcttctgtatcttttaatttttgattttaaaaatgggataagaagggcaaattactgattggtttaactagtttattcagagcttttcttaaaataatgacttgaaaggtggatttaatagagtactttttaaaaagattgttttctcatgcctgaaagcattgaatgtttttacatagctttatatctggatcagaagggaacgagttctaattcatgcttttttttccgttttattaatgactgaaagtcctcccccagaaattatcgtaacgtttattggtaattctctgtatcattctcgaaatgtttaatttccatttcctctttatttaaaaaaaaaaaaaaacttgatgtaaatttcttcatttattgagcaattgtttgagggcccaaaggcacagtgcaagtttctgagaatactaggagcaaaatgtgcttatgatctttttaagcacttttttctttcgttttctttttatgatactaagagctcttcctattatcacagtgtatagatatctgagtcacaatatcatgactgtctcccagtttacagcagaacgtgctttttaccttggattaaaatttgctttatttggccgggtgcagtgagtggctcatgcctgtaatcccagcactttgagaggccgaggtgggtggatcatttgaggtcaggagttcgagaccagcctggccaacatggtgaaaccccacctgtactaaaaatacaaaaattagccaggcgtggtggtgggtccctgtaatcccagctactcaggaggctgaggcaggagaatcgcttgaacccgggaggcggatgttgcagtgagccgagattgcgccactgcactccagcctgagtgacaaagtgagactccgtctcaaaaaaaaattttttttttgctttagtatacttatcagaagtataatgcagtacagagtgttgtacagtatttcagtgctgtacagagattaatcttgtggataataattgggagatactctatccctactctatttttaacagtttaatgtagttgagtgttcattagcaagtggttactttgaataatactggcacatttgaagcattgaacttgtttgataatgtatgtcccagaagacaggtattattgtatttagcacaaagcaaagggaagaagaaacactgtttatgtccaaaactatggggcagtggtcttctcttttacttttctttgctgctgttcatgaagcttgttaccttttcgctgtcttttttttgagacggagtcctgctctgtcgcccagattggagtgcagtggtgcgatcttggctcactgcaacctccacctcccagcttcaagtgattctcctgcctcagcctcccgagtagctgggattacaggcatgcaccaccacgcccgggtaattttttgtatttttagtagagacggggtttctccatgttgaccaggctggtctccagctcctggccttaggtgatccgcctgcctcagcttcccaaagtgctgggattacagacatgagccacctcacccagcccagataatccttttacacactgtttaaaattttcaattttcctggagatagggtctcctgtcgcccagcgggtaaatgcagtggtgcgattatagctcactgcagcctcagacacctgggctgaagcctgattcttgagcctcccaagtagctgggactataggtgtgagccatcatgctttgcccttttttttttttttttttttttttgaggcagagtctcactctgtcacctaggctggaatgtagtagtggcacgatcatagctcattataacctcaaactcctggtttcaagcaatcttcccgagtagtcaggactacaggcatgccctgccatgcccaactaattaaaaaaaaatttttttttatacacatagggtctcactatgttactcaagctagtctccaattcctggccttaagagattttcccaaagcattaggattataggcatgagccacctcacccagctgaaacagataattctttttttttttttccttgagatggagttttgctcttgtcagccaggctggagtgcaatggcgcgatctcggctcgctgtaacctctgcctcccggggtcaagcgattctcctgtctcagcttccccagtagctgggattacaggcgtccaccaccacactcggctaattttttgtattttagtagagatgggttttcgccatgttggtcaggctggtcttgaactcctgacctcaggtgatctgcccacctcagcctcccaaagtgctgtgattacaggtgtgagccactgctcctggcttgaaacagataattctttatattcaacctgttgtcaaaatttttagaaacattttcccagttccttgtataagtatactttgtataacttctggcaaaccataattatgaactcacattactatagtactataatactgcagtaagggatcttgcgtttcagtaatgtcactcatccagttttcctcccctttctcttaccccatctccctcccagtctcatggtttctgttgtcaatcctctttctccttacacaaggcaagaggttttcttaccaatagatcagaactgtgaaggactgcccgacatgatctgatatggttgttcttcattttgggctgtagtattttaaagtagaggtttgctctgatggtcccatcactgcttgccattgtctttccctttgctctagctatcaggggatgttgctttaagtttgttccccaggctttactgccaagagggaaattcatacccactttaacaaggtgtgaagcttatcttacagttgctaatgcctcactgaccttttggaaaggtcatagttactcttcaagttgagcgatttttctcccccaagagctaattaaagtttcttgtttctgatatgctctccttggcaaatgtttgaaagtctagtatcagagcagctgtgatcctgcatctatcaaaatttataacttcctagagaagttttcattctggcattattcctggccttaacactagaatgccctgttgaaagcatacagtaacatttattatactcattctggttgtctgtttgccctagctcactggacgttggtggtgattggcatctgtcaggacttggtggtcctggtgcctcctgtttttatttttctttttgtcctgctcaaacagatatttcttattcatgccgtcttctaatgagtcatttggattcattattgccataaatcatttggaggagtgttttcatgatttactaagtagatcttttaaagaagattttattatgaaatatgcaaacattttaagcaattttttaattaaaaaaaattcgacctccaagattaaatcattagatgtggttaacactgtttctggattggtaagtttccacaaaaagaggtttttaaatttttaaccacatagaccactctttaccatattcattattcttagtattcattgtggtgagttctctctttttaccacgtttatagttgttggattgggaagtgcagtgtgactcttactttgtagtttttaaatcttaacaagtttatagttgtatgagctaaaagtttaaacctctgccccattttcttggggcagtgttctgtgaccagttacatttttggacttaggttatctctgaagtgctgtgttgctgtataaatgtcatatggaggataacctacaaaatacacttcggatctcccaacagctttgcggttctgaaacagccttcagtagtaccactgaaaagaaacggggaattaactggttttttgtttcttttatagagatgagggtctcgctatgttgcccaggctggtctcaagctcctggcatgaaatgatcctcctgccttggcctcccaaagtgccgggattataggcatgagccactgttcccggcctagaattaaacagtttatatatgctctaaaatttaagtcagtgatcaagttgtttatactgtggatttatgtcacatggatattacttgatatgaataataactaaatgaacatgactgttagatgatcaccttttactttaatcaagaattgaagttttattttttctaaatagatacatataaaatgaatggaatttattccctctccccagattttatttggattctaaaatggaattattacatcaaaagataaggtatttttaagaagtatagttgtttttttgagactgagtcttgctctaacgcccaggctggtgtgcagtggtgcgatctcagctcactgcaacctttgcctcccaggttcaagcgattctcctgcctcagcttcccaactagctaggactgcaggtgtgcgccaccacacctggctaattttttgtgtttctagtagaggtggtttcaccttgttggccagggtggtctcgaattcctgacctcaggcgatctacctgtctcggcctcccaaagtgctgggattacagacttgaaccaccacacccagccatgaagtatagttttttgtttgttttttgagttttgcttttgttgcccaggctggagtgcaatggtgcgatcttggctcaccgcaacctctgcctcccgggttcaagcgattctcctgcctcagcctcctgagtagctgggattacaggcatgcaccaccacacactgctaattttgtaattttagtagagatagggtttcttcgtgttggtcaggctggtctcgagctccagacctcaggtgatccccccgccttggcctcccaaagtgctggaattacaggcgtgagccatcgcacccggcttttttttttgttttgagaccgagtcttgctctgttgcccaggctggagtgcagtggcacgatctcggctcactgccacctccgcctcctaggtacaagtgattctcttgcctcagcctccccagtaggtgggattactgacacacatcaccatgcccaggtaatttttttgtatttttagtagagacggggtttcgccatgtcggccaggctggtctggaactcctgacctcaggtgatctgcccgcctcagcctcccaaagtgttgggattacaggtgtgagccactgtgcccagctgaagtatagttttgactttcaagaattcttatgaacaagacatagccagttgtttatataattgcattttctaccgtttatttctagagaaagaaaatagattttgtctatcataatccctttagtgctagccactttttttttttttttttttgagttttcgctcttgctgcccaggctggagtgcaatggcatgcagtacactcacggctcactgcaacctttgcctccccaggttcaagtgattctcttgcctcagcctcctgagtagctgggattacaggcacctaccaccatgtccagctaattttttgtatttttagtagagatggggtttcgccatgttgggcaggttggtctggaactcttgacctcaggtgatcgcctgccttggcctcccaaagtgctgggattacaggcctgagccaccatgctcggccagtgctagccactttttaaaaaagtgacattaagcctaaaaagacacattctaacgtgccatttctcttctaggttttggcttggtttgaagaaggtgaagaaacaattacagcctttgtagaaccttttgtaattttactcatattagtagccaatgcaattgtgggtgtatggcaggtaagcaaaaattcctgtactgcaaaatttcaataagttatgtaagtgattagggctgtattaatctttctgttatctgtttttcctgatgtgttgagtaaaaatatgtttgcgggaagtttacatgtattttccctttattccataaattaattgttttctgacacagtctcactctgttgcccaggctggagtgcaatggtgttgtctcggctcactgcaacctcttcctcccaggttcaagtggttctcgtgcctcagcctcccaagtagctgggactacaggcacgcaccaccacgcccagctcatttttgtattttttggtaagagacagggtttcaccatgttggccaggctggtcttgagctcctgacctcaagtgatccgccctcctcagcctcccaaagtgctgggattacagacgtgagccaccatgcccggcctattaatttaattaattgcaaatttttgaccttaatgcatataaactttgcagttaagattgctcattcttcgccaagtgtggtggcaccagcctgtagtctcagctactcaggaggctgaggtgggagggttgcttgaacccaggaggtcaagactgtagtgagccatgatcgtaacactgcactccagtctgggcaaaggagcaacactgtctcagaaaaacattgttcattctttacggtagcaaggaattaaaatgggtgagagaagctgcttaaggaaatgagaatgtgagaaccattatctttatgtctcctagttgcttcctgtgacaaactttaaaagctacatgtcatttttattctccttgggtttttttggtaggtttagctataaaaattgtttccccttcagtgcttactacagactctgagacttaaaattcatgttaagtgttgatcttttaggtatttgacggatataatcacccctttgaggactgaagtagaccttttttttgtttttgttttgagaccgactctctgtcgcccaggcaggagtgcagtggcacgatctcggctcactgcaacctccgcctcccaggttcaagcagttctgcctcagcctccttgagtagctgggattacaggcacctgacaccacacccagctaatttttgtatttttagtagagacggggtttcaccatcaggctggtctcaaacccctgacctcgtgatccacccacctcggcctcccaaagtgctgggattacaggtgtgagccaccactcccggcctttttttttttttttttttttgtttgtttgtttgtttgtttgttttgaccgactttcactcttgttgcccaggctggagtgcaatggtgcagtcttggctcactgcaacctccacttcccgggatcaagcaattctcctgtctcaccctcccgggtagctgggattacaggcacgtgccaccatgcccagctaacttacttacttttaatagagatggggtttcattttgttggtcaggctggtctcaaactcctgacctcagatgattccccctgccttggcctcccaaagtgctaggattacatgcgtgagccaccacgcccgacacatcttataaacatacttagtcctgttgaaattgtaaacttctaatctttaccaataaatgttaacgatctttatgtggtaggttcatagaaagatggcctacttagagatttgtaattgtgccatatatatgtgtgtgtgtgtgtgtgtgtgtgtgtgtgtgtgtgtgtatatatttttttttttttttttttttttttagatggagtcttgctctgttgcccaggctggagtgcagtggtgtgattttggctcactgcaacctccgtcttgtgggtttgaacaattctcctgcctcagcttcccgagtagctgggattataggtgactgtcaccatgcctggctgttgttttttttgtttttttgagacagagtctcactctgtcacccaggctggagtgcagtggcatgatcttggctcactgcaagctccgcctcccgggctcacgccattctcctgtctcagcctcccgaatagctgggattacaggtgcccaccaccacgcccagctaattttttgtacttttaatagagacggggtttcaccgtgttagccaggatggtctcgatctcctgaccttgtgatccgcctgcctcggcctcccaaagtgccgggattacaagtgtgagccactgtgcctggccttcttcttatgtttttctcaaaaaaattatatttggtcagggcatggtagctcatgcctgtagtatcagcagtttgggaagctgaggcgggtggatcagttaaggtcaggaggtcgagaccagcctggccaacatggcaagtccccgtcgctactaaaaatacagaaagttagctgggtatggtagcatgcgcccccagctacttgggaggctgaggcagggcttgaacctagggggcggagtttgcagtgagccgagatgatgccactgcactcgagcctgggcgacagagctagacttcgtctcagaaaaaaaagattcgagtttttaaaaaaagaacattcttaagtctttagtatactgaatggtatgagcagcaatagagggttgtggccttctgaaagtaaggaaaattataatgacagtataaggtagtatgaggggcatagtcttttatttctgaccagtgtcatcaaggagggctttattttttttaagacggagtctcgctctgtcaaccaggctggagtgcagtggcacgatcttggcccactgcagcctccacctcccggactcaagagattctcccacctcagtctcccaagtagctgggattacaggcgtgcaccaccacgcctggttaattttttgtatttttagtagagacagtttcaccatgttggccaggctggtctcgcactcccaacctcaggcgatccgcccacctcagcctcccaaagtgccgggattacaggtgtgagccaccatgcccagccttttcattgattgtaattgtcatctttgttctcagggtcagagataatttatcttttttttcccccaagacagcttcactcttgcccaggctggagtgcagtgtcataatcacagctcactccaatctctgcctcgcaggcttagtgatcctcccacctcagcctcctgagcagctgagactgcaggtgtatggcaccatgtcaggataatttttgcatttttcgtagagacactgtctcgttatgttcagcccaggttggtctggaactcttgggctcaagcagtcctcttacctcagcctcccaaaagtgctgggattacaggcatgagctactgtgctcagctgataatttaagcacatgcaaaatacagtgctcatgggatatttgtttaaccttgagcagtccagttaaattccacccaacatgatcttgaagggtaagaatgtctgatatgagattgaaattaactttatcatgaatttcccaattaaggtttttttatactttttctggggtatatacatcaaaactgaggtacacgtgttaccagctttcatctttgtgtcatttgattctctttaggctggtttgattctacaacttccattctgaaatcgggaagaaaattactgtgacttctaacggttgatagttcatatatgatgtcatgagaaatatatagcttgggactggcagtgctatgatgagagtccagccattcattggtctttacaactggagggatagttcttagaatttgtgagagatactcatcactcatagcatttactgtgtgcccaaacacaatctaagcatgttacatatgacttcttatcctcacaaaccttgaggtaggaactgttagtgttgtcattttatagacagtaaacttgtgtgttgtgtaacctctctacagtgacatagctgttaagagcctgtattgaacctgggcagcttagcccagagttgggttgggttggggttttttttgttttgttttgttttgtttttttgacatagtctctttctgttgcccaggctggagtgcagtggcaggatctcgtctcactgcagcctccgcctctcgggttcaagcgattcttctgcctcagcctcctgagcccagactattaagctgtactgcctctcatgagacagaattgattttaaatggcagggggatttggctaaaggtgaaagctgtgttttacagtcttagggacagcagagtctgtaattgcttttcctcattgttttatccccttagcttaattgagggtacttaacgtttcgtttttaatacaaattaataaatgtccttgtgtctgttgccttagatgtgaattgtttagtacaaatgttactggtgggcttcctttctttttaaagattagacctctaacattttattccttgggttagaaataattgcagtgtcaggcaggtctttactactcttctgttttcttttatacaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctggtgagttgagtttgtcatttttcttttattctagatagtatttctgaatgtagtccttttctcaaggctcataattatatttaaaataattgttttcatgtatcaattaacacattttattgccattcatacaaatcctacattctctaaaattattttgaaatgttttagcacctcccttcctgtcattgataaggcttttggtttttgtttttaaacaaggtattttgaattctacttgtttaaatacattgtagaacacaagtgctagagaggtaaaacctaatgttgatttgacagttagttatagtgaacaatttgttagaatactggctaatgacgacacagtttttcctgttttgtttcttggcaccaaagttcatggtcaagggtaatttcttgactctgaaagctatgcttggccaggcttggtagctcacgcctgtaatcccagcactttgggatgccgaggcaggcagatcacgaggtcaagagattgagaccaccctggccaacatgaaacctcatctctactaaaaatgcaaaaattagccgggcatgatggtgtgtgcctgtagtcccagccacttgtgaggctgcagcaggaagaatcgcttgaacctgggaggcggaggttgcagtgagctgagatcgcaccactgcactccatcttgatgacagagtgagacttcatctcaaaaaaaaaaaaaaaaaacagtatgcttaaaaatacttatgtgttacactgagccaggagtctctgcctgaattccagagatagcttcaaagagtccatgaatccactgtgagtccagaatgctccacagacctccaagggtcagtatcctcactgctgtagattagtgctgtttttttgttttgttttgttttgttttttgagatgggagtctcactctgttacccgggctggagtgcagtggcatgatctcagctcactgcaacctccacctcccaagctcaagcgatcctcccactttgccccccaaatagctggtaccacagatgcatgccactacactcgcctaatttttatattttttgtagagagggagttttgccatgttgctcaggctagtctcaaactcctgagctcaagtgatcctgccttagcgtcccaaagtgctgggattacaggtgtgcccagcagccatatttctgacagtccaaaatcacaacacccctgggaccaaccaggatagtctaggtgggttgtttgttttggctatttcacttagagagtcattgcatactgttattcagattatctggcttttcatacccttctgagttaagtatactatttactttgttgctatttgtgaattatctcatagtaatatgcttttatattgacttgggaagggtgtgctttgtctttattgtcttactcattttaatgaattgaaagagctgcattccttaacccatgctctacaactttggcctctgaaaggaaattgccttgtcctattctctcatccagaaatttttgttgttcctccagaaaaaaaggatagtgttacatatatgccagtaagccaattatttgggactgtgtagtgtttgtgtgtaaatggtgtgtgtaaatgatttaacagcttccttaagtatagtgttaagaagagtacaactcagaatgaaatgtcttggctattggattttttaaaacttcctgttttggccaggcgtggtggctcatgcctgtaatcccagcactttgggaggctgaggtgggcagatcatgaggtcaagagatcgaaactatcctggccaaaatggtgaaaccctgtctctactgaaaatacagaaatcagctgggcatggtggctcccacctgtagtccgagctcctcgggaggctgaggcaggagaatctcttaaacccaggaggcagaggttgcagtgagccgaggtcgtgccatttcactgcagcctgggcgacagagccccagactccatctcaaaaaaacaaattttctgttttgacacaaatgttatactatcacagatgtattattttttcactctgtatacacacatttttgtatgaactgttgaagggtatattgcaggcatgatgcccctttaactcctaaataacatttgttttatagtatcaaggatgttctcttatataacctcagtatgattatcagaattaggaaattgatgcaatagtatgtaagatcttattcagaatttaccagttatcactttttttgatgaggggaagacagggtctcaatctgtcacccaggctggagtgcagtggcaccatcacggctcactgcagcgttgacctcctgggctcaagtgattctcccacctcagcctcctgaataactgggatcacaggcatgagcaaccaagctcctagctaagttttgtatttttttgtagagatgggtcttgccctgttgcccaggctggtctctcaaactcctgggctcaggcagtcctgcctcagcctcccaaaatgctgggattacagacgtgagcccactgcgcctggcccacattttttttaatagcaaaaaatatttgaattagggaattctgatggtgatgaagaaaataggtcagaatggggaaggctgaagatatagggaggctattttagtagtctaggcaagagataatgaggacagtaacattaagaataatgaaggaaagatttttgagttcatgaatagtggctcttaagcaggagtgcacatcacaatcatctgggggcactctttttaaaaaagtttttggcaggtctcaacctagaatattaactctgaatctccattgggtacagagttctgatcgtgagtagttcaaagagtgagcctctgacttagttacaaaacagcagatttgttttgttttgttttgagatggagtttcgctcttgttgcccaggctggagtgcaatggcaccatcacggctcactgcagcattgacctcctgggctcaagtgattctcccacctcagtctcctgaaaaactgggatcacaggcatgagccaccatgtacctggctaagttttgtattttttttgtagagatgggtcttgccatgttgctcaggcttgtctctcaaactcctgggctcaggcagtcctgcctcagcctcccaagtagctgggattacaggcatgcgccatcatgcccagctaattttgtatttttagtagatgtggggtttctccatgttggtcaggctgatctcgaactcccgacctcaggtggtccgcccgcctcagcctcccaaagtgctgggattacaggagtgagccaccacgcacggcctaaagcagctccttccgtcagtctgtccgtccgtctgtccttccttccttcctccccctttccctcccctcccctcccctcccctcccctccttctgtcctccctcttttccttctttctcgctctctcttttttttttttttttttttaacttggagacaggggcttgctctcttgtccaggctacagtggagtagtgtgatcactgcgacctcgaactccttggcttcaagggggtcctcctgcctcagcctcctgagtagctggtaatacaggcacatgacaccatgcccagcttttttttttttttttttttaaagacggaatcttgaactgtcgcccaggctggagtgcagtggcacgattgcggcccactgcaagcttcgcctcccaggtttacgccattctcctgcctcagcctccccagtagctgtgactgcaggtgcccaccaacactcccagctaattttttgtatttttagtagagacagggtttcactgtgttagccaggatgacctcgtgatcctcccgcctcagcctcccaaagtgctgggattacttacaggtgtgagccaccatgcccggcctttttttttttttttttttaaagtaaagatggggtcttgctttgttgtccaggctggtcttgaacttctgggctcaagcgatcctcctcctcctgccttggccttccaaagtgttgtaattacaggtgtgagccactgtacctggctcaaagcaacagattttgataatagataggagagtgtgtaaatcaaagatactggcaagatttctagtttacgtgactgggtgtgatgatggtactctactacctacagaaggaaacattggaaaggagattgtttttccacaaatatatgtggtgggtgaggttgtagatgacatcacctaaatatgtgtatgagattctgtttgattttatgcttacagtttctccagcttcttcttgtttaatttttttaaaaaaatagagacagagtctagctatgttgcctaggctggtctcaaactcctggcctcaagtgatcctcttgccttggcctcccaaagttctgggatttacaggtgtgagccactgtgctctgccttgttgggctgttttagtgtgttgagtctacttgaagccttagagaaattacccccaaagcctttatccttagtttgcatcagtagatggcaatggtagacagcttcagaggaaactacaactgtgatacctcaaagcaccatcctttttgaagaaagagacaaaagccagcttctcttcagttggtgattctggtttctctgtatctttgaatcctgattcttgccagtccttcccgtcttttgtaagacactctaacctaattaactgtgagaaacttggaagtcatcttgattttttcccccctcttatcctctgatttgtccgtaaggccactgattctgtctccagaacacacccaagttcgtgaactccgtttccttggtcagcacactagtctagccatcatctcacaccgcagctgtcatcatctcctaactaggctctggcttcctttgttgtcttcctccagtccattctccacacaagtgccagagtggtttcttaaaggttgtgttatttattcatctgctaaaaaacccttaagggacttccccattgcacttaaaatacaaaattctctgacctgataaacttgcattgtgtgtatgtacctcctgctttcttctatgatttcatcttgtgctgctccttcatgttgcagacatccaggcctttttttcagttttcagtaccaccaaagtcacctttttttggaaggttaggcaaattttatagagtttattaatttgctcaatgcactgatcttatggtggtgaagctttgattattaccctgacctatctcgctttctcacactgaaatttcattttctatattgtaatatagttttgttgttgcatttgatagtttagaaaggacaaataatgtttgatctatagtgtatgtgacttaagattttcagtctaatgggattttccttatttatattgtggtaaagtatacatattataaacttacccattttaaccatttttaagcgtgcagttctgtggcattaagtacattcacattgttttgggactgtcaccatccagaacttttatcttccctaactgaaatgtacaccttaaacactgacttccagttcccctcttccctggcccctggcaaccattccctttatttgaatattcaaaagacaatgaatttaatattcaaaaaaaacctgagtttaaatcccttaggtgaatatactactactataaagtggagtacaaatttaaatccattttcctttcacctgtttctgaatccttcatagatagtgctgattctggtagttatttaccactttttttccccagctcttcccccacagtatggtaattgctaaaaagcgtatatattgctttgacgttgggctctgtttttctttaatttttatttttattactattattattattattattattattattactattttgagacagggtctcactctgctgtgcaggctggaatgcagtagcgtgatctcggttcactgcaacctctgcctgcctgttcaagtgattcttgtgcctcagcctcccaattagctgggctcaccagcatgcaccaccacacccagctgatttttgtagttgtagtagagatggggttttgccatattggccaggctggtctcaaactcctggcctcgtgacccactcacctcggcctcccaaagtgctgggattacaggcgtgagccaccgtgcctggcctattattattttagttaagcccagctgtgtgagacattgggctcttaagtgctgcttgctttcgtcttaaattgtgacctttttaactgagtaatgcagaacagacatctaggtttagaatgtatgtgggcattttattaaatactgttgtcatactactaggcagtgagcaccttaaggacagaactgtcatattgactgttgtaacgttatcgtaagttctctatgaatgaaatttgaaatcagaagtatatgataggctcagctaatgtaaacatagttgctgtgcagaacaaacagttgaagtgtatgtgtgtgttcaatacaattattattataatattatacagacagagtcttgttctgtcacccaggctctagtgcagtggtgtgatctcggctcactgcaacctgtgtacctcccagtttcaagtgattctcctgcttcagtctcccgagtagctgggattacaggcttgggccattatgcctggcttgcttgcttttttgtttgtttgtttgtttgtttgttttgagacgagtctcgctctgttgccaggctggagtgcagtggcatgatcttggctcactgcaacctccgactccctggttcaagcgattctcctgcctcagcctcccgagtagctgagattacaggcacgtaccaccacgcccagctaatttttgtattttttagtagagacggggtttcaccgtgttggccaggatggtctcaagcccctgacctcgtgatccatcctcctcggcctcccaaagtgctgggattgattacaggcatgagccaccgcgcccagccacgcctggctaatatttttgtatttttagtagaggcagagtttggccatgttggcccggcaagtcttgaatttctggcctcaagcgatccacctgcctcagcctcccaaagtgctgggattacaggcgtgagccactgcacctggccttcaatacaattattgaatgccagattattagtatattcaaggtctgtgtgatcctcattattatcttaattccagaacattttcatcaccctcagaaaaacccatacccattagcagttgttgccctgttttcctcccaccagttcctgacaaccacagtttattatctgttttgtggattactgtctgtttttctggatattgcatataaatggagtcaatcttggtgactggctttctcttagcatagtgttacatttcgttcatgaatatagcatgtatttcattccttactgctgaataatgtttattagttgatggacatttgggttgtttccagttttggtctattatgagtaatgaatagtgctataacttgtacatacatgcttgtactaatttttgtgtgaacataacattttctctctgttaggtatgtacctaagcatggaattatggggcctatagtgactctatacttaacattttgagcagctaccaaactgtctttcagaatggtggtgatattgttctacattcccaccaacaatgtatacaagttccagtttctctacatccttgtcaagacatgtcattgtctatcgttttaaagttttacccaggaagtgagtatcattgtggttttgacgtccgtttccctaatttcttaatgatgttgggcatcttttcatgtggctattgtccatcggtgtgttttctttggagaaatgcctgtttaaattaggttatttgtctttttaatgttgaggtataagaattctttacatatcctgccttatgaggtgtgattagcaaaattttttccccattctatagggattcctttttttcactttcttgatggcatactttgtaacatacaagtttttaatatgataaagtccacttatacattgttgttgcttgtgcttttggtgtgatgtctaagaaactgttgccaattgaaggtcacaaagactttatatattagccagtatatatgatccaggcgtcgtggctcatacctatatgatcccagcactttgggaggctgaggcaggaaaaaccacttttttttttctttttgagacggagtcttgctctgttgtccaggctggagtgcagcgagtggcatgatctcggctcagtgcaacctccgcctcctgggttcaagcgattctcccgcctcagtctcccgagtagctgggattacaggtgcacaccaccacactcagctaatttttgtatttttagtagaaacggggtttcaccgttttggccaggctggtcttgaactcctgacttcaaatgatccgcctgcctcagcctctcaaagtgctgcgattataggcaagagccaccatgcccagcctaggaaaaaaacacttttaaattagccaggcaaggtggtacaggcctgtagtctcactactcaggaggcagaggtacgaagatgacttgagcccaagagtggaggctgcagtgagctactatgatcctgccactgtcctccaccctaggcaacaaagcaagaccttgcctctttaaaaacagcaacaacagcaaaaactatggtgtgaggtaggagatccagctgctttcttttgcatgtggatatttagttgtctcagcaccatttgttgaaaagatttcttcactaatttgtcctgcaacctttgtgaaaaattaatttacaaatgcaagaatgtatttctagactctattcttactccattgatctctgtctttaggtcagtaccatactgtcttgatagctagctgtcgttttgtattttttgaaattgggaacttgggagtgtaactttgttcaagataattttgggcattctgggttccttacatttacatataaatttttaagagttgcttgtcaatttctgcagaaagcaagctggtattttcagtaagaattgtgttgtatctatagatgagtttgggaaatatggtcgtaatatcaagtctttggatccatgagcatagggatgtctgttttttttttgttttttttttttaaggtctgtcatttctttcaacactggttgtcagtgttcaagtcttgtgcttcttttgttattgcatttttggcggggggaatatttgtaattggaataattttttgtaacttgaaattggcctattggtgatatttatttatttatttatttttgagacggagtctcgctctttcaccgctatgacaggctggagtgcagtggcacgatctctgctcactgcaagctccgcctctcgggttcacgccattctcctgcctcagcctccccagtagctgggaccacaggcgcctgccaccatgcccagctaatgtttttgtatttttagtagagacagggtttcaccatgttagccaggatggtctcgatctcctgacctcgtgatccacccgccttggcctcccaaagtactgggattacaggcgtgagccaccgcgcccggcctagtgatatttatttttaattaaaatttttagattcaaggtacatgtgcaggtttgttatgtggatttaatgtgtgatgctgaggtttgggcttctgctgatcctgtcatccagatgatgagtatagatgatgagtatagtacttcacagatagtttttcagccctcgcccctctttccctcccactttttggagtgcccagtgtttattgttcccatcttaatggctatgtgtactcagtgtttagctcctacttacaagtgagaacagacagtatttggttttctgggttaactcacttaggataatagtctctggctgcatccattttgctggaaaagacatgatttcattcttttgcatggctgcgtagtatcacatggtgtatatataccacatttatttttgagatagggtctcactctgtcgcccaggctggagtgcagtggtgcgattttggctcagtgcaacctccacctcccaagctcaagccatcctcccacttcagcctccttgtgagttcaggccatcctcccacctcagcctccttgtagctggaactacagatgcccaccacgcccaactaatttttgtatttttcgtacagataaggtctcaccatgttgcccaggctggtctcgaattcctgggctcaagtgattcacccaccttggcctccgaaagtgctgagattacaggtgtgagccaccacgcccggccacaatttctttttcttgggatatatacccagtaatgggatcgctgggttgaatggtcattctgtttttagtttcttgagaaatctccaaacagctttccacgggggctgaactagtttacattcttgccagcagtgtataagtgttccccccagccccaccaccttttttttttttttttttctttttttttgaggcaggatctcagtctgttgcccaggctggaacacagtggcatgattatagctcattgagccatggctttccaggctctagtgaccctcccacctgagccttccaggttagctgggactgtaggcacacaccactatgacaggctcatttttaaattttttcgtagagatgaggtcttactatgttgccctggctagtagttgaattcctgggctccagtgatcctcccacctcagcttcccaaagtgctgggattacaagcgtgagccaccgtgcccagcaataatagtcactctgactggtgtgagatgacatctcattgtggttttgatttgcatctctctactagtgatgttgagcattttttcctatgttgactacttgattgttgtcttttgagaagtgtcttttcataccctttgcccacttttcaacagtgattttgtgtgtgtgtttgtgtgtggatttaagttccttatagattctggatattagtcctttgttgagtgcatagtttgcaattattttctccaattctgtaggttgtcagtttactctgttgatagatttcttctgctgtgcagaaactctttcgtttaactaggtcccaattgtcaagttatttgttgcatttgcttttgaggcttagtcataaattctttgcttagggcagtgttgagaagagtatttcctaggttttcttctaggatatttacagtttgaggccttacatttaagtctttaatttgccttgagttaggaattcttttttcaatttcattttcagattgttctttgctagcgtgtagaaatagttttttacgtattgatcttgtagtttgccatcttgctgaactcattagttagttttaatagtttttatgggttccttaagattttctatatacaagatcatgcatttgcaaatgaaaatgtttttacttctttctagtctggatgccctttatttcttgcctaattgccctggttagaatctccaatacaacgttgaagtaccaagagcagacatccttgtcttactgatcgtaggggaaagcatccagtccttcacagtgaagtgtgacataggtgtgggtctcataggcgggtgccctttatcatgttgaggaagcctagttacagctgtaatatttaggttgtcagtatactctggtgacctttcatggtgtttgtaaacttatatgcaaatcagaaatgatagtttgctgggttactaggaccagcaggtcattgaattgggtaagatataattctaaggcatttgcaactattatatggaacattttggaaaagcataccgtgactgtataacctgggccagataaataggtatttattttattaagactatacacgttgagccttttaaacttccacctcttttagaattagtaatcaaattgactgtgcaatctagcatttagcctgataattcagttttgtgaaaactatagagtgaactttaattctgaattttttcttgtcagtcgaaggtactatttgcgtagcctgaaagattaaatggcataaattgtgcttttagacatggtgacttttatattttcatttacattatgaaattggatgtgaaggggtttttcagatgtgttggaaaactggagagtgttgtaaactaattcgaagctgaaaataaaaaagtactgacttaacgattttgatatttgcagaaaggaacagacctttttgtagtcactgtttggaatgtaagggtcatctcctgactttaaaattctttgtcagcttttggaagatatctggtaggatggttctggctgaacttttcaaagactaagctggaataggtggttttttgagggagatatggagagagagtttaaggaaactaatttttttttttttttttttttttttttttttttttgagatggaatctcactctgtcgcccaggcaggagtgcaagggcgtgatctcagctcactgcaacctccgcctcctgggttcaagcgattctcctgcctcagcctccctagtagcagggattacaagtgcccgccaccacacccggctaatttttgtatttttagtagagacagggtttcaccatgttggccaggctggtctcgaactcctggcctcaagtgatccgcccgcctcagcctcccaaagtgctggaattacaggtgtgagccaccatgcccagccaggaaactaaattttatatgttgctataccagctaatcattccaaagagaaactgggtaagcatacatagcaaatgctaatgtgagtcttaagtatctagaacacaagagccaaatgaaattgatatggcaaataaaaacatggagaaaataacccgcacataggctgtgctcagtggctcatgcctgtaatctcagcacttttgggggaggccaaggcatgcagatcacttgagtccaggagtttgagaccagcctgggcaacatagtaaaaccccatccctacaaaaaatacaaaaattagctaggcgtggtggtgcgtacctgtagtcccaacgacttgaaaagctgaggtgggaggatcacctgagcccaggaggtcgaggctgtggcagtgagctgaaattaagccactgcactccagcgtgggcaacagagtgagaccctgactcaaaaaaaaaaaaaagagaaagtgacccacatgttcacctcttaagaagccacagtaattctacattatcttaaggccaagaaaatatttctccggatggatggaaaccaaaagtagtgaagttgtacataatcttataagaaatgaacgtcattgtttttaagctttctgtattatctgctgacatgaaagtgaatcaagctataatagcctaagtcatttctgttttctttttttctttttccttttttttttttaaagtagagacgggattttaccatgttggccaggctggtctcgaactcctgacctcaagtgatctgcctcccttggcctcccaaagtgctgggattacaggcatgaaccaccgtgcccggccatggttttgtgggatgtttttttgagacaaggtctccctgtattacccagcctagtctcaaactcctgggctcaagggatcctcttcccttggcctcccaaagtgctgggattacaggcatgagccaccattcccagctagaagtcttagttttagaattttggggcttctagtatatgccgcaggggttatttattgacttcttaagaacactgttttcagggttgtttaaaacaaactttatgtatcttggtaacccagggttgatgaatagcaccaggaaataaatattctcagatgacttctgtcttgtagtatatactctggagcgaatcatcttttaagatttaagtagtggaagcaacacaatcttaaaattgcatttgctttagcacttgtacagaaattgataattttatttcctaaaatgaagacttaatagccaacagggtgccagcaatttcaagatttactcgggaataaaaagaataattcttaaacttgacagcaatttaaaggaagaaaactttcaatttaaaggaaggaaacttttacttcagacagttaacatgcagtactgagatttagtagcaggtataaactgcttttgaagcagttgagtaaaaggcagagttgtgaaatagatgagtggattcatataagaacctggattatgatcctagttctgcatgacattggactatgtacattaacctctgcagaattaggtaattggagtactgtttcaaggagctttcttgctctaaaaagtgtgatttagatagtatggccatgagtccatgtggacttttttttgcttttagaaagctgttggggttggaattgactggctttaaacatttagcaaacattaaatgctctttaacacaaaacagagtagtcagtctgctgtagagcagaggagttggcatactatctttgtgggttggttggttggttcgtttgtttatagacatgaggtctcactgtgtcactcaggctggtcttgaactcctggcctcaagtgatcctcctgccttagcctgtaatcccaggtctttgggaggcggaggcgggtggatcacaagatcaggagttcaagaccagcctggccaagatggtgaaacccccgtctctactaaaaatacaaaaattagccgggtgcagtggcaggcacccgtaacccgtaatcccagctactcggtaggccgaggcaggagaattacttgaacccagggggcagaggttgcagtgagccaagatcgcgccactgcactccagcctgggggacagagcgagactccatctcaaaaaaaaaaaaaaaaaaaaaaaaaaacgctgggattataagtgtgagctatagcgtccagctaatattttgggttttgtgggccacaacaatctctgtaccaaagtcttttgtaaaatatgaaaagagaattgtttaaaaaaaaaaaaaaaaaggtgttggctgggtgcagtggcttatccctgcaatcctagcattttgggaggccatggcaggaggatcacttgagcccaggagtttgagaccagcctgggcaacatattgagaccttgtctttacaaaaaaagttttaaaaacttgcatagtgaggctgggagccatggctcatgccagcactttgggaggctgagacgaggttcacttgagctcaggagtttgagaccagcctgggcaacatggaaagaccccgtctctaaaaaaataaaaaatgaaaatttgctgggcatgttgacgtgctcctgtagtccctgcttctcgggaggctgaggtgggaggatcagttgagcctgggaggtcagggctgcagtgagctcagatcgtgccagtatgctccagcctgggtgacagagtgagacagagtaaaactctgtctcccaaaaaaagttcggggggtggggagccttaagattttgcacactgcttagatcaatgtttctctaacttcatgtgtgcaggaattacctggggatgttgttaaaatgtatgttttgattggttcagtctgaaatggggcctgattattctgcatttctaataagctcccaggtcaataatttgagtagcaaggctctagagcagatcttaatcatttctagatcacagtccctttgagaattaatgaaatttatggactttcttccccaaaaacatatattgaaaatcttgtgtgcaacttcaggaggttcatttgtcctcctcctcagaaagtccacctcaggattctagctatttagttttgaaaactgaagtacaggccgggcatggtggctcatgcctgtaatcccagcaatttaggaggccaaggcaggcggatcatttgagcccaggagttcgagaccagcctggccaacactgtgaaatcccatcttcactaaaaatacaaaaattacccgggtgtggtggtggatgcctgtaatcctagctacttgggtggctgaggcacgagaatcgcctaaacccaggagatggaagctgcaatgagcctagattgcacaactgcattccaccctgagggacagagcgagactctgttgcaaaaaaaaaaaaaaaagaaaacaaaacaaaaaagaaaaattgctttagttgttctgtaaatcctggaagctatacctctgtttccaaagccaaggtataaattattactctagaaaacggataagcagaagagcaaaatagtctaaaacaaaaatcagcatagagagtttttgagtttgagagcccctgagcactgtcagaatagctaagacattaagaactgtgagaaatgagagttctcctcaaccatcagaccatgataggccagttgatcttgaagcctgacctgatttcatggggctggcatttccttcctgatttcctgtaatcacctcctctctactccccatgattcagtggtagtcacagtaccaggaagtgccaaccttttcattcttgctactgagatgaagattttggaaaaaggagaagaaaccatgtggtttgggaaccacctttccttttttttttttttttttttttgatacggagtcgctctgtcgcccaggctggagtgcagtggaatgatctcggctcactgcaagctccgcctcctgggttcacgccattctcctgcctcagcctccccgttagctgtgactacaggcacccaccacaatgtccggctaattttttgtatattttagtagagatggggtttcaccatgttagccaggctggtctcaaactcctgacctcaagtgcttcatctgccttggcctcccaaagtgctgggattacaggtgtgagccaccgctgctggccatgggaaccacctttcctaagcattaacaccaaaccacctagatgggcagatttaactgtgaccaacttttatattaaaagataatggaacttttttttttttttttttttttgagacaaagtctcggctctgtcacccaggctggagagcagtggtgcaatcttggaccactggaacctctgcctcctgggttcaagcgattcttctgcctcagctttcccattagctggaattacaggtgtgcaccaccccacctggctattttgtattttttttttagtagagacggggtttcaccatgttggccaggctggtcttgaactcctgacctcaagagatccacccaccgtcagcctcccaaagtgttgggattacaggcatgagccactgtgcccggccgataatggaacttttgaaaaccaagggcttggtggccgggtacactggctcatgcctgtaatcccagcactttggaggccgaggcgggcagatcacctgaggtcaggagttcgagactagcctgaccaacatggagaaacgctgtctctactaaaaattcaaaattagctgggcatggtagcgcttgcctgtaatcccaactacttgggaggctgaggcaagagaatcacttgaacccaggaggcagagtttgtgctgagctgatatcgtgccattgcactccagcctgggcagcaagagtgaaactctgtctcaaaaaaagaaaaaaaaaaaaaaagtaaaacaaagggcttggcattatcagtgccagaaaaatacaagattgagagaatggggaaacaggagggacataaacttggtgggagtatacatttgtatgcaaaagtaaaagataacagacgaagatgttaaccctgtaacaccgtaaaaggaaatgttagaaataactagatagccataaaaatagaggatgattcatttagttcatggtatggttgtgaaatactgtggccttgaacaagtaccttttagtgtctcattttcctcatctataaacagggagggagtaaagataatagatccctccttagagttgtgaagattgaattagtaacctgtgaagctgttccagcagtacctggtctagaaataatagtctcaaaatttcattgcttattattactatacagccactttttaaaatgagacaggtatgtataaatataaaaggtctaatattgttttagtgaatgttgtacataaagagatgtccagaaaatccagaagatacactttttttttttttttttggaaatggagtctcgctctgtcgcccaggctggagtgcagtggcatgatctcagctcactgcaagctccgcctcctgggttcatgccattctcctgcctcagcctcccaagtagctgggaccacaggcacccgccaccatgcccggctaattttttgtatttttagtagagacggggtttcaccatgttagccaggatgatctcgttctcctgaccttgtgatccgcctgcctcagccttccagagtgctgggattacaggcgtgagccatcgcgcccggcaatatactgttaactgtatatatatctgttgaaagaggggaagaagaatggtgtttgaccttttaaacgtgcatttttcttttgtgataaaaatctctgttggtaggtaggctggagtactctaacattgcttagtgcatggttgcctttgcaacatctaatgaattggttacctttctacccccataactctagtaactggaaacttgcttaatgatcagtgtcatttttttagtcagttcattataaaatattccttatgagctaaaatatattttgtctgttgtgtatgttagcttttttaatttggagccacatagaaatctgatttatcaccagtttagatctgaaggggagcttatgaaaccttattttaggggatgagaagactaaaactcagagtttgtaacttatccaggagcatgtggcagtttgtggcagtactaggactgtcaaatgttagcagtatagcgtatcctaaaatttttatttttggccgggtgcggtggctcacgcctgtaatcccagcactttgggaggcctaggtgggtggatcacttgaggttgggagttcgagaccagcctggccaacgtggtgaaaccccatctctactaaaaatacaaaacttagccggccgcatcggcacacgcctgtagtcccaggtatttgggagggaggcaggagaattgcttgaacccaggaggcgggggttgcagtgagctgagatcacgccactgtgctccagcctgggtgacagagcaaacaaacaaaattagcttggtgtggtggtgggcacctgtaatcccagctactcgggaggctgaggcaggaaaatcgcctgaacctgggaggtggaggttacagtgagccgagatcatgccactgcactccagcctgggcaacaaagctagtctccatctcaaaaagtaaaataaaataaaatgtttatttccaagttagtcttagcatttgtttcaaacgctttaccatcttggtagttctctttggtacccagattgaatgcagttatgtaaatggagtctggttgtcattctagacattttttgtcttctgacagtctatggaaatttctttggcagtcttaattactctaccagctaaaactacagtctttcttaggtgttcttcccatccccccattcctaaatttctagacttttactggcatagattattttggttttagtctaaacgtagaatttaagcaactaccattattgaacctcatttagcttaaccaaagctgttatctctttggaccctgattttttattgtttctagcttcgtgatgttcttcaacttggtaattagaagtcttttgctacatgtatactaaaggaaatatgtgtgccaaatgctttattcattgacagatattttatttgacacccactgtgtgccaggtatagtggtagggctaggaaatcagtgatgtctgagtgactctgcctttatggagcttttggttttagtggggaagattcatgaagaccatgcgagtgtaaggaaaggacaggatgctctgtgggcacacagtgagggatgccagcctaatctgggagttagaggaaagccttactatttatgggagaagaaagggtatgtgaaggcccagaaacaagttagaggaactgaagagcatagtgtgtgatgctcagagggaggtgagagggtgacaggcaaacagcacttgggtcatggaggctgttataagcccgggttgggatgccaaagaagctgttgaaagattttaaaacaggaggagatcacgtttgccattttaaagacagtactgtctaagaaacagattgggagcaaaccacagtagtataatggggtattgtgtaatgttccttccctgttcaccgtgaggcctggaagtagtttaaagtagtcaagtagagcttctcaaatgaagaatttcattcagtctctgctaaactacaaaatttatgactcaaattggaaacacggtgaaaattttgagtcacagttaaatgtttaagtagtttaagataaatctgttatgccttgtgtttcctaggagccatttagattcaaaaacaacagtggcatttagaaggtaatttctggtcttaaatagtgtttttcttataaaagattttaataactggtgtttgccacaataaattaggtttttaaaatgcataatacaattgattaataaaaaggattttttaaaaaaataatgctgatttttggtttgtttgggttttttttgagatggagtctcactgtgtcacccaggctggagtgcagtggcgcaatctcagctcactgcaacctcagcctccaagtagctacaattataggcgcccgccaccatgccgggctaatttttatatttttagtagagacggagtttcaccatgttggccaggctggtctcaaactcctgacctcaaatgcttcgtccgccttggcctcccaaagtgctgggattacaggtgtgagccaccatgcccggcttgaataatggtagttttaaccatcagtatttatatttgacataagtggtacaaataatgtttcagtatcatggcttataaacgtttgcatggagttctaaaacgtggcaaactgataatttaatgaactcttacttgaactcttgtgcaagtatactgtgaggattttgttctgattggaaatctttattgtaatagcaaattaaagagctgtggattttcaagagctgaatttgaaaggtgtcagatgttaaatggaaggtaattcagagtttattcttttattgtacctgcctccacccaaagagtcagagaaaaacatttggaagaaaaaattgcagagcatccctttggcaagagtaagaattttccactaccacttgccctaagagcattgacatgcctcaccagggaaatgttacaggatgtgatcatcggaacagcctagcctgctcttcatgcacaaaatcctttgtctgaaattcacagaagcctctccagacaaagggaaattgttgtgtcttcacttgaaaagtattcggtggacctttactttcatgaaccttttaactctaagaacctgttttcctaatagagtcaaccctaaattgactctgatatcaacaaaaggaatgtaacagtcacacagcaagttaaacaaaggttttcattaattgagcttccttagagaaggctacttttacttcctagcctgagttcctgtgcataaaatgaagaggacattggttggtcaagatgatgtgatggtccctctagctaagaaaatactagaatatggcaggttcgttggtttgtttttgagatggagtctcgccctttcacccaggctggagtggcgcaacttcggctcactgcaacctccgcctccaaggctcaagcgatagtcttgctttagcctcccaagtagctgggattgcaggcacccaccaccacacccggctaatttttgtatttttagtagagatggggtttcatcatcttggccaggctggtcttgaactcctgacctcaggtgatctgcctgtctcagcttcccaaagttctgggattacaggcataagccaccgtgcccagtctatggcaggttttttggatttatgtttcttcaatatctttctacaaagatcagtttctaatagaagccaattaaacatagaaactctaaggtagcatatttcccaagtgttgggaggctttggagctttttagcttcgagttggtgtgcctgatagatgagaaacagcacaacagaaaagctgttcataggatccatgactctagctattgcattttttctcttgcattaatttttctagtgtatttgtaaaacctttttaaaaatatggattcttaattttaaaattaacctggtgcaatggcacatgcccgtagtcctagttacttgggaggctgaggtgggaagatgacttgagcccaggagttcaaggctgtagttcaccgtgatcacgccagtatactccagcctgggtgacagagtgagaccctgtctgtaagaataaaaaatgaaaaaaaaaaaaaaaaaaaaaaagtggattcctagaccccactccaaatgcatttaatcatactcttaaagaatctgtaaaagatctccagataactcttcttgtcgtttctaaatatttaattgccacttgattagaatggaagttgtaagatggaaacatttagaacagctgtggtcagtatttaagggtttcccaggcatttgacatttgttcctctagcatttgacatttaaggtattcctcagtatttggccaaaagttaaatgtgtatcaatacagtttctgcacagcaaagaaacacctttcatatattttagtagacctttataaagggaaagagtacatgttggtttccttataatgccagtataaatataatctttcatatacataatatatactatattatatattaatactatatataataaatctatactacacatattgtatatttatactataggaccaataggtaagacctatagtcctgtactacctgttggtcctgtaggtgtatctattagtgttaggtaggaccattactaaatacagtgtgtatatatactaaatatgtatatttagtattggtcctacctaatactgttagataacgattggatatccctaatctgaaaagctcaaagatcagaaactttttgagcaccaacatgatgctcaagggaaatacttactggagcatttcagattttgagttttttgtgtagagatgttcaacagtaagaatataaatcaaacactccaaattttaattttaaaatactgtttccaagcattttgggtaagggatactcaacctgtaatatgttggcagtgttacccaggaaatttaaccttggtatttcttacctgaaaaatacattttctatttatttcaaatcctctgagcttccactgaaacacagcaaaacacatgccaaaacattgcttttgtatcctcttgtaggttgtactcaatttaaatattagatttgttgaccttttaaaatttgtcaagtatatgagagtatgagctagggtttatatattgaattgtttaagtctgttcagcagttacaatgcagaagtaaaatagtgcttatagattgacgaccgctatctcacattggacagaagtcttctactccataggatcatgacattgacgtaaatcaaatcctcagacaccaaaggaacatttggaaataaattttccatttagggtcataatattcatcattgaacttgtcctctttttgaaatgttcgagggcatgtaggatcaggttaatcatgacaggcagaaatagtgcagtatagggcatgttagctgttaaagaccactaaagtttagaatatagttactttgttgtcttaaatcatctgttagatgtactctcttcaatgtagttagagcagaattatattaaaatgaaaggttctcgttgattcagtctgaatattgctgttcattgcacaagcatttccagcaggaatttcaccttagcttgtgtgtccctgcagtcaaatgcaagggtgatctttgcctgttgagattatatattgacaaactgtgccgccttgtgaccacattgcttacttaggctatagcattgtttttatgcactcaaattaaaaaagtaaaccatattctccctgaacttaagctccgaagtagagaaaaatcagaactaatttgaaggtttaagaagttcagtgttggctgggtgcagtggctcacgcctgtaatctcagcattttgggaggcaaggcaggtggatgcctgaggtcaggagtttgagatcagtctggctaacatagtgaaacgctatctctactaaaaatacaaaaatgaggctggttgtggtggcgcacgcctgtagtcccggttgatcaggaggctgaggcaggggaatcgcttgaacccgggaggtggaggttgcagtgagctgagatcatgccactgcactccagtctgggtgatagagcaagactctgtctctgaaaagaaaataaaaaataagaaattcaatgtttacttcttggacaggagtgctattttgccattttgtatatgactggtaacatgcaattcagtatagagagtaagtctgaaaaatgatttgattttaaaatgccatctgcaagtatgggagaattttcttatgtaatttgtagctgccctttcgtaagacttacaaaccaccttaattatctttcagaaaatcacggacagctgttttgttgttattattgttgttttgagacaaagtctcgctctgtctccaaagctggaatgtagtggtgtgaactcggctcactgcaaccgtctgagtagctgagactacaggcacactaccattcctcccagctaattttttatatttttagtagagacaggttttcgccatgttggccagactggtctcgaactcctagcttcgagtgatcctcccgcctcagcctcccaaagtgttgggattaacggacagctgttttaatgtccagctgctttgtgtgattgtgccactcattcagcagtatttgaataccagcagagggctgggcactattctcaaggtgcatggctttgtctgttacttgggctatgttgtggaatttcactttgtacacacatcaaggaaaggggctgagatttgggccttttaagagctattaaagtaacttgttggcctaggaaagaagactcagttgacttaaagatcttcaggttatgcaagaggtttattattcatttaattgatatttctttttttttttatgagacggagtctcgctctgccgcccaggctggagtgcagtggcgcgatctcagctcactgcaagctccgcctcccgggttcacgccattctcctgcctcagcctcccattaattgatatttcaaaaagtatcaaaggatatatgccccagctgtgcagtgttactagtttgctacaccttcccagaggtgtttctttataccattggaagttgtcattttagtatgaattaattacatgttatacgagcatatcaaagggtttgaaacagtgaaagagctaagattaacttggaaataaacattttattttattttactttttgagatggagactagctttgtttcccaggtggtgtgcacctgtagtccttctgcttgggaagctgaagtgggaggtcaagggtgcagtgagctgtgattgcctcactgatctctacatcctgggtgacagagcaaggccctgtctcaaaaaaaaaaagtggtgttactgtgtagttttattttgcatttgccatgtgtttcgttaattgaatatctttttaaagggggccatttgcttcctgttcacaataatttagcttttttgatggaatgaatcatggcatatacaactttattctctttgctgtgccttgtgtatatgtagtaagacttttacttactgctaagtaggaaagtattctttaaagtgaaagcttgaaggcctgtctgaagatacagagcaaaatttcttagaataatgtagttaggtttccttaagcctcattctcttccttcctaattcaaatcttgaatccatctaaagttttttatgactccaagataggttgatcactttgcttgttttaactgaattttatgtatttgtgttatatgcagatcatttattttctttaaaaattgatttggagacaaattcatctttagataacatagttttaaaagttgctcatttcagccgccttttttttctcctaattagttggtgacaaagttcctgctgatataaggttaacttccatcaaatctaccacactaagagttgaccagtcaattctcacaggtaaatatgatatattaagtcattgaatttctgaagaccttcgcatattccatgccaatagagttggctcttgcctcactgtccctttatggtatcccatcttaatcctctctaagatacttatttcttagtgctttagtctcgctccattgcccaggctggagtgcagtggcgtgattgcggctcactgcagcctccgcctctcaggttcaggcagttctcctgtctcagcctcccaagtagctgggactacaggctcctgccaccatgcccagctaatttttgtatttttattagagatggggttttaccttgttggtcaggctggtcttgaactcctgacctcaggtaatccacctgcctcggcctcccaaagtgctgggattacaggcgtgaaccactgcacctggctgccgatacggttttaaaggcatgatttaaaaacaaaacaaaatggctgggcacggtggctcatgcatgtaattccaacactttgggagactgaggcgggcagatggcttgagcccaggagttaaagacgggcctgggcaacatggcaaaaccccgtatctacaaaaaatacaaaaattagccaggcctgtaatcccagctactcaggaggctgggtgaaaagatcacttgtgcctaggtcaaggctacagtgagccatgcttgtgcctctgcactccagcctgggggacagagcaagactctgtctccaaaaaaaagttgtaatttgttcgttaccataggtaaatcttaaggttgaattgttgtctgttttgtggaaagcaaattacttattcgatgtcctttttccaggcaagaaaaatagactccagtgctgtaatttttttcactggaggagtgctaatgttgtatcaatctttacagtatccaaatacacaatgaacaaaagttagcccccataagagatgaaaattgtactacctggaatttgcacaattgtttgaaacattttcccgtttttgtgtgataaaagcacaatctagggtggagggttcatactaactggaagtaagtttgtcagaagaattaactttaaatacaatgctaacttggattaaatagtaaacataaagtctaaaggctctcaagatttatctgattatcaattttgaaaagcagctaatgtcatggagacagttatatgagtaacctggctctattttttttggtattgtttctttataaatagcttacttattaaaattctcattagcaacaacaagctggaggccaattaagccataaaatgttggagaaatggttgggttatatgtgtgaaattctcatagtgtgccctaaagacgtagttgccatttaaaaaaaatttttttttttttgaggcggagtctcgctctgttgcccaggctatagtgtagtgctgtgatctcagctcactgcaacctctgcctcctggattcaagctgttctcctgcctcagccacctgagtgtctgggattataggcgtgcgccaccatgcccagcttatttttgtatttttagtagagacggggtttcactgtgttggtcaggctggtctcgaactcctgatctcatgatccgcctgccttggcctcccaaagtgctgggattacaggcatttaaaaactttttaggctggtcacggtggctcatgcctgtaatttcaggactttgggaggctgcggcagtaggatcacttgtggccaagagtttgagagagcagttatagtctctataatgaaaatctttttttttttttttttaaagacagagttgcactctgtggcccagtggcgcgatctcagctcagtgcagcctctgcttccggggttcaagtaattctcatgcctcagcctccctagtagctgaaattacaggcatgcaccaccacacctggctaattgtatttttagtagagatagggttttgccatgttgtccaggctggtcttgacctcctgacctgaagtgatcgcccgcctcaaacccccaaagtgctgggattacagacataagtcatcacacccagcctataataaaaaactttaaaagtttaaaaaaaaatttaaacttcatagaggttctcgaatattatctttctttcattaagaaatcataatgtagtttttggctaacttgtggaaccaatttttttggtcaaatattgagagtgaagtttgctacctgtaacttaaagtaacatttagagacatattttactcagattgaccctaattatatatctatgacatgatttttaaattgaaatcagctgggcatggtgtctcatgcctgtaatcccagcactttgggaggccgaggtggggggatcacctcaggtcaggagtttgagaccagccttggccaacatagcaaaacctgtctctactaaaaatacaaaaattagctgggcatggtggcacatgcctgtaatcccagctacttgggaggctgaggctggaaaattgcccgggaggcagaggtttcagtaagccaagattgtgccactggactccagcctgggcaacaaagcaagactccgtctcaaaaaaaaaaaaaaagtagttctttatttaccatgcgatctttccagtacacttgctaattgctactccagagcatagccagatgtggcccacacctgtaattccagcactttgaggaggacaagatgagcaaattgtttgagtccacgagttggagaccaccctgggcaacatggtaaaacctcatctctacaaaaaaataccaaaaaaattaacccggcgtggtattgggtgcctgtaatcccagctattcaggaagccaagttgggaagattgcttgagcccaggaagttgaggctgtagtgagttgtgatggtgccattgcaccagcccgggtgatagagcaagacctctgtctcgaaaaaaaaaaaaagtatcagtatatatgttaaagtatttattaaagtatacaacaaatatatgtaaataatacagtcacagtatcagagtataaaatgattactgaaaaataaattaatttgaatagttactccagaaaataatcaatggggattctacttgaaaattcacttttttattttggaattgtgttgatttttatcctgacaccctttgttctggtattaatttccattactaagttttcccagcttacctcctttgaatgaattgggccttttgccaaccttttctcacactaacagtatcccaagagtggtaatgggtgggcatgaatgagaggttctaggttcttggtgtgggtcgcagagatctgttttttctgtctcacaacccgcttaggtgaatctgtctctgtcatcaagcacactgatcccgtccctgacccacgagctgtcaaccaagataaaaagaacatgctgttttctgtaagtactttatgaaatgtgtttttatttacagacatttccaaagcctaatcaaatgttatgtttttcactgccaaccatcactggctatcattctaaaggataatcacacttttcatggtcagtcttaggtgtcagaatatggcagtaacataacgtgtgacttagatgtcttttaattggcaagttttgggggaccaaaaaataatgactagcttatacatcttcaaactcttacctgcaaacatagttgaaaagtagatttgtttggaaaagccttagccaataaagggtattttcaaaatgatgtagatgacagctgctatttgtatgtggttcacaataaaaaggtgcgtgtttagagagagagagaaagcaaacatggcaaaccattaataatggtgagtctaggtgcaaagtatatgaatgttcattttactatttcactttttctattgatgtgaaaaattctttgaatagtgaggaaatgattttaagttggggacatttgtgggtttgtatgagaacctgactactacccatagtaagtaaatagaggtaccctgaaaatagtgaagccatgtccttctcttataacactaggaattaaagtggcatgggagagactgctcacatttgatttctttggtttttggaccctgtcacatgagtaggggttgtcaagatagcccatggggctagttgccgtttctattacagtgagaaaagtaggggccttgagttgttggagccagaagtggagaatgcttagagttgaactatatgagtttgaaaaattgggaacacagaggggttaagagcactgcttgaagatggtctgcaagccgggctcaaatagaaatctaggtgggtcagtacagagctgcctgacataagtaagtagcacatggagcattgcttgttgtcacagttgtatggctggttgcttgaacagtagccagtggaagacctagtagaatgtgtagagaatctgggtgccctagtcaaaaaccagcgtcggtatttaagttgggatgtggtattcatcttgtgaccagttctctacttctgtcctagggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcagggtaagaggagtaatttagaatattccgtgtcgtggttctttgttcatcctaccaatatgccttcatgccatcaaaacttttgatttgtaatttcatacatttctgtgggctgtatgtatagcctgagcttaatttctaatatttgagaggatctaatcatttaattcctaaaactttcacaaaatacaggatatctgtatggctgatatacttgtattagatgtaagagaattagagaaattatattttcctttaattaaaaaaaaaaaaagcctgggcgcagtggctcacgcctgtaatcccagcactttgagaggccgaggcgggtggatcacctgaggtccgaagtttgagaccaacctgaccaaaatggtgaaaccctgtctctaccgaaaagacaaaaattagctgagtggtggcgtgcacctgtagtcccagctactcgagaggctgagacaggagaattgcttgaacctgggcagcggaggttgcagtgagccaagatcacaccactgctctcaattctgggcgacaagcaagactccatctcaaagaaaagaaaagaaaaaagacaaggtctcattctgttgcccaggctagtgtgcagtgacacagctgtggctcacttacagcctcaacctcccaggctcaagtcctcccaccccagcctcacaagtagctgcaaccacaagtgcatgccaccatgccccactagtttttttatttttttttgtagaggcaggttctcactatgtcaccaggctggtcttgaattcctgggctcaagtgatcctcctgccttggcctcccaaagagctgggattataagcatgaaccaccacactcagcctcctttctaattttcctgatcctctgtctctaggtgtatgttaatagacaagttctagagaaagctgctagttaacctccctacctgaagtcctaattggtttttctatcacatgttgaatgaagcgtgctttttctcaaaaagtagatagtcatctctctgtattcattagagattggttccaggacctccctcagataccaaactctgcagatgctcaagtctctgaaatgaaatggttcagtacttgcatataaccttgttcatcctccagtatacttgaaaacatctccagattacttacagtacctaacgtaatattataaatgatatgtaaatagttaaactgtgttgtttagggatagttaacctgtgttgtttagggaataatgacaagaaaaaaatgtacatgttcagtacagatgcagttattttttccatctgctgtttagttgaccgtggatgtggaacccacaggtacagagggctgactaaaattgcttttaacttgctttattctgtgtattcatcatatatatttttgtttgtttgtttgttcttgttttgagatggagtttcactcttgttgcccaggctgtagtgcaatggcccgatctcagctcactacaacctccgccttctgggttcaagcaattctcctgcttcagcctcccaagtagctgggattacaggcatgcgcccccacgcccggctaattttttgtatttttagtagagatagggtttctccatgttggtcaggctggtctcgaactcgcgacctcaagtgatccacccgcttttgaaagcctcccaaagtgctgggattataggcgtgagcccccgcgcccggccatcctatattttttgaccatcatttgataaaataaataatttaaacctgctgttagaaaagtaacaactgaataaataatgcaataattatacagctggattattttgtataattcactttccttaggttttgcttaaacaacttggtacaagtctattccaaaaggtacacatgactcatacagagtagacatttgtcacatattttattcggctcattaattagcaagggaatctgtatttgaggaagtgttcaatattagaatattagaatagggattgctaggttagattacaaaactaatgtcttacagggaaacctcatataacatgagcatttatttagtaacacagtgttacattttcctagaatgggcttgttaaataatgcttctgtatgatattgaaagggtgtagttatcttggcctttttgtcaggttttagataattatttttaacatcggaaattgttttataatcagttaagccctgtgaatttttatcttgccaattttaagctcatgatgattttttagatacaggttctccctcccccgcaagctccttgtgaagtccaaacccacatttagaattgacagaactggggtgttccaactttcaaagtggaaagcttctaggtttgtcttaggtttctccaggatattaaggtgtttgagctacttaagttcttattttttggaaccaaaaggttggatgaattggctaaaagtcagttttgtcatactggttgtttcaggaagagaaagggaattttcttatttacgattttgtgtctcacttagcctgaaagctttaattcctcagaatagtctttatgtctgtgaaagtaagccatgtgtaaagccatgtgtaaaattgtaatttttaaaatttcagtttcccagttcactataatttttttttgttcttttctcccttgaatggcttggcttaaaatgttttcttataataaagaaaaagcctgcctgttctgagtgaagctctacctcacaacaggaagctggtgctaattggtattctgcaggaggcttcttgcagtggtattgcataactgcccttgacttaggaagattttcatcctgcatatcctaaatggttgacttgctcacagtcaaaaatgtctaagtacatttagatttagctaatgtagattcagattctgaatgtcttttagaatattttgggctttggtatagactcaaagaatttcacatttttggctgggcacagtggttcacgcctgttatttcagcactttgggaggccgaggcgggcggatcacctgaggtcaggagttcgagaccagcctgactaacatggtgaaacctcgtctctactaatattacaaaaattagctgggcatgttggcaggcgcctataatttctttgggaggctgaggcaggagaatcacttgaacccgggaggcggaggttgcagtgagccgagtcgtgccattgcagtccacccagcctaggcgacagagtgaaactccacctcaaaaaaaaaaaaaagttattttaaaataaagattaactaatttccttattgaatgtgagatgaattgctctgaaaagatgtgtttttaaaacacaacatagctttgttgttgctgttattacggagttttgctctgtcgcccaggctagagtgcagtggcgcaatctcagcccactgcaacctctgcctcccgggttcaagcacttctctccctcaacctcctgagtagctgggattacaggtgcccaccaccacgcccggctaatttgttatatttttagtagagacgggtttcaccatctttgccaggctgatcttgagctcctgtcctcatgatctactcaccttggcctctcagtgctgggattataggcgtgagccaccgtgcccagctcaacgtggcctgtttaacttgagttttacattttttaaattccccttagagaatgatttgatcagattattaattgctcatatttcagagaaagcacgagaaaatatagttttgacatcactttctgtaattttttctttttagaggaggttttacaagttttcatttgcaatgaaaacacaagcctaaatcttacttttccaaactgggcttctgaattataatttgtgaatgcaaatcaagcagtggaaaaattatctttaagaaaatagcttatgtcgctttaaaaaataaaattaatcctttcctaagcatgcttccatctgtattgtctagggaacatcaattcattcagctctgcgggctccttactgtatacatatagttatgcagcttcatagaacatgagctattgccacaataaaaataagtgggaaggagcagagaagcagtttgtcttattttactcgggaaatgtttatgcaactctgaaatgtgagtttattcttcccaagcttttgtgcttagctctaaggcaggactacctaataccactctcacagccagccatttgaaatttgggattctgagcaatctaaagagtaacttgtctctggaactgaccttttgctgaccgggagtcctcataacttggattttgtgtgggttgttgtgtctttggtgccactgctgctcattcattcagcacctcagtgatgctgtttttcatactgttcgattggtcgggggtgtgatgggcgaagcagtctaatataattaagctagttagggtaagggacagtactgctgatgctgagtgagcctcagtgagttttattaaagttgttttcgtaaatgaaagaggttgtttgcctttgtcctaagctaacaaaggtagtttatttgtgtagcattttttaaaaatcccttttaaatactctgatgcgctctccccctacagatgttcattctggacagagtggaaggtgatacttgttcccttaatgagtttaccataactggatcaacttatgcacctattggagaagtgtgagtaaccctcctcctcatttaaaggatctggtgtggcagtttagtatttgtattgatttgcagcatgtctacaaagttaagacagctttctgaatgtggctcaagtcaacacttattactaaagtagtaaatgtttttaaaacaaaaactttgaaagatgaaccaaaggttataatccagtcatctttttgcatcttctgggctccaaactttcaagagggatttgtgtttgttattcactgtagccagtggtggaagaattgaattaagaatttctggtctttttactgattgatttctgataccagagatgcattctctcttttgtttttgtctaatattggctctggcatcaaattgtttggaattttttccagtatgttgtcccagaaattctgttttcattattaaacaattgcgggggggcagggggcgggaggaatcaatagtggcgaccataccctgctctaagagtgttttctctttgggcaggcataaagatgataaaccagtgaattgtcaccagtatgatggtctggtagaattagcaacaatttgtgctctttgtaatgactctgctttggattacaatgaggtaagtctcttcataaattagaaggaatggctgttcctagttcaagggtggggtgggtggaatgaaagtctagcctgccttcctcccttttgaaagtcaagggtgcctgattttgtttcccccttccattcagaacctgatggtggggccagcatgacctcaccaaagaaagctgagagcctttcacatatcctctgtgactgagcattgcagttagttaacttaaagttgtagtatatgtgatgttctttctgttgatagcatacttactataaatgaataaaacccaggatagaaaatgctttcctgaaagcaaaggatatagtttctgtctcaaaggtaagctagtccctgtcagagacagaatgtgaactcttcagaatgataagcagtgacatggaattacattattatgtgaaggcactctttgaattaatagtgtgatcagtggcttcttatatttgggtgaaataataaatactgtgtttgatgtcatcttatatttaagggaaatgaaaaacctacttattagaataagatcacatgcacacctgtactttgagtatgtttttaattatctgggtcacctgtttcagaggaggataaaaatggccttacagtgttgtaatagaggacagattgtgcttttgtggaaaaaaaatattaaagataaatttatctgtgtacttctcccttttttctactttctgtgcctttaaccaatacaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtgagtatttgaacctggtttattgttcatgctgcttatcagtcgtactatatatacttagtgtctgcactgtcctactctcttagaaaactaattataccttatctcctcaaacttacagtatttccttccccatattcactctcaggtaagatgctcttcctgtgtatttgaccaggaaaataaaagcaatcaatagctaatttccttgagcgaccctctgggcccacaggggctgccttctcccatagtgctgtgaacagtgttcttgctcctagcagaagccacctcctcccaacatctttgctgcattattgatttccatctctactagatgttcttcagcatagggggaaataatagtgtctttctatcttgaaactttcctttgaccttatttcccctgtcagctaccacactttcttttcctgttcaattaaaccttttttttttttttttttttgagacagagtttctctctgtcaccagattggagtgccatggcgcgatcttggctcactgcaacctccacctcccaggttcaagcgattctcctgccttagcctccctagtagctgggattacaggcacacgccaccacgcctggctaattttttgtatttttcgtagaaaggggtttcaccatgctagccaggctggtctcgaactcctgacctcaggtgatccgcccacctcggcctcccaaagtgctgggattacaggcatgagccaccgcgcctgggcatcaaacatttcttaactcatttgatgagaccagcataaccaaataccaaaggtcaatgtggtgatggtggtggcagtggcagtggcagtggcagagggcacccacattgttcatgtatacactgaacaaataagtggcctctgagcctttttctgcctgtcagagtctttgagacagggctcattcgaccagcatcactatgacaagggccagtagcaaggatggggagtctccacagtgagttggacctgagtgaggttcctctcaaagagctgctgctccctcctgccaagaccaccatactggacctgtcctgcagtactgcccttagatttctgtggcctcacaagcccggggagcctagacctcagtagaaacactttgcaacggctgctggtgaagaatggccatccattgagtctctagcacctgggtctcctcaaaagactggtccccctgcctgtcacttggctcagcttaagaacttgaagtggaccaggcgcagtggctcacacctgtaatcccaacactttgggaagctgaggcgggagagtcacttgaggcctagagtttaggttgcagcatcactgcacttgagcctgggcaacagagtcagaccccatctcaaaaaaaaattaaggcctgaagtggctaaacttgaaggataactccctttatcttatcctggccaaagtggtagatgattgcttggatgagaagtgatatgcagataagatgttgcaatacacaaagtctgtgtgggtcagtcggtcacgtgggtgccaaggacaggtgggagagaagaagcaagctacagaagcagctcaagaatgggaactgcggaagctgattgtattggaggaaggagtgtgatgctctcagagcagccagggaggagcagaaggagcttagggacgtaagtcaggctctcaaagtctatgtctggttcctgcccccacaaaccaccacccaggaaacatcattcctgagctgtgtggcagcagcagcagctgctccttttatatggcagacagggtgattgcttgttgggcaagagccctcctacactatcttagagtgaataccctctatctgcagtccagggtctgcacagccacatggtcctctaataggtccaccagaccatttgcctgcaaacagcctcatcctcagtgcccactgtctcctagctgtggagcttggattcctatggaattgggttctgctgaacatacctctttttagcatcagacctacctgtctgtcatcaccatggggctgccagtcagtacttttgcagcctctttataggacattgttgtaacttagggttccctggtagaataaggagcgatgggaaggggagaggttctgcctgcctgaaggaacaggtctgggggaggagagaggtaaaactcagccttttctagttgtcatacacagctgtataaaggcaagcctcatttagcaaaatgattagttgtcaccacgtttaatgctttttgtatgtcataagccctttcatcccttcctggataataagggcaaatgaggaggcattgtgtcattggggggtagtacagcctgagttgggagggagcagtatacctgttttcttaataacctcaaatatcaggcattttagtgaccacacaaaatctcagggtgaaaagttctagaccatcatgtccagcctgcagttagggacacctagcccttccatgacctgtatggcgtggtcttccggttagtgtgaggcagcattttgtctcctttatactgtcctgagaaaacaaaactcacactggaattgagactgtctcagctgaaatatagattccttttcagtaaactgatgcacaattcacaaatagcagtctcaaagccatgaaggccttggaccactcctttggcttcttccctctacccatgtgtcttccatgaacccgaagcagtccaggcttattcactctgccagtaagcaaggagttggatcctggcagagccacgctgcctgtgatctattagttggtgtaactaaaaatctgaggcagcctgaaaacagcttcacagattgagggtttgagtcgtttgattctagacctctgactactccactgagtgatgggaaacaagtcatgtaatggggctgaaccagcactggctcactagccagtgaccacacaagtacgggcaatactgtcatccttgtgtctccctgctccagagctcccttgtcccatctttttcacatcccttggccaagggatcggaaacagctgtcatgctgctcattcactaaggagttccaaacacaagctctttgcctcccttcccacttgagacagcaggaacccatgtgtagtttagaagcagagagagcaggtccagcattttggccccatggcttgtttggtgaggtctgtggttcttggccagcctagtactgaaagggatttccctcccccactcccagcccaagacctcttacctgggtaggtccacgccttcctcagaatcattgcgtgttcctttagtcatcccagtgccattggcgcaaatgcttaattgaaactaaacacacgtgtgattgagatgatacagaatctagcgtagcactcatacccattcctttgctgcctgagacggttcagtggctggcaggccagcaggatcgctgcagggccctgagccccatctagtcagttcatcagccttcagtcctcccgtagcttcctaggttagatgctgatgttcttggggatttctatgatgatttttaaatgtgtgtcagtgggagcaaatataattaactcaccacattaaccaaattaaggtggaaaaaacaataaggtcacctcagtaggtgcatatgatgaaacgcatcttatcacaccaaactaagactataaaagtgtgtctttaacgctgacagtgtgtttacacagagaccatgctaacataacagaattctcaccatttctatgcagtattatactggcattcctggtctgtgtaataggcaagaaaagtacaaaaactggaagagaaggggtatctttagttgtaggtaacgatataaagccaaaggtttattctcagtcttcgtcttcctattttgttggtgctgtcactcgctccctctttgaagcacctcttcacttggcttccacgatcccatacttgctctccctccctggcctctcattcgaggtctttgtagctgggtctttcacaaggcaccaggaggtgaaggctccatagtcctcagccatttctgtctatagttactcccatgatctcttctggtctcattactataatcagtagccactagctatctaaaactacttagaatacctaaaaacacttccttagatgccctagccatattcacttaaagtgcttatccatcacgtgtgacagccacatgaacagtggccacagagcattgccatctttcacagagttctggtggacagctctgcttggggccatctcttcacctccaacgttccctagtttaagtcagtgtcattatactgaatggtattccttgtctcccttcagccaatgcttttgttttttgagatggagtttgctctttcgtccagggtggagtgaagtggcgcaatctcatctcactggaatctctgcccccctggctttaagcagttctcctgcctcggcctcctgagtagctgggattacaggtgcctgccaccacacctagctaatttttgtagacagggtttcaccatgttggccaggctggtcatgaactgctgacctcaggtgatccactgcacccgaccaccttcagccaattcttgacaactggagcttgagaccctccgttgtcttctgttttacttgtcttaaaagccaaatgccccataatgacttttgaggtcttaatgacctgcttctaccatcctctgccattacctgcctcaccttttgctcatgtaaactctattccagccacgttggcactcctttaccattccaggacttgccaggttgcacttccgttctctgcctggtgggtcttcaccaccacccactgggttcacacacatcttttcaggccccatggggccatctttattcaaatgtcaccgccttctggccactttatgtaacagttcatatgtatgtatgcaaattttctatcccccttccctttttctctatagcacttgtgttacttttgcatcttagtctgtctctcccaaaataggggacaagtttcatgagggcaaaaacctgtctgttttgtttattgctatattcctagcatctgtcatgtaataggtgtgcttactgcttgttaggtaaaaaagttcagaaattgccacccagtagtatccatatttgttccctttgtaggtcattaaacagctgatgaaaaaggaattcactctagagttttcacgtgacagaaagtcaatgtcggtttactgtacaccaaataaaccaagcaggacatcaatgagcaagatgtttgtgaaggcaagtatggcagattgcaattgagatgttcttgccagggttaagatcccggtgaaccaataaaacaaaattgtttatctaaatctgtaacatttccagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgaggttagctaatgaaaagtttctttgtccacaccctgcacgattcattgtgtttaaacagtactccttcaagcaaaaggtcaaacagttctcacttttgccaagaaagaggtgtggttatttgtttttctgcctgccagctgtgtcacccttaaaatttgctgcttcaaacatacatagttaataatttcataaaagtgttattttcaaagtagaatattttcaaagtagaataatcaagatgagcttaagcttgtaaaccccattttgcctctcatctaaatcatgattttttttaaattggtgacatttctagaatattcattagttactgaaggtcaaaagatccaagttggagattacttccacttttctactcagagtagaattcttttatatcaaggatgtgacatcctaaagctatgaacaaaatgaagaagctttggtactgtgggctcagaatagcacaagagttaaagaatggtttgataacgggtgtagtggtatttttttttctcataagaaaatgcaaaaaccgccaggcacggtggctcaaatgcctgtaatctcagcactttgggaggccgaggctggcagatcacctggggttgggggtttgagaccagcctgaccaacatggagaaaccacatctctactaaaaatacaaaattagccaggtgtggtggcgcatacctgtagtcccagctaccctggaggctgaggcagaagagtctcttgaacctgggaggcggaggtcgcagtgagctgagattgcgccatggcactccagcctgggcaacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgcatgcttttgaaggcatattttttggccgagtgcagtggctcatgcctgtaaccccaacacttgggaggccgaggcaggtgaatcacttggggtcaggagttcaagaccagcctggccaacatggtgaaaccccgtctgtactaaaaatacaaaaaattgctgggtgtggtggtgggcgcctgtaatcccagctactcgggagattgaggcaggagaatcgcttgaacccaggaggcgtgcagtgagccgagactgcgccactgcactacagcctgggcgacagagcgggactccatctcagaaaaataaaaatttgcatatttttgcaatctgcatctttctacttgaaatttatccatgtggatacaagtgcttcctcttgactgccacataggttgtgtttttgtttttagtaagataatacagataaatttgaagtcccctttgtcccacttcggtaaacttatttggtaattttacatttcctaggtaaaatgtgttttgtgacaccaacttatgaaacaaaaattctaaaactctttgccaagagacctacggctctattcattttcctcctgcttcccattcagtgggcttttgcctaggggtatgaatgtggcatgccagttggctgacccaaccattgctttccctttcagactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctggtaggtctctgtgacagcatcacttactgtacgcctttatctaaatgggtcatggagcccagttctcgcagtttgctctccagattgcagcagctttggtctttgtgcctgagttggaagaggggagtgggcaagacagaaatgccttatggaagcagtggtgctttggccctcgggagggttgtctgcagctgccccaatgtgcaaagaatcctctttaacgtgagactgagctaacattaaccaggtagtcacatgaaattcttgccctccaaaagttggctttatctcagtcagcttaataatttttttatttttatttatttttttgagacagtctcgctgtcgcccaggcttcgggcagtggcacgatctcagctcactgtcccctccacctcctgggttcaagcctcccgaacagctgggattacaggcatgcgccaccactccctgccatttttttgtgttttagtagaaatgaggtttcaccatgttgcccaggctggtctcttaactgctgagctcagccagtctgcccaccttggcttcccaaagtgctgggattacaggcataagccaccgcacctggcctcagtcatctgaatttaagtaataaactaagtaaaattgagctttaattcaaaattgggtataagtattttacagattacctgaagttgttgtcatttatttttctggaggagggcgggttgatgatgctctttaaatagtggccagaagtcatttgggctctctttgtcttcttttcttgattggaaacagtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaattctcagtgtggtggtgactgttctgtgggagggggactgatgggcaccaagggcctccactccgcacccgggcctgcccctctacagggaagcaggggaggctcagtctgggcagggtggccatgtgactagaggggacaggaacctcttggactcgacttcacagtagacaggctgactggcagcaggtccgcccatgtgaagcccaccctggctccctaccctttaaggatgggggaagctgagtgtgtgttaccagtggggtcttaaacacacaaggcctcactcgtcagtgtggtgaagaaagccaagactccgcgctctccattgttagcagcctggaaagatctggagactagcaatggagagatgtttcttaggctgttcagatccaaaacttccacattccccgttgttgataggtatgggatggagaggtgaacagaactgaagcagctgttggaattcatttgctggttactttagtgcttatttggcagtgatgggtttgggattgggtttttggttttgcacattccctaagatgattctttatcactttaaaaaataccaggatacaaggatagctggatgattctataaatctaatttttaaaactatcagttctgggtaggcacggtggctcacgcctgcaatcccagcactttgggaggccgaggcaggcagatcacaaggtaggagatcgagaccatcctggctaacacgatgaaaccccgtctctactaaaaaaaattgccgggtgcggtggctcacgcctgtaatcccagcactttgggaggccgaggcgggcgaatcatgaggtcaggagattgagaccatcctggctaacatggtgaaaccccgtctccactaaaaattcaaaaaattagccgggcgtggtggtgggtgcctatagtcccagctactcaggaggctgaggcaggagaacggcatgaacccgggaggcggagcttgcagtgagccgagatcgcaccattgcactccagcctgggtgacagagcaagactccgtctcaaaaaaaaaaaaaaaaaacaacaacgaaaatacaaaaaattagctgggcatggtggcagttgcctgtagtcccagctactcaggaggctgaggcaagagaatgaatggcgtgaacgtgccactgcattccagcctgggcgacacagcgagactctactgatcagttctgctgatggagaaaaaaaatttgataaaatttaacatccattttctaaaaattattcctatgtaccatttattattagaaaccaaaagtgttaacgctttagagttgcattccaagtccactcttgcccactaccaaacactgttctagaggtgctagtcagtacaatcgggcacgagaaggaaaaaatgccttggaatgaacaaaaagcgatcaggggtcatactgggtcaatgttcctagacaggaactattttgttcctagttagaaatgtttaatgattcagggaaaattgacagctgaatgggagtgacatataattcatactgatatatgagaataccaatggtggccttaggccaatcctaacaaacatcaggcagacaaaaaccaaggaagcacaccaaacctcttaaagctatggtaattcagtgcatcacttgagaagggtggtgtttcagcttagtaggtaatagttggattattatgtggggggtcatcttgagaaaaataaagctgtatcccttacacccaataaattgcaaacggatcaaaatacttggaaaatgcaactatacccccaaaagaaacatggttaaatggtgtaaacgagagaaaacaaatagctcatgtgaaaagatgctcaactccactggcaaattaaaatcacgaggtaacgtctcgagaagtgggtcttctgatgccaaggatggagcagcttgcgaggatgaactctagggaatgaccgaaatcactcagcctagaggtgttctcaacacccttacccctgcccc

SEQ ID NO: 16327 - DNA, 31573 bp, Human
cggtggctcacgcctgtaatcccagccctttgggaggctgaggcggacgaatcacctgatatcgggagtttgagaccagcctgaccaacatggagaaaccccatctctactaaaaatacaaaattagccgggcgtggtggcgcatgcctgtaatcccagctactcgggaggctgaggcaggagaatcgcttgaaccagggaggcggaggttgtggtgagcccagatcgctccattgcaccccagcctgggcaacaagaacgaaactcagtctcaaaaatttttttgttttattttattttttaaatttgagacaaggcctcgctctgtcgcccaggctggagtgccatggcgcaatcatagctcacggcagactcgaactgctgggctcaagggatccccctacctcagcttccgaggagctaggatgacacgcgtgagccaccatgcctggctaatttttagattttttgtagagacggggtagctatgttgcccaggctggtctccaactcctgacctcaagtgatcctcccgcctcggcctccaaagcgctgggattacaggcgtgcgcaaccgcgcggaggcaatctagaaactgcagagggagcacggacctgggcactgggaagaatagggcgtggacttggagtgtgaccgcgtttgaatctgggttgtgcctgggacaccccacctcctgggccgtaggtggggggggagagagagagagagagagagagagagagaggatgtcgaccttacatggctcctagctctccgcgctctagccgaatgcctggttcctagtgggtgcttgatacgtgggaaatgtagggggagggggtggcggggcattgggaatgtcccgcagagtggatttcgggagagtggcgcttttctctagaactctcttccggttacacctggagtaaaagcttgacactctagaaggaaaaccccagatgagcagctaggactgagggttagcggtaggcgggagcggggagatagtacaagtacgcttcctaatgaggcggtgccgcaaaataaccaattttaataaagactgcagagaagaaaaccaggttctgctggcggagtgcacaggctcccagccgagcgcccaacaaccaggttccgggcccaccctgccgcagcctcttggaaatctctaagttggaatgtgtgcgtgcgcaccacgggtcactgccctctttgtgtgtgaatttgaagcgaaatctgggcgaggcggggccgtgctactagcaatcggacccacagtcgcggttccaagaagccccgaagcttccccggcttcccgcagcactgctgggagggcacacggcgcctctgtccccaccccagagcgtggggcgcgcggaaaaaggtctggtgactgccctccccgccgccccccgggagcgtgccctcccgccggaccctgggactccagagaagcgccgagggcgcgagtacactaagatatacgaccttccctggggaccgggaagggcacaaccacctcttgcaactccgccactaagacgccttgggtcaccaggcccgggggaaaactcgtccccgtcccaggctctcgattcgggccgcagctcacgtcccgcgctcctccctgcgcgccgctctgctcctccctagtcccgcctccagctccgcccgggcgcccagagggcaaatgaggggcggcggggtggcgggtgggggggagacgcggaatttcccagcgcgggggctctggcttaccctgcaaccgggcagtctctttctgtttacggagagaaaggggaaatggaaaagtcggggaggcggtggctggcgtccgctgcgccgcccctgggcaggctcagacgccgtgagtcaggggcagagcagggcggtctgagcgtgcgggcgacgcgggtctcactcgtccgctccgctctggactgcgcgccacgctctggggtccggcgccctggttcctgcttctgccgctgccgccgccggatcccagtggcccggcgtgctcggctcccacaggcctgcagccagcatcgcaccgaaccttcggggggccgcggctggagcgctcggccggcgtgggagcgccaaggccgcaggtaatccagggttgggggtctccggcgtgtctttcgggtcgcgtcccgcctgggtgccccggggattcccatgcagaaatggagggtgcccccagcagaggggaaaactctggcgtgggaagaggtgggggcgtgcccacagctgcgctcgcgggtcgccggctgcaccaggcacagctggaaagcaccttgcgcaagggtctcacggggtgcagactcgcgactcctcccccttcctcctccttcccgtatccgcagcgccagggcagtgctggtctgggcagtacgcggggaagcggggacccgctgtcactgcgcctcccgctgccgacgccgcctggacggccgcactctccctgcccgagacccggtgagtgcagctcggaggctggaggacccgatcctcccaaatgctgggtgctttgataatttataagccttttaggctcccttgacttagagaaccaggaggaaaggagtgggagtgtgggttggcggagcccagagacttgtgaatggctgggactaaattcaagtttgtaacccggactctatcccatgactaaagaggtcatagcagaacacgaaggctgggcttttggtctaagaaagaatactaggagaaaaaaaaagttattttcacggaagttgttttcgagcgatagtgcatgatcaggactctgaaatttttctagctctgggcggagaaggacgcctagggattgtctccatagttaacaggggaaggccaccggctgcctgtaagagagaaacgttgcgatgcttgtctatttcacttttgggaagacaagattaaaggctgctcttgataaaaaacagggacagaaaggctcttgcagttgctttacatacctgtggcctgagtcgtttgtgccaaggagagtgtaatccacttccagctgacgcccccagctctctgcgacggattgaggtttgtgtgcaggacgtctggcatacggcccatgaggactttgtcgtgtaaagcaaatgggaacgttgaggcatgtagaggttttgaagcagagtgtcggtccttccttccatacgcctgaaacgcataatccggggctttttgagagcaaaaacatagtcagaaatgtgccctgagggagaatgtactattttggcacacatatgtatatatgtatatataatttttaaattttttttgagagggggtttcactcttgtcgcccaggctggagcgcaatggcgcgatctcggctcactgcaacctccacctcccgggttcaagcgattctcttgcctcagcctcccgagtagctgggattacaggcgcccgccgccacgcccggctaatttttgtagagacagggtttcaccatgttggccaggctggtcttgaactcctgacctcaggtgatgcaccctccttggcctcccaaagtgctgagattacaggcatgagccactgtgcccggcctaaaaaaatattttaaatgagaaataacacaagtaatagtcattctttgttaggcagaagcatatgctgttatgctggccattttcattcacacttgccaggaaacactcacattttgtttctgtatatggaggcagccaagagtattatgttaatgtttaggaagagaatttcctcgtgattttattgctgatttctgaaataattcagtgtaactaattttgactgtatttgcacatctctccaattccaaaagctggcataattttctgtttggttaggaagtaggaattttatgaggacttttattgtaaactgtgtcaagggaaaaatcatcttatactaaacgtctttattgccaaactagaataccttcacaatctgaactttctctagatgggcacagatcatgaataactcagaaaccattagcatattgtgtgcttaattaaggctggaaagtgctgaggctttttgcaggcgcagttagcaggcgaactggtcagcagggtttctggggaacgtagatttgcgtgacaggggccctgtgttgctaaggaattaatgcaggcactgagaaaagtctcagcgtcagacactcctccacctcccgggtcctgcttccctccctctcccctttccaggcaactcacagtttaggggtgtggttgtgtgtgttcaagctcttgggttttacatataaatgcctgagacttttctgcagggtttaaaaactaacatcttgtcttacagctcttttaggatttgtcttttagaatctccagtcctcacaggaaaaccccccaattaaaaaaataaaagaataaagaataaaaagaataccactactactataaaaaaaaaaaaaatcctctaaaatttgtcttcccagatcagcagagtgaatttgaactgtgtggacttttttcctctttctttcttgagtcatgttagtactgagaacttttttttttttctgtcaaatcatctgtttgataaataagtccaggagacttggatcctttcaacccctgaggccctaaattaggctgttttttttttaacctctgtgtttccagtaaattcgacaagcagaaactgcaactaaacggctcagtaaaaccgaagtcaaatgttcctccattaatctaagaagttgctctcctaactcagcagactccaagaacctgaatcacaatctccctcgaagatgtacaagatctcaggaggggaagctgccccctcactctagatttcacggtggtgataacagccatgaaagcatttcataggtttctgccttttttttctctctctttatgtcttgttttagatgcaatcttcttaccgcgaagaagccaggggaataggtagccacatcttgtttgcagataagaaaggaagctaacgcagtatctgcaaagccaggagtctgactcagtacttttctcactcatgcatacaaagcagctaaaaatgacacagcttatttaccatgcccctgacactgcactgagcactttatgagcttgaactctgttaatcctcacgaccacctcatgaggtaggtgctgttattacttccattttacagatggggaaaattgaggtcgagagaggttacgttacttgctcaacgtcatgcaagcagtaaatgggagtgtggggggaggcaatgagatttgactccaagcagtctgagaccagaggaatgttggattgcaggatgctaaactgctttcctcagacacaattcatacgtcagaaaatgaccatcaagtaagtgaatgatgacactaaattgcatggttcttttgtcaaatgaaattcactgagaggcagatggctgggtcatgcgtgcaggtggctctgcagtggagcatttcctggagctttgaaatgaagctccagattgatcagacgtgcgtggctttagccctgagtgtcctgtgtgttaaaggcttgtgcttctcagaacttgaaatacctttcagaaagaggctatgcttttgggagtgcaatcggtgatttaagtaaaccaatgtgccttgaaattctcttagatctcttaggaccttttgtcttttctccttcagaacagagttgttctaaaatcctgagtaacaacgtcagtttttacccttgctttactttctttttctcatctacagatctccaagtgtggcagctgatttgtatataagagctgaaatgcaattttggttaatatagtcacttggacttgcttatgataaatttgactttcctggcttctttctactactcacagcttctagaaggccatttatttatatattaatcttctgggaccctcaagatgtttgctttgcactattaaagaattctggtcctaagggaggacagctgaatcataggttaaatgtatcatcatctttctcatactcatcactgggagaacaaggtttcctgtcatccttccaattagctgtttaactcatttgcataagaatcattcctgaaacttgacctattgccatcaaatttgtgtagattgaaatccatttttccagcttctggctttcagggcctgagttttatttgccaagttagctcctgcatttagtgaagaggttatttttctttaaagtcaccagaggcataaaaaagccatagcgattcttgcagggagggtgccacttcgggggaatagctgggttgtgtaaggttggaagccctaaagagccggtagcctaaggtcttcaaagatttctgagctgctcttgattcgtgtgtatgtttagtgaaagtttgttttcagtgcctgtagctgataccactgactctgtgagtaagagtaagctctctggatctcaggtttccctctgcaaagtgagctggactaaaggttatcttaggtccctttcaactctgcactgtcaacttgaattcatacacacagttgacacagaaccctcgttttctgaacaaaagcatataaaatcctgttgccaatccttgtatgtcagtttcccatgggtcttgaatgcaaatacaaatatcgtaaactaaatatttgtgttttctttcctagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtacgtttctttccgatcagttgggtgctatgtgctcagctttcctgctgcagcttcatttaatgcagagtggtgtttgaatttggcttagatgggctggcaggcatgattttaaaaaatgtaatcatcagtaagaagtacttccatgttaaagatgcaaaaaaaaaagtcttcattaaaatttctatttaaagattcttgatcatattttagtagtatttctacaaataggtaattaagaagaatgtattttggccgggtgcaggggctcacgcctgtaatccgtgcacttggagaggccgaggtgggtggatcacttgaggtcagcaattagagaccagtctggccaacatggtgaaaccccgtctctactaaaaatacaaaattagcctggcatggtggcgggcgcctgtaattccagctacctgggaggctgaggcacgagaatcccttgaacctgggaggtggaggttgtgatgagccgagatcacaccactgcactccagcctgtgtgactgagtgagactctgtctcaacaacaacaaagaagaatgtattttaatttaacagttcactaaaaagtttattcatcagttatgcagaaaagaaaggcttaatgagactccttcgtctgagaggggaataaacactttgtcactaattaatcttgaaggctgaattatttgttcctttcttgtcacatcttgaaatgttattaattcatttcttgcaaaaatgtagtatgtaggcagtaaatagctatccacagattcactctctttcattggcaaagtatgaatggcaagtgatatatttgcttaatcatcgcaagtatgcaaatcatgcaaaatattgtggcaacattttgttgccataatagtagatcaggtgatgtgtttaggtgtgcctgggattctgtcaggcttttagtatgtcagaggtgaacgtaggtgctggctaaaggtaacctaatatttttaaaaagaataatttgcaaaggagtaggtggtagcttgcaaaacatgcttattgatgaaagtgacgccctttcttttggtgtatctaaatggcaaaatggctaatgttgggggaaagtcggtgctgaatgagtgcggagtccagaaaaagtacttaattattttgtttttttgcataccacattcatttaattaaaaacaacagagtaatttaggtcaggtatgtagtgaattgttttgtcagaagccagtcatactcaaccatagctcacaatggagcaagataatattttgcattgttgtgtgactgctttggtctggctctatcaagctctatttaatagtcgactaagtactttaccttcagaatatttcttccttttataaatgagaaataatcatttgaactagaagccatatctgattttcccaaataaaggatagttggagaactcgggttcaaagttatatatatgtctataccgagaaatataattgtttgtgtatttctctcatttttaacgtatttatttgttaaaatgggaattaaattttttttaaaatcctgctccttctataaaaatgagtattttaaatgaaaatatgcagaaaaaaaaccaaagtattcttgcttgtaaatatgcaaagacttaggtatgtttgcttattccgtggcctatctgggaatgtacagaaagaaattcaggaaatttagaagaaatacaaagaaacaacattctgaagtcttttaggaatgggaccagaaaagttaatcctaaaaagaagagagactaagacattaagatgaggataaaattgtatcagcaaagggtttgagtaaaatgttgtcattacctgctgtgggtcctgtgctctttaaaagaacaagtacataattaaggagaattcttttttttttttttgagacagagtctcgctctgtcacccaggctggagtgccgtggcgcaatcttggctcactgcaatctccgcctcatgggttcaagcaattcctctgcctctgcctcccgagttgctgggattacaggcctctgccaccatacccggctaatttttgtatgtttagtagagatgggttttcaccatgttggccaggctggtttcgaactcctgacctcaggtgatccacctgccttggcctttcaaagtgtggggattataggcgtgagccaccgcacctggccaggaaaaattttaagaataaacaaatacataagtaaaggcagggatcttgaaaaactttaaaaagatttttattttaaaatgatcaagaatataacatataaaacaagaagactaaaaaacagaagagaataagaggaggaccttaaaatctattggatcttagatatggcctcgctaggcaaatcgacccagtggtcgatggctctggggggctgcggttgactttcctgccactcacattaaagatggactacattgctgtgcctgctaggtaacccatcagagctccatgcttcataaatgatagcctaggaattgggactgtcatctctgattgtagtcacttcaagacagtagtgagggaggcaaggcttgctttcggctccctttcatcctcacgtggaacattggaaccacccaatgttcaagatctttctattcccatcatcttccacccactaccctatcagaactttactcactgggcttcatttgctgctctctaactctcagctttaggaaaatagcagctgattggttcctaggtaaaatccatctatatgatgtatctacatagggatggggaaactttcattcaagtatttacctattcatttgctagacacagcttggacatctgcagtgcgtcgggtgctagagatagtatggaacagtctgtgcctctgggagcttgctgcctggtgcatgcaggatgcagttgaataggcagttatagcagagtatgctgcttcccagcacgtgtgcatgctgtttgctctggcagtgcacaggcaggatactttacatagccatgagtgtggtagaaggaaggagaatgtcagcacagccttccaagaaggatttatgcctaagccgaggtctgaagtgttgagttggagtcagctagatgaagtggacagggtccaggtggagaaaacagcatgtgcagaggtccagagacatggagacctgatgtattcaggcagccaacaaccacaacaccattgagttatttagacagggtagagaaccaggaattacaaaagcatcctgaagaacaggcatgttcagtgattgtgtgtgtgatttgactaaaaataatatctgttaaagatcccaccaacatccagcaagatctggggaagaagctttgggagactaacctgggaattgctttgggtaagagtgctgcatgttatttatcatctacgctgattcataacctggcccgggaacaaataatctaaaatgagttccaaacactcaactctttggtggttttatggggactgaaggaccccaaaaccttcaccccttttttacaactttatatctataagtgtgagagctgaagatgttccttagggcttagtcatggagtcatggcttctcagagttgaaaaagcctttaagatacttgagtccagccctccgtctagtactcaaatcaccctgttcatcatctccaataattggtagaacattttggtatgttcttgaaaatctcctgtgacaaggagctcattacacactgggacacaaagtttcctatttgtccagtcctgactgtaagaaagttctcttccttatatagaaccaaaattcatctctgaccgtttagtgcaagccctacttattggccattaaaaaaagtgcatatgatgagcagtggtgaagacgatgggtcctgaattaaagtacctgggttatgtagttcagctctgaaatggattggctgtgtgaccctgggctggtcatttcacctgtctgtgcctcagtttactcattcataaaatggataacatcatgacactccatagagttgatatttggagcaattaatgaatacatgtgacctggttacacatagtgagtgttaaatgaactcgaggcattgtgggagttactgttgtatacaattgttacaccccttccttatgacagtccttccaaaattttttaaattgcatgttccccagatcttgtctcttctttcacatgcatttccaactgtgtgcatgacttctcatgaattgtactattaactctctcatcatctgggcaggaccctgtgaactcaagcttgtattagtgtctatcttagagccatattttgaatgtgaggatccatttgttgtgatcagcagagtgggacagagctagcttggcctttgtgctagataatatgcctgcatgaatatagatcgataccatgtctgtttcatagtagcatatcacaccagtcacttgtggaatctattcttactataatacttaaagagttttctcaatatgctgcttcttggcccagtgttgtttcgtataaatgacagtgatctggatgaggagataggaagtgtgcttataatgcctgcccttacaggtgattttggtaagttgaagaactggcagagataagcagcatagagttccctaagatggtttgatagcgctgggtgtggtggctcatgcctgtaatcccagcactttgggaggctgaggccagaggatcacttgagcccgagtttgggaccagcctgggcaacatagtgagacccccatctccacaaaaaaataaaaaagtcagccaggtgaggtggcacacacgtgtagtcccagctacttgggaggccgagatgggaggatcacttgagtctgggaggttgaagctgcagtgagctgtgatggggccactgcactccagcctaggtgacagagcaagaccctgtcttaaaaaaaaaaaaaatttatacgggcccctagaaagaagaaaaatacccatctaaaatttaaatacagggttcgagaccagcctgaccaacatggagaaaccccatctctactaaaaatacaaaattagctgggcgtggtggcacatgcctgtaatcccagcaccttgggaggctgagacaggagaatcgcttgaactcaggaggcagaggttgcgatgagctgagatcgccccattgcactccagcctgggcaacaagaacgaaactccatcacaataaaataaaataaaattaaattaaattaaatacaggggatctggggctaggggaagaaccaggcatttgcagaactgcaaactggtcaggacttgcacgttacactagaaattcagggcccatcatgaaaagagcctaggagaactcataggcattgaaagctggtccccagaatctgggaagttataaaataggggtgaatgggggtgaaggaacttgcattatttgatctacagaggagaaggctaaggtatgctcagaaaatatgtaaacacataaataactgagttatttttataacccggcatttaataactgggttttcatcttagctcagctttaattatggccttctggaatatacaaggctcttacccagactaggaggtatgctttggagtcagacagatctgagttcaaatcctaatgccagcactaactagcatgttccttaacctcttgaagtcagtttcctcatctgtgaaatggagataaaaatagtagttaagctcagactattgtagacttcgatgagataatgtattgaagtactgagcacattgctgtacttagaactcaacaaatggctgaaattatcttttgtcctcttggacagaataagaggacactggttcgaggtgggttataggccaggcacaggtggctcacacctgtaatcccagcattttgggaggccgaggcgggtggatcacttgaggtcaggagtttcagaccagcctggccaacatggtgaaaccccatttctactaaaaatacaaaaattagctgggtgtggtagcacgtgcctgtaatcccagctacttgggaggctgaggcacaagaatggcttgagcctgggaggcagaggttgcagtgagccaagatctgccactccactccagccactgcactcaagcctgggtgacagggcgagactccgtctccaaataaaaacaaaaacaaacaaaaaaacctaaactgggttataacaaatttaggttggtaaaactttcatgaagatgagttaaacacagagatggttcactggagggtgaggtgaaatcaggcctgtaaatatttaatgacaagaaacggaaaatcagcaagtgctcttgagtgttgtgagtagggttctgtctaaatgtgaaaagggactaaatctatcatgttctcagcatgctgcaaaagaggcctccagcaaccagaggcgacatacaggttatctttcaaacaaggcaagaccgccatctgcacttattcatgttagctctagggccctgcacagggtctcacacagcagaaacactcagtaaatagtttctaaatttaatgacttcatatttctaagcattagagttagtctctgctttattccctgactaatagtgaacacatctgtttgtgggatgtgtagctaaaattagcagtggtggagctgactgaatggcccttacagttactagaactatttctgtagccgtgtccctagtaagaagtcccatgcatctgcagatgaatcaagagttcattctcttcccatgtggtagatctggggatttgtcacattcccttcagcagctgctgctgcctcttttaagttttaaacaaaatagaaatggagtctcactgtgtcacccagactggtcttgaactcctggcctcaagtagtcttcccaccttagcctcccaaagtgctgggattataggcgtgagccaccgcacctagttgttcagcttcttctgttacttgaaataagttaaggtcctttaatagtttcacaattcctgagccaggcgccgtggctcacgcctgtaatcccagaactataggaggctggggcaggtggctcacttgaggtcaggagtttgagaccagcctggccaacatggtaaaaccccatctctactaaaaatacaaaatttagccaggcgtggtggtgcgtacctataatcccagctactcaggaggctgagatgagagaatcccttgaacccaggaggcagaggttgcattgagccaagatcgtgccattgcactccagcctaggcaacagagcaagactccatctcaaaaaaaaaaaaaaaaagaagaagaagaagtttcataactcctgaattcagaatcagaagccataatattactgattacattgaggagaaactggtactgaggcgatttatcccttgaaagaacactctggacatgttacaggcacgcgttccagattgcatttcccatgaactaccatattattttgttttaattttaattattttctcttctaattttttcctctttaaaaattgaaatatattttatatatagtcaaatacacagatgttaaatgtccaattttacgagttttgacaaatgcatgtgcccttgaaacccacattgctgtcagaatagacctcttaattcttgttttattattttaaaatttatattgtgtttttatttttttctgtagaaatgaagtctcgctatgttgcctaggctggtcttgaactcctggcctcaagatatcctcctgcctcagtctcccagtatgctagtattacaggcgttatccactgctcccagctgtctctcaatttttgaatcaactagtttcaaaacttctagttctaagagttggcttgctcatgaaccctgggaggtcagggatcagccatctcgtttgtggctgcctccgcagcaccaaacacagtgcctagcacctattttgcaagcaatagataacaatgcatgcgatagatattaagtgagcaagtagatgcaaagtaattctgccctcacttaatttacatagcattgtcaactcatagctctgacatacgctgtggttttccaaaatcttccatgatcatcagttaattttgatgttctttctctgtatgcgtcatgtgtgagtaatagctatgtggactaacaggttcgcacattgtaatagaaacaagtcaacctgcaggcacggtttatatttacgcaatctttattttcagccttttggttgccgtagtcatgcttttttagataaataatttttaaagttctatttggcaattaattactcatgagtaggtggaaatatgaccaggtctgaccaggcacctgcatctgttacatgctctctctgacttcctcaagctctaaatatagtctctgtacagttggtaggattaagcacagtgacattaatttcataactgtgtatcagaatgctgctaaaataaccagcttcctaataggtgggtcttagaaaaagccagcttgactgaagttctcaccgtctcacatttttattttgttgtaggtcatcactccccaaaatggacgttaccaaatagattccgatgttctcctgatcccctggaagctgacttacaggaatattggttctgattttattcctcggggcgcctttggaaaggtatacttggcacaagatataaagacgaagaaaagaatggcgtgtaaactggtatgtgttttctacctagataacccacactgtgtgtttggcattctggcttttgtttttttgtccatttgcattaaccaaaggtttttatcgtttgattgggtcttatctgagggtgcactgcctcaaagcatttgtttttctgaatttattggctacttggggccattcagccctaaaatctctgtttaggtgcatagttgattttaatctagatgattaaaaggataagtgctggtttttaaagcactgatttggataaataacatcatcactcttggagagaagtagagaagagccatcctgcaaagtaggagcaattctctgtgcttctcctttcattccgcccactgcagagggggccaggcagaggcagaaactgggaaggaggtagccttttcaggaaggcagatttaaagggctgaatttaaatacatcaatgattgaaaagaccctatcccaaattttttattattattattattattattattattattattattatttgaaacagagtcttgctctgttgtccaggctggagtgcagtgtcggggtctcggctcactgcaacctctacctcctgggttcaaacgattctcctgcatcagcctcccaagtaactgggattacaggcacctgccaccatgcccagctaattttttgtattttcagtagagacgggtttcaccatgttggccaggctggtctcgaactcctgactacaagtgatccacctgcctagccttccaaagtgctgggattacaggcataagccaccgcgccctgcccttatcccttcttattaaacaataactgccaaggtgccactactttggaaaactgtatctacataaggtgagcattcacaccccctatgactcaacaattcctctcctgtaggtgcactcactccacagagacctgtccacgtggccaccaaaaactaaaagctatgtggtagcatgttcatatctgcactatttgtaagggtcccaaactagaaacttccaaaatgctgaaatgggatatatttacttagtgaaattctggatagtaaaaagaataaatgatttacaactataataatgtggattaatctcataaccattatgttgagcccaaatagccagacacgaaatgagatctactgtatgagattctatttatataaaggaccaaaacaggcaaaacaaaatctgtgctactggatgtcaggatggtgggtacccttggagagtagcgactggaaggggccaagaggggggcttcttgaatgctagtagacatctgtgtgttttttctggtttgtttttctttttgagacggagtctagctctgtcgcccaggctggagtgtagtggcgcaatcttggctcacctcaacctctgtctcccgggttcaagcgattcttctgcctcagcctcccaagtacctgggattacaggcactcacccccacgcctggcctgacatggtttttcattttgatttagatgggggttacatttgtacgttcagttgataattcattgagttggacccatcatttttacacttttttgtatgtctgttttactttaattaaattttcaaaagtataacaaaataaaatacactcacttttgatttaacaaaaaataaaataaataattgccaaatattatgtcttggtttctcttattgtaataagagagtagctgggattacaggcatgcacaaccaatgcctggcaaatttttgtattttttgtagtaacggggtttcgacatgttggccaggctggtctcgaactcctagcctcaagtgatctgcctgtgttggcctcccaaagtgttgggattacaggcatgagccaccgcccagcctcagtgcttattttaaatacattgctataatagagtatgaactgtggcaacaaacacttcatattatctcacaaccaactgaaatattgaaaatacaacctaaactcaaggtaccatagatactgttgtctaataggtgggaaattatctcttttttgattcattcataattttaaaactttggatagatttctgacttctaaatgaaaagagtaactcattattttgttttttattttcttgttctgaattttatacttaaagctgactaacatagttaaaggcagatctgaggtgaacattattgtaactgggcagtccattttcacacagggcagagtattcttgagggcatttatttgccttttgttttttgcattgacctatattttatatttttaagatgactttggggttatttagaatctcgcttgtatttttgtgttctagatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatgagagaatttgaaattatttgggtgacaaagcatgttctcaagggacttgattttctacactcaaagaaagtgatccatcatgatattaaacgtaagtatctttggacatatacctttttggctcaaagagactagttattcaggagacaaacaagctccttcctgtaatctgaagaccctccatggagggtggaaagctccctcagagcaccgtccgtcttccttctccagagacatatcttagaatcatgcggggttactagagctttcaaagtcataaggaaagattactttcaacagttgttgaaaggttatagctacatacctattaggtactgctctgttaaaaaggcttttaaaattgcaatttaggctgggcacggtggctcacgcctgtaatctcagcactttgggatgctgtggcaagttgatcacctgaagtcaggaattggagaccagcctggccaatgtggtgaaaccccgtctctactaaaaatacaaaaaaaaaaaaaaaatagctgggcatggtggtgggtgctggtaatcccagctacttgggaggctgaggcaggggaatcatttgaatctgggaggcggaggttgcagtgagctgagatggcgccattgctctcccagcctgggtgacaagagcaaaactccgtctcaaaaaaaaaaaaaaaaagcaatttacttaaaaacatacaaacacagagacaagtatttttgagaaacaaatacctttttcattttttataccaatgtaacaataatccattaaacacacctttactaactgttttctaggagtctgatatgatgaggaaataggtaaacctttaatagccagtactaaattagagtggcacaactttcactgggaaaaaagatgggtattttacttttctgttttagaaaagtggcttgacaacagtatgcttatgtcttagagtttgaaattcaagttcttgaacattattaatggctacaatcattcatacccacattggctgtattcttgatggatccaaagtgattttcacctcaactctgaatttcattctcctcttttgaatataatacaaccatctcactagaggaagcatttcagtcttttctgattggagattcattattgttttagataatgttttcatttgacttatgggtatataaaaaattttatcttaaaaatatttcctctcattttagctagcaacattgttttcatgtccacaaaagctgttttggtggattttggcctaagtgttcaaatgaccgaagatgtctattttcctaaggacctccgaggaacagaggtaattatgttcacatgaaaagggttactattttattaagaataaaaaggaaaaaatgttctagaattattgtgggaacgaaggacaaagaaggggaagaaacccactgcattaaatcattattttccttggaacacatttaatgagcacttgctctgtgtcaagtactaagtttagcacttgattttttattgtattttttgctatgttatttataatacataatagtatttgtaatataatatacatgttgatatatataatatagaacatttgtacacaatgtcatgtcaaaatagatcacattggccaggtgtggtggctaatgcctgtaatcccagtgctttgggaggctggggtgggaggatcaattgagcccaggactttgagacaagcttaggcatcatagcaagaccccatctctataaaaaaaaactggtttaggctgggcacggtggctcaaacctgtcatcccagcactttgggaggctgagatgggcggatcacctgaggtcgggagtttgagacaagcctgaccaacatggagaaaccccgtctctactaaaaatacaaaattaaccaggcgtggtggcgggcacctgtaatcccagctactcgggaggctgagggaggagaatcatctgaactcaggaggcagaggttgaggtgagccgagatcgtgccattgcactccagcctgggcaacaagagtgaaactccatctcaaaaaaaaaaaaaattagctcagtgtggtggtacacgcctgtagtctcagctagttgggaggctgaggtaggaggattgcttgagcccaggagttcaaggctgcagtgagccatgggcattccagcctggatgacagaacgagatgttgcttcaaaaaaaaaaaaagccccccaaaatagatcatatccacagttcggctttattttgtgtgtttttgtttttgtttttgagacagagtcttgctccatcgcccaggctgtaggacagtggcgcatgatctcagctcactgtaatctccacctcctgggttcaagcgcttcttagtctcctgagtagttgagattacaggcatgtgccaccacatccagctaattttttttttttttcagtagagatgcaggtttcactatgttggccaggctggtcatgaactgttggcctcaagtgatcctcccacctcagcctcccaaagtgctgggactacaggtttgagcccccgtgtctggcccacagttcagctttaataataattatagaattagagttaactttataataagtttagcacttaaaaagcagtatgttatttaatccttacaacaacccagttgttgctattgttattcttattttacaatcaaggaaataagtttgcagagattaaaataaagtgtccagagtcactcagtgacagaccctggacttgaacccagttctttctaagtctaaccctaaggtctaactgctacataactttaaaaaattataatattacatacattattaaaatatattagtgatataactaatatcactgagttttggctcaatgacagtcttaactatggtcattaatatttatgaggactctaaaggcctctctttgagcctaggaattctataataaacctcaagtagtgagcataaatgtatcttatttaaagatgtaaaacagcactcatgtttaactcatctgtgaagcaaaaaatgacccagaaaagcctttctttcctgactctaaatgagattctgaaaaatgcgttcgcgggcttccaagtaatgtatttaacattcacatcattaggctgactgggtgattcaattagccagtgtccactgggcatctgctatgtggcaggttcttgtgagcaccaacgaggaagcatgacacaaggcagtgaggagcaagccttagtggtactccagcgatcctcactctttggtgggaggacttactttaaattacctgaattattaaaagagcaaccgtttagggatgggcgtggtgttctcacacctgtaatcccaaccgttcgaaaggccaaggaggtgggggtggtttgcttgagcctgggggttcgagaccagcctgagcaatagagtcagacctcatctcttttgaaaaaaaaaaagaaaaaaagaaggaagggagggagggagagagagaaggaaggaaggaaggaaggaaggaaggaaggaaggagaaagaaaaaggaaggaaggaaagaaaaagaaggaaagaaagaaagaaagcatgcacaacagtttagttcacagttgattgtgatgggcacaaggttggatgcaagcaggaaggtaaatgggtgtaaaagctgcctccttggcccctcaccactaccgggggaagctgcactgcctgagccactcagccccatgcccttctctttgctggaagtgcccataggaaatagagagagggtctttggctgcacctctatgtcaggattaccaggtcagtcttggtgttcaatcagatgacaacccttagtctaatctagctagtatacgtgttgcactgaactggattgcagccacaaaaaaattgtcttcctttcaaaccagattcttccagcctgggcaacatagtgagaccccatcgctacaaaaagtaaacaaacaaacaaaaactttactttttgtaaaaatggcatggtggtgcatgtctgtagtcccagctactcaagagactgaggtgggaggattgcttgagcccaggatgaggctgcagtgagctgtgattatgccactgcacccatagcctggaaaatagaacaagaccttgtcctaaaaaaaaaaaaacgccaagattctgtaagtcctttctcaactctctcaaagccagcactctcccgggcagcagaagaaatccttgcttttgtgaatattactgaagttattattgaaaatgctcgagcgaggattcttgacggttgtctttgagcagaacaatattcagaagggaagctgtaatttttttttttttttaagaatgcttagtccccagatcttaagaatactttaccaaagtgtgaggtctaataagacttaatgcttacgacatgttttctttggaaaatgtttcagcatatttggcattagtcaggagttcagatatgtaatattccaccaccctttttcctggaaccagtttgaaaaacaaactatttatggtattaaagatggaaaatacttttctcttcctggcaatgtggtgaagttgaacattttgcaacattggagaaagaagtgttctttctggggctgtctagcggaatgcatggatatgagataataacatattttactcctgagtagtatttggatcaggttttttttggcaaatgcaaattgctttttgtgaagtgcaaaactgagccttggtgtttataaatataaactctcttctaatcagcctgcatttaatatctgcctagtacacacgagttgaagtttgataatgaacaaagttgtgaagtgaccagtgaaacctttcaacaagcttgcttttacccttcctacttaaagagccaggagatctaattagtcaactgtgcagactggctgatgttagaatttgatcatgtggctactgcacagtcatagacaatttctgatttctgcagtatagctcccaaatgcaaaccctggttacccctgtttgattgctctctctaagcattggtattcagagcattctattgtaaccatgtaatacacatccagggttaatccagcatatacagaatagactgtttttgagttgcaaggtacagagagagaatacatagtgaatgcgaataacaaatcagaattacttttagaacttggtcctttttgaaaaatccttctaagtctgcttggttttacctttgtaagttaacatatagtcatcacatgcacatatacgcacacacacggtctctttccctttctaataaacatattgaaaggtgaagggttcgatcgctgacatcaaggttttctcttgctccagtgccctgccccgagggtgcagaactctcagagagccctgtgttggtcccaccagggctgtttcatgccttctaatcagccagagtgctcgaacattatgccctgctgctccctgatctaactggtagttggtagagcttgaggaacaagagctccgagccaggaagctctggggtttctacctgagtggcagcacccaggccaccaggcttacagatgttccatccccccaggctgcctaggcgtgcagtcacatagaacctgcagagccacctctgcacaacccctgtgggctacaccagcagtgggcactccgcccaatccttgctttattggcagggaggagggggtacaggagagaagataggcatcctctatggacagttaataatacccattgcatttctttttcttttttatttgattgtggtaagaacacttagcatgaactctaccctctcaacacatttttaagtatacaatacactattgttgactataggtacaatgttgtgcattaattttttaagtttgtgatatatttagtagcaaagtccttctggaaagtcctctggctctgctgcagggaaagcttgagaacgggagctcagtttcacctgtttgctgagagcaaaaggaagctggcccggaagtggcttgcaggaaggagttgagcagggttagggtggggagactgggcagtttctctggtttttgtaagctagttctctaattacttaccctgaaatgtgttccggaaacactgacctccattctcttattcacatggcagacagtgtacaagctgtttcaagcgaaatactgataatcaggatattaactactatatgtctgcaccagccatgaatacaaatcactggtcaccagtgtttgctctgttcctttttaaaaaaatgtttaattaaattaggtaactaattaatttgtaaagatggggggtctccatcttgtccagactagtctcaaactcctgggctcaagcaatcttcctgcctcggccttccaaagtgctgagattcagtggctcacgcctgtaatccccacactttgggaggccgaggcaggtggatcacgaggtcaggagttcgagaccagcctggccaacatggtgaaaccccatctctactaaaaatacaaaaattagccaggcgtggtagcacatgcctgtaatcccagctagttgggaggccgaagcaggagaatagcttgaacccgggaggcagaggttgcagtgaaccgagatcgcaccattgcattccagcctgggtgacagagggagaccccatctcgaaaaaaaaaaaaagccaaagtgctgagattatagacatgagccaccatgccccacctctctttgtttctttcttaagtttagaaataaatgctcgttagagaaactatttataaaaccagccctgtttattcagcatggactcatgagaccaaatataacttatacaatgttaatatggctgcatttaatatttagtcactgggctacatagtaggtaaaaataacagatagtttgtaaaaatgactctttagaatcacttctacaatattacactttattttttaagtttttccctttcaagaaatttgtgttaataccctatagacttctatcaccttttatcattgcagatatttagaaggttagcagtgtaatgacaaacagataaagaagtctgtttgtagttcatttaaatataaaaggaattggcgttttagttgaaaacttagctacacctgatcagtgtactgcagaactttgatgagtgggagtccctgatagattcctggttctaggctctttgccaccagatcaaccagaaaaaggtggtgttttgttttgttttgttttgttttttgagactgagtctcgctctgtctcccaggctggagtgcagtggtgcgatctcggctcacagcagcctccgccttccgagctcaagcgattctccttgcctcagcctcccaagtagatgggattacaggtgcccatcaccatgcccagctgatttttgtatttttagtagagaccaggctggttttgaactcctgatccgcccacctcagctgggattataggtgtgagccaccgcgcccggccaggtgttcttcatcagactgcagggacacctccagcaattgctgcatggttcctggggaatgcctgcattattctcctagtttaaggcaaatgagccaatttccagaactggattagggaaatggaaacccacacaaaggaggggaatgaagctgaatgtttcccacttctttttcagatttacatgagcccagaggtcatcctgtgcaggggccattcaaccaaagcagacatctacagcctgggggccacgctcatccacatgcagacgggcaccccaccctgggtgaagcgctaccctcgctcagcctatccctcctacctgtacatagtaagtggggttcaaccagggctgggggcggcgggggggggggcgttgagttatgcatcccgcaggcttgggagggactgctctgccttctataccacccccatctgaatgaggcaatggtgaaatgacaggtagctacaagttcttcccatgtagaagcaagctccattcttgcaaagaaaacatagctattttagtgggagcttactaaaatgtgcattgggcataatttatgctattccattgtatgtgtaataatgcaacactacttagtagcatcagagtagcataaatatttcagcaaaggaagttgtatgtgttctttgaacagttaaaacattttttattattaatgttcacaccagtgtggcttgtagtggaatatgcaattcccattttactgttgataaattcaggagcagacacttccctgttactgcacagtgacttttgggacactgatttgaagctgtcactgacattcaaacctatcacttatcttttgtaacattaaatcagaagatgggtttaacctggtatcctttagaaattaaagtgggccaagcacggtggctcacgcctgtaatctcagcactttagaaagccaaaacaaaaggatctcttgagcccagaaattcaagaccagcctgggcaacaaagcaagaccccatcgctacaaaaaattaaaaaaattagctaggtgtggtggtgtatgccctgtggtcccagttgcatgggaggctgaggtgagaggatcacttgagcccaggagttcgaggctacggtgagttgtgttggtgccactgtactccagcctggatgacagagcaaagaccctgtctcaaaaggaaaagaaaaaagaaattaaagggaagcttgcttgcttaagggctgaactgcattcgttgcagggcatgtggtggaaaacggattactttctaggtcctggtactagcatgcttttgctgttgagggtgtatcaccatacctttgatgctaagagagctggtttgttgatagatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctggtagggacaccctgctgtgtgccgcacacttacttcccttctctttctgtccacatcaaacctctgatgtagttcatgaaagcacttggaaaaaaaggaaatgacttcttgagtaccataccttgcttgagaaatttcagcaagattagcagaagcatgtttttttttttaaattggctaatttagcaccaaattataacagattttcagtgcaagtgtaggtagcacagtcactggaaaatgcttctgacttgcttttttgcaacttgcttttttacaacttttgtctttgaaaacagattgagcatgacagctttgcagttggttcttcttaactcactttttttttctttttttttgagatggagtcttgctctgttgccgaggctggagtgcagtggcatgatcttgggtcactgcaacctctgcctcccggtttcaagtgattctcatgcctcagcctcctgagtagctgggattacaggtgcccaccaccacgtctggctaatttttgtatttttagtagagatggggtttcaccgtgttggccaggctggtctcgaactcctgacctcaggcaatccacctgccttggcctcccaaagtgtggggattacaggcgtgagcaaccatgcccagcctaactcatttatattaagccaccccagtccttggtgggggaacatcatggcactgccctgcacagataaaatactcagtttgaagtcaacttgcatttccatcttccttggcttaaaatcttgccagttgtaaatttttcccacttaggaaagtcagtatgctttccaggagcattgaatatgcataaagagggatttccatttttattaaaagtctgtggcattcttaatccatttaggtccaaaccgagatgtcaagcctggtgcgcttgtttatatttctttgctgcttgtctaacttttgtgtatttaaagagagcaatctggctgttggaaaaatatgccaggatttctaactaatttcttgtctccattgactcctgtttgaactttttgttctatgtcatattatgtgaacttagccatagtgttcaaagacccatctttcacgcttaagacactgttttattaggccccaaagatttatttcactgcagaaggaacaggtatttatcatttgacacgttttcttgttacttactttgtaatgttttccttttcagattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattatgcaaataaaacccaatacttttgtccaatgtggttggtcaaatcaactgaataaattcagtattttgccttagttgttgtgaagcctgtgattctcagctgggactgaggatgggctataggagttgagttatagattggaaggaaatgtgtatcataagaaggcaaaaaataccaggagctttgcaaattgtattaatacactccttttctattgctcttgtatgaagctattgtcagctggaatggtttgcatcccccggtacattgaggtagaaaaaacaattgtggttgtgcctgtaatcccagcactttgggatgctgaagcgggaaaactggttgagcccaagagttcaagaccagcctggccaacatgatgaaatcccatctctacaaaaaatacaaaaatttgccaggtgtgatggtgcatgcctgtagtcccagctactcaggtggctgagatgtgaggatcacttaagcctgggaggcgaaggttgcagtgagccaagatcatgccacactacactccagcctggataacagagggaggccttgtccctgctaaaaataaaataataattgtgtgccactggtttagggttatgtggttctattttgcaccctgtttttatatatttatactatccttgaatacacgcttgcatactctttgcccattgttatgtggcaagctaataactagccattgtagaaggtggctttaactcacatacatcaactctagtgaaaactgttgaatggaagtctgtcatctacatagcaaatagtattaaacacttttacatgtgttgtgtaaaacatgccatcccttgtaatccatgtaaacacacatgaaatatgcattgctacctcttttttctcagagaaggaaattgaggcatagtgagggtaagtaacgttatcctcaagaccgcaaagcaagtgaagaaacagctggtatttaaacccagtcctttctggctccagtacacatgttctccctcgtacgttgctgcttgtaagtgagagatcaacactgcagaggaaacaatttccttttctgcccctctggtaagggcagaggcagactgaccatgaagctaatgaagcttcagcctcagggctcctcacttgcatgggcccctccatagccctgtgcctgattttttttaatgtattttttatttcagtgacttttggagtagaaggggtttttggttacatgaatgagttatgtagtggtgaattataaaacttcaatggacccatcacctgagtagtgtatgttacactcaatgtgtagtttttcaccccacacacctccccccctttattttattttttttgagaaggagtctcactctgtcacccaggctagagtgcggtggcatgatcttggctcactgcaacctccgtctcccaggttcaagcaattatcatgcctcagcctcgataatcccagtagctgggattacaggcatgcaccaccatgcccagctaatttttgtacttttagtagagacggggtttcgccatgttggccaggctggtctggaactcctgacctcaaatgatctgcccaccttggcctcccaaagtgctgggattacaggtgtgagccactgtgctcagccccaccctcccccattatttcactctgtatgcctttgcgtattcatagcttagctgcctgtgcctaatttcatatcaccctagatcaggcccaacaaaacttggacctgctcttggttaaaggtatacagcttttgataattttcatgagatactcacatagtcaatatgaattgagttctagttaacaaattccatttggagaaaaccattctctcttttttttttttctttttcttttttttttttaagatagagcctcactctgtcgcccaggctgaagtgcagtggtgccgtctcggctcactgcaacttccgcctctggagttcaagcgattctcctgcctcagcctcccgagtagctgggactacaggcatccgccaccatgccaggctaatttttgtattttcagtagagatggggtttcaccatattggcc

SEQ ID NO: 16328 - DNA, 68702 bp, Human
ctgatccgtgggtctataccatcaaccaccagactttttattctccagattatttgaagtaaatcttagacattgtatcatcttgccagtaaatatttcagaatgaacctgtttaaaaaaaaaacaaactctttaaaaattaaccacaacatatttatcacacctaaaattttaaaggtaattcctggctggggacagtggctcatgcctgtaatcccagtgttttgggaggctgaggtgggaggatcacttgaagccaggagtttgagaccagcctgggcaacatagtgagaccccatctctaccaaaaatgaaaataactgagcatggtgtcattcgccagtaatcccagctactcaggaggctgaggcaggagaatcgctagagcccaggagttggaggctgtggtgagccatgattgtgccactgcacatcagcttaggggacagaaaaagaccctgtctcaggacgaaaaataataataataataataaaaactagagttttttcagcccctttgcagaattttccgggagatacattcaagaaaaccaagatgtagagaagtctatatatgacaatctaatttttgtagaacaatggcaaaattaacctcttcagtatgtaggtatttatgtgtatgtgtgggtgtatgtatgtgatacataacaggtttttaacatgggttatagggatagaatgacatcaaaacagaaaaaggagaaaatctgtacctaagaaaacagcctacatgatataatcccttttctgtgtttgtgcaaatggtactcctatgtatatgcactttgcaaaattaaaaagagttatgatttggccgggcacagtggctcacgcctgtaatctcagcactttgggaggcagaggtgggaggatcatttgaggtcagaagttcgagaccagcctggccaacatggcgaaaccccgtctgtactaaaaatacaaaaattagttgggcatggtagtgcacacctgtaatcccagctactcgggaggctgaggcaggagaattgctttaacacaggaggcaggggttgcagtgagccacgatcacaccactgcactctagcctgggcgacagagtaagactccgctcaaaagagaaaaaaacaaggcctgtaatcccagaactttggggttcgcaaatcacctgaggtcaggatctcgagaccagcctggccaaccaacatggtgaaaccacgtctctactaaaaatacaaaaattagccgggtttgatggcgggtgcctgtaggcccagctactcgggaggctgaggcgggagaatcgcttgaacccgggaggcagaggttgcagtgagccaagatcgggccactgcactccagcctgggtgacagagcgagactcctcaaaaaaaaaaaaaaaaagttaacgattttaaaaacgattgagagggaatgtttaatgtcccttgatgtcattaaggaagtacaagggaatttgcttagaagttggaaaatgcccaagagtgtgggaaaacaaagacttagtgaccaccgccggtgctggccagccggagaaggctctgtggaaggtttggaggggagagaggggcagctggatgctcttgggccacggtcgctccctgatctctgcgcctcttcctcctgctccgggagaaataatgtttccctgggggatgaaaagcatctctttgtgcgggctttaattgccatgttgttgtgccaagggagtgagtggcaggcgggagcagcagctgggcacagccaatgccaggcagtggtgcccactccctcaggacggcccagccagctggctcctgggagcgctgcccacctctgcccccagctgggcgcctgcagaggaaccgaccacccgtggggctgggggaggttggctggaggaggagaaaggggcgggcatctgggagggtctcagccactctcagaggcttattcatctcatcctcctttccctccccccttcttgtttttcagactgtcagcatcaataaggccattaatacgcaggaagtggctgtaaaggaaaaacacgccagaaatatccttttggatgttgcttggaagaccgaccctgagggaggtcagctcatggggactgaggtcagggccaggctgccttgctcagctccaggaaggggcaaccctgcacaggccaggtccctgcagcttctgatgacggcagcttctcagagagggctggctgcagagaccacagaccttcagggtggcagacaccaaaaaggctgtggagcccaggcctttcaacttgccaaagatcctgctcctttccttaaggacttaagcactcctttttttctttttccaaaaggggtcttgccgtgttgcccaggctggagtgcaatggcgtgatcatagctcactgcagcctcaaactcctgggttcacgcaatcctctcgtctcagcctcccgagtagctgggactacaggtgtgcaccactatgcctggctaatttattttatgatttttagagatggggtattgctcattgcccaagctggcctcaagcaatcctccctcctctgtaaccccaaagtgctggaattacaggggagagccactgcacctggccgactcaagctttgtagaacctcatagtcacttgaaagttactttcctttgagagacctcctgggggtcaggagggatcttcacctatattcaaagccctccaggtcctttctttgcctttacaggaacacagggaccactcccctgggggttgcataatcaatagttatctccttttctgagcatgaaagcaaaaaaaaaagaaaaagagagttttttttttttttcttttttgagacagagtcccactctgttgcccaggctggagggcagtggcatgttctcggctcactgtaacctctgcctcctggattcaagcgattcttgtgcctcagcttcccaagtagctgggatgacaggcgtgtgccaccacacccggctaatttttgtaattttagtaggaccggggttttgccatgttggccaggctggccttgaacgcctggcctcagcctcctaaagtgctgagatcacaggcatgagccaccatgcctggccgaaaaaaagaaagtcttagcttcagaggttggttggccttaaactgaggcaggggctctctaccttcgtgaacaggttcaacctatgccagggggaagaagacaagagccttgaagtggattagggaatgggtgacttgaaagccctctgtaagcccaccacacccaggagcagcctgtggctttgtagagaggtgcaggaccatgctggctgatgaatccctaggaatctgcctttgagttgcagaatccaggaactggagcgcttaatccccaaaggctgaaggagagagtctgccaggggggtggctaagcttttaactctctgtgtgctgggccagagcaaggtggagttccgggcaagcagagttgggactttttttttttttttttttttttgagacagagtcttgctctgtcgcctaggctggagtgcagtggcatgatctcagctcaccgcaacctccgccttccaggctcaagagatccacctgcctcaacctcccaagtagctgggaccacaggtgtgtatcactacccctagctaatttttgtatttttagtagagacggggttttgccatgttgctcaggctggtttcaaactcctgagctcaagcaatcctcctgccttggcctcccaaagtgctggaattacaggcatgagccaccgcgcccaacttcggaggccgcacccagcctcagaggctggacttctgtctgcagtgggaagcttctcctcacctgggctcttggttactgtgtcacagccaggcaagccagagcagcttgtcccgaagccttctagcctcaacccctagaggcgaccctccaggttagatagccagagaagcccagcattgcttagtgtgatatatgaactgctgtttgctagagggaaagcagcttgcctttagtgggaagatgctttggctggaattaggatggcggctgcagaacctctctggggtaacccagaagtccagccctgtgcgagcctagctagatcttgctctttttttccccagaaagacacaggccccttggtttcctgcatcacgtttggtacccttgcgatgattcaaagcaaaccaagaaaagcctttattttaaacggcccagtggattttctcagaggaaatgactcagccctgacccttacctacgaataatttgtgatcaatctgataaaagatatgagtaagggagagacagttatcatcaggcagtgtgctgttcaggacaagacatgggtgcagagaggccaggcctgcagcggcagggtcaggtcacatgctgccgggaggctccctgggaggagggaaggggccctgcaaggagattctgacattctgccactggaactctcgggctcactctgggaccttgagtggggcctccatgagtcttaggtcactttctgttcaatcaaaggttggacaaagaagatttcaggccaggtgtggtggctcatgcctataatcccagcactttggaaggtggaggcggatggatgacctgaggtcaggagttcgagaccagcctggccaacatggtaaaaccccgtcctactgaaaaaacaaaaattagccaggtgtggtggcaggtacctgtaatcccagctacttgggaggctgtggcaggagaatcacttgaacctgggaggcagaggttgcagtgagccgagatcgtaccactgtactccagcctgggcaacaagagcaaaactctgtttcaaaaagaaaaagatttcaaagatttaacagtccagccctaacattctatgagtctctgattcataatttctaaatggtgaataaatgttgaaaaatcaactccatacagtagggtttgaaatgcctaattaaagatatcccaaagcttttttttttttttttttttttgaggcagggtcatgcactgtcacccaggctggagtgcagtgacacaatcagttggaggctcactgcagcctccaacttttaggctcaagtgatcctcccacctcagcctcctgagtagctgggactataggcacatgccatcatgcctggctaattttttatagagatggggtctcactgtggcccaggctggtcttgaactcctagctaggctcaagcagtcctcccgctgggcctcccaaagtgctgcaattacaggcgtgagccaccatgcccagcgcatttatctattatcaggtcttttatcagctgccttagatacaaactgaataagcattaggaagtctgacttcagaaatgctgcttacacatttatcacagatgcctaaatggtgaacaggttggcccgccaccttggtattcactcctggagggctggggactgagtcttatttttcttattttcttttttttctccctgaatggattttacaggctttgacacatacttggggcataaaaatgcttatatgtgaaagaatgccagaaaggcattatttctgaattatttcagaaatcgctcctacaccaaggccaggcacagtggctcacacctgtaatcccagaactttgggaggccaaggtgggtggatctcttgaggccaggagttcgagaccagcctgagccatcatggtgaaaccccgtctctactaaaaaaaacaaaaattagccgggcatggtggcgggtgcctgtgatcccagctacttgggaggctgaggcacgagaatcacttgaacctgggaggtggaggttgcagtgagccaagattgtgccactgcactccagcctgggcaacagagcgagaccctgtctaaaaaaaaaatagaaagaaagaacgaacgagagagagagggagggaaggaaggaagggagagagagaaagaaagaaaggaaggaaggaaggaaggaaggaaggaaggaagaaagaaagaaagaaagaaagaaagaaagaaagaaagaaagaaagaaagaaagaaagaaagaaaggactcctacaccaaaagctgattttagcttccagacccaaacatctgtttaagcccacccctctctaaatgaagatgtcatcgaggaaaggagctttatggtatcttccagttcagaagcaaaataacatgtgctctgggtgagtcatttagtttcctacctgagatgagtccttctgccctaaatgacagtgcacttgcgacctagccttgctgagtaaagcctaaagttccgggcacagagttgtcctaacaactgacagtgcccagttactgggtctgtgaatcttgttgaagcacacaattacaaaagtggaaattctctcctcactccaaaaagagctcactaatgacagagatctggaatagccgaacttaaaatcatgtgaggccagagggacatttgtttatttttgagatggagtctcgctctgtcgcccaggctggagtgcagtggtgcaatcttggctcactgcaacctccatctcccaggttcaagtgattctcctgcctcagcctcccgagtaggtgggattacaggcatgcaccaccatgcccggctaatttttgtacttttagtagagacggggtttcaccatgttggccaggctggtcttgatctcctgacctcgtgatctgcccacctcggcctcccagagtcctgtgattacagccgtgagccaccacgcccaaccctgatggacatttattacatgcaaactgacaactatctgcagagggtgggtgtgtttggaatcaggcctggggagaagtggttccaggatcccatatatggggaattcaaggtgtggagagattgaaggtgaccctgaacagggccaggcaggtttatggaagaagtcgggtgttcaggtttatggaaagggcttttgttgttgctgttgttgttgaggcagagttttgctcgttgcccaggctggagtgcaatggcatgatctcggctcactgcaatctctgcctcccgggttcaagcaattctcctgcctcagcctcctgagtagctgggattacaggcatgcgccaccacactgggctaattttgtatttttagtagagacggggtttcaccacattggtcaggctgatctcaaactctgacctcaggtgatccgcccgcctcagcctcccaaagtgctgggattggaggtgtgagccaccgcgctccaccctgatggacatttattacatgcaaactgacgactatctgcagggagtgggtgtgtttggaattaggcctggggagaagcggttccaggattccatatatggggaatttaaggtgtggagagattgaaggtgcccctgaacagggccaggtgggtttacggaagaagtggggtgttgaggtttacagaaagggcattttaaacaaagattgctgctgtcaaggcaagcaaaaggctggctaaatggaaaggggccgggagatgctgcctggaggaggagccaaggggtcaaggtgcaggactccctgcagggaccaaggtccttgatgaggagcagaagcacactctcacttttttttttttttttttttttgagatggagtcttgctctgtcacccaggctggagtgcagtggcgtgatcctggctcactgcaacctccacctcccggattcaagcaattctcttgcctcagcctcctgagaagctgggattacaggcgcccaccgccacgcccagctaattttgtatttttagtagagatggagtttcgccgtgttggtcaggctgatcttaaactcctgagctcaggtgatccacccaccttggccccccaaagtgctgggattataggcgtgagtctctgcacctggcttgcacacccttacttttaataatgcataagaaagaacctgaggaagccctcaaatgttgtttaaaagttaggtgtcataaggccagacacagtggttcatgcctgtaaccccagcactttgcgaggccaagaggggaggaccacttgaggccaggagcttgagaccagcctgggcaacatagcaagatctcatctctaccaaaaatttaaaaattagccaggcacagtggtgcatgcctatagccccagctacttgggaggctgaggtaggaggattgcctgagcccaggagttcgaggttacagtgagctatgatcacaccactgcactccagtctgggtgacagagtaagaccctatcttaaccaccacaacaaatagctgtagttattcccgaaggacacatcatcaactcagcattctcgtagaaaggacaacccaataccaccgtggcctacagggtatttgtgcaaattagaaaaagacacacctctctctcaagacgcttacatctcgggaaattgtctactcaagtggattttattaaaataagtattcccatctgccctaaaactcccagaaggaatgtacagttctatggtgtcttagctctgagcggcgctccctccaaggcactgccaaccacgacttgcactactgctcggtcccctgcagtggctgtgtgcaggcttggtcccctgcagtggctgggtgcagcctctatcccctgtgatggctgggtgcaggctcagtcccctgcagtggctgggtgcaggctcagtcccctgcagtgactggcagagcccatccgttgttttccataaccccccctcaccgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtgagttcctggggctatggggtggcagggagccagggatccttgtggggaaagtgactgcctgggccacagaggctgctgtcctctcccacactgcccccttctcctggcctttgggttccccattagagttgggtgagtctccctcccatcagcctgtccccctgccctaggttcacctccgcctctctccatcctccttccctttgtctttctttccttctccattctctcacaggctgttcttttgcccctgcaggtcctgaaggactctctgagatacagaaatgaattgagtgacatgagcaggatgtgggtgagtttggagatgtactcaggagccacctgcttctcctttccttcctcagaggccacagagcaaggactggagggtgaaataaattcatctccttcagcttgttgaggatttctcccatgggtgccagagacggactaaggatgcccccaaagagtaccatgatatccatagtcttgcctggggtctctggacgcttcaggaaagttccagggcctgggagcttctcctgccaatgaaaactcataaactcatgtcacaaagctgcccaaggttgggatccctcagcagtagctacatggccatgtttcctgcttttttttttttttttttggtagagacggggtcttgctatgctgcccaggctggtcttgaactcctggcctcaagtgatcctcccacctcagcctcccaaagtgctgggatcacacacatgagccactgtgcccagcccacagttcctacttctcttctccttccactggtcccgttggagtcatagtgcattgagaattagaattagcatacccaattcttaatgccagagctttttctttcctgtttagagattatcagtgctttaggatgaggggggaggtaggtggcaatatcacagtcaatggaaaagagcatttctgtacacacaccacaatcaccccagattctgatgtccgtgggtgtgtatatggagaggggtaatctgcattttgaagaatctctcttggccaggcgcagtggctcacgcctgtaatcctagcactttaggaggccgaggcaagcagatcacctgaggccaggagtttgagactaacctggccaacatggtgaaacccgggctctattaaaaatacaaaaattagctgggtgtggtggcgtgtgcctgtaatcccagctactcgggaggctgaggcaggagaatcgcttgaacctaggaggcgaaggttgtggtgagccaagattgggccactgcactccagcctgggtgacagagtgagactctgtctcaaaaaaaaaaaaaaaatctccctggttgattctgatatgttcttttgcctctaccagttgagaactactactttagcctttttgcacagtcttacctgtatctgtctgcacctataaaatgttggcaactatgtagtcctatctacctatcataggtgaggaaacacaggcccagaaagggaagcagcttgtcctaaagtcacaaaattaggtaccagaacaaagttgagagttgtccccagatttcccaactgtgtgctagaaaacgttccctgtaacatgtaaagtttaggtctttttcctttttgttagaatttgcctggtatatatttctccatctttttactttaagcattcctatatttttatgttttagaaataacacttataaataacatttggttggattttgtgtggtttgtggttgttgtttttttatccaggatggtagtctttgtcttttaactgggcatttagtctatttacatttattatgctacgtggtatgtttagatttatgtctcccattttattctatgttttctatttgtcccatctgttctacttctatttctctcattccttgccttcttttggattggctgggtgtttttttctcattctgttttttcctcattactatttgggaggttaaaaaataaatctactttttttgtttttggcatgttctctaataattacaaaatgcttgcttgttttatctaggtctacctttcgtatctttgtttcctgtataacacaaagactttagaatattttagttccattcagtccctcaatttatctgttagcataaccatgtattttggttttggttatgtttatctttaaattctgtaagttattgttttattttccttgttttattctgtgctctccatagacctttcatctgagatcactttctttctgcctgaattatttcctttctaacttccataattgagagcctactggtggctgacactgtgtttgcttgtttaagaatgtcgtttttggccaggcgcagtggctcatgcctgtaatcccagcactttgggaggccgaggcgggcggatcacgaggtcaggagattgagaccatcctggctaacacggtgaaacccccgtctctactaaaaaaatacagaaaattagccgggcgtggtggtgggtgcctgtagtcccagctactcaggaggctgaggcaggagaaaggcgtgaacccgggaggcggagttcacagtgagccgagatcgcaccactgcactccagcctaggtgacagagagagagtcgtctcaaaaaaaaacaaaaaaaaccccaaaaaaaaatgtctttttttttttttttttttttttttggagacagagtcttgctctgttgcctgggccagagtacactggcataatctcagctcactgcacccttcgccacccaggttgaagcgattctcctgcctcagcctcccgagtagctagaattacagtgcctaccaccacacccagctaatttttatattttagtggagacacggttttgccatgttggccaggctggtctcgaactcctgacctcaagtgatcttccctcctcggcctcccaaagtgttgggattacaggcatcagccatcgcgcccagccccttctcagattttggctagacctgtgtcagactttctcatcctacccctcatgtctctaaaccactctttcagttttttctacctatttgtctttgctgtattctggataatttttatcaactctagccttcagtttgcctcctctccagttgggtctaatgtgttattaagcttctccataaggttttcaatttcatttagtacagttttcttttcttttcttcttcttcttcttcttttttttttttttaagacagagttttgctcttgttgcccaggctggagggcaatggcacgatctctgctcactgcaacctccacctcccaggttcaagtgattctcctgtctcagcctcccaagtagctgggattacaggcatgtgccaccacgcccagctaattttgtatgtttaatagagatggggtttcaccatgttggctaggctggtttcgaactcctaacctcaggtgatccaatgcctcagcctctcaaattgctaggattacaggcatgagccaccacacctggcccaattagtacagttttcatttcttgaagttctatttatttattttttttcaaatctgcttgttttttgcgggggaaggtggttgttgttgctgtttgagacagggtctcactctgtcacccaggctggagtgcagtggcgcgatcatggcttattgcagcctcaacctcctgagctcaggtgattcttccacctcagccttccaagtagctgggaaaacaggtgtgcaccaccaaacccagctaatttttgtagacgcaggttttcgccatgttgccaagggtggtctcgaactcctgggcttaagcgatctgccacctcagcctcccaaagcactgggattacaggcaggaggagccactgtgtctggccctgcttctcctcctttacaatttattatgccctgcatatattttgaaacagtctcttatttctttagatatatgaaccaaagtcatctcatatatgttttgtaattctattatctaaagtctttagagatttgtttctgtcctccgtcccttttggtgcattttgcccatgctgtgtagttttctttatgttcggttactttctaccctaagctgctcatcttccttggaattttatctgtggagaattctttgaagtctgtaatgaaggcaggttcctccagagagaattggcatttgcttcgattgagatcactcgaaattaaattctcagcttaaggttttgtgagtttagggcagattttccttccccaatcacagcggtgatttgaggcggtagaattcttcatagtccttagggaggacttcctcagtgcaggagtacaagcgtttgttactttattatttatctttacttcccctataccaaggaggcagtcttttgtgtgtgtgttggtggtggtggtggtgttttgagacagtttcttgctctgtcaccaaggctggaggaatggtgacatgatcacagctcactgcagcctcaacttcctgggctcaagtgatcctcccacttcagcctcctgaatagctgagaccacaggtgcacaccaccatgcccagctaattttttaattttttgtagagatggggtttcgccatgttggccaggctggtctcaaattcctgagctcaagcaatcctccctcctcggcctcccaaagtgctgggattacaggcatgagccactgcacctggccagactcaacattcttaagtaggaagctttgtccagaatttatcaaaggcagtccttatgtttgtacaaaagattgtgctataaggaatgttcattgaaatggtttatgatagcaaaaatttcaactggtttgaattggcttcagctcatttgaatttattgagtcagttcaataaattacaataatactggtcagtcactaaaaataatgaaagaaagtttaagaagttgaataaaattgcagcatattaagcaagaaaaatagattgattctattttacatttaagaataaaggtagatggctgggtgcggtggctcacgcctgtaatcccagcactttgggaggcagaggcgggcagatcacctgagatcagaagttcgagactagtctggccaatatggtgaaaccccatctctactaaaagctacaaaaattagctgggcgtggtggctcacacctgtagtgtaatcctagccttttgggaggccaaagcaggtggatcactcaaggccaggagtttgagaccagcctgggtaacatggtgaaaccatatctctagtaaaaatacaaaaattgaccaggcgtggtggtgcgtgcctgtaatcccagctactcgggaggctgaggcaggagaatcacttgaacccaggaggtggaggctgcagtgagccgagatcatgccactgcactccagcctgggcaacagagctagaccccatctctaaataaataaaataaaggggagaaaacaaagaagatagattctttaccagagaattcctggctgcagatctcttgactgttatgttcttgttgttgactctgtttcccctcctcttcctaaaagggccacctgagcgaggggtatggccagctgtgcagcatctacctgaaactgctaagaaccaagatggagtaccacaccaaagtgagtctctgcggacagttctgccgccaccgccgcctcccctgctccatcccttcagcccctccctgggctcatttgtcagctctttcaggtaatagacagcccaggcttctgaggaagtgtgcacatcatgtacccaagctgtgagagaggaaagccaccgccaggcccacggggtgtgacgaaggctgggattttggcccgtgtcttctgcaccctttgttccccattttgcagctagaaagaaacctggccaggcacggtggctcacacctataatcctagctctttcggaggcccaggcggatggatcacccgaggtcaggggttcaagactggcctggacaacatggcaaaaccccgtctctactaaaattacaaaaattacccatggtggtgatgcatgcctgtagtcccagctactcgggaggctgaggcaggagaatcgcttgaacctgagaccaggaggcagaggttgcagtgagccaaaaccatgccactgcactccagcctgggagacaaaatgagactctgtctcaaaaaaaaaaacaaaaaaaagaaagagtaaccctaggcactatattgccttatgaaaatgttacagaagcattgattttactgttaataaaaacaattcctggctgggcacagtggctcatgcctgtaatctgagcattatgggaggtcgaggctggaggatcgcttaagaccaggagtttgagaccagcctgggccatagcaagatcctgtctctacaaaaaaatttaaaaattagccgggcgtggtagtgtgcaactgtagtcccagctactcgggaggctgaggtgggaggataccttgagcctgggaagtcaaggatgcagtgagctatgatcgcatcactgccctcccgcctgggcaacagagtgaggccctgtttcacagaaaaaagagagaagaaggtgacacaatggatagtgtgaggtgggggaggcgagcagctgcggggtgtacaggggtctggcaactgtgggagacaacggggatcaggcagaggggtgggcacataggaggcaacgtaaaccagaactgaggctgggccaggccagggtgtcagaggctgaggcggggagtcgggctgcccttgggctggattgcaaggcgaagaagcaggagggagaggctgagagtgtggaggggagggggcttgtagcgtgtgattggagggaggaccgggctctggtaaaggtgtcatgaggaggcggggaaaggtgagaactggatttaagatgttttggggttgggcgcagtggctcacgcctgtcatcccagcatttcaggaggccaaggcgggcggatcgtctgaggtctggagttcaagaccagcctggccaacatggcaaaactccgtctctactaaaaatacaaaaagaaattagctcacgtctgtagtcccagctactcgggaggctgaggcaggagaatcgcttgaacctgggaggcggaggttgcagcgagccgagatgctgcctctgcactccagactgggcgacagagcaagactcaatctcaaaaaaaaaaaaaaagacgttttgggagtagagattgaaagtgttaaattgagctggatgtggtggctcacacctctaatctccacacaatggaaggccaaggcaggaggatcacttgaggccaggagttggagaccagcctgaccaacatagtgaaacccccatctctactaaaaacacaaaaattagctgggcgtggtgacacgcacctgtaatcccagctactcaggaggctgaggcttgagaatggcttgaacccaggaggcggaggttgcagtgagccgagatggcgccactgcactccagcctgggtgacagagcaagactctgtctcaaaaaaaaaaaaaaaagtgttaaatggaaagtgggaggaggaagggcctagggtaggattttaggtggaaaaggaaagaaaggagggtgtagagaaagcaagactgggaagaaggttaaggaggaagaggactgggatgggagctggggcagtggggctgcggggctgatagaggccaaaggggtccctttgccttgtatataggaagacagcagagttcagtggcatcagaagcagctggtgccaatagccagtcccctagcttttaatagcatggaagggcagaagggaatggtcacgtgggcttggagaactggggtcgaagaggatgcagctggctttgcttccagaggctctcgagctcactgctgtcttgtttttcctggttttagaaagcagagaaaaaggggaagctggtattgtccaagtgtggaggagcaaaggacttttccagtttttagcaattagcgatacaagagtggggaaggaggctgggcagagtggctcacacctgcaatcccagcatttggggaggccaaggcttgaggtgagaccagcctgggcaacacagtgagaccctgtctcttaaaaaaaattttttttggccaggcgcggtggctcacgcttgtaatcccagcactctgggaggccgaggcgggtggatcacctgaggtcaggagttcaagaccagcctgggcaacatggtgaaaccccatctccactaaaaatacaaaaaaattagccgggcatggtggtgcgtgcctgttaatcccagctactcaggaggctgaggcaggagaatcgcttgaacccaaggggctgaggttgcagtgagctgagatcatgccattgcactccagcctgggcaacagagtgagactccgtctcgaaaacaacaacaaaaatatcccgcacacattaaagaaaaattcattctctggctgggcgtggtggctcacacctgtaatcccagcacttcgggaggccaaggcgggcggatcacctgaggtcaggagttcaagaccagcctggccaatgtggcgaaaccccatctctactaaacacacacacacacacacacacacacacacacacacacacacacacacacaaattagcccgcatggtggtgtatgcctgtagtaccagctactgaggaggctgaggtggaggatcacttgagcccaggaattcgaggctgcagtgagtgatgatcatgccactgcactccagcgtgggcaacagtgaggccatgtctctaaaaaataaaaaaagagagagaaacaagagagagctggtttccccctcctctgccatgtaagcaacgtaatcaggatgaagcgcctcaccaggcaccgaatctgtcaacaccttgactttgaactccctggcctcgagaactgaaagacactctctatgggttaagccacccagtgcatggtatcttgttataactgcccgagctgactgagacggacgttcaggacagagagcgtgaatgcatagtgacaccagctgtgagtctttctccagggacagtcggcagccggccctaggtgcagagccgatgacaaggacccaggctctcagcaggtcttccaagcagtgtggtagaaaggcaggcagggtgtggggaagtggagccaggccaccagtcatgatgtcaagactgagccaggaagcaaaggcaggcagagagatggggaggagagggagcaggaggggactggccatctctgagacagaagcgtgagtagtgggtggacttgagggcaggagaggactgaaagggcagaggcctgggcgatgcagccagagagggagatgctggtgtggggaggtctgggcagggatgttttaggtgatggcagagtctggagtggggatggagtagaggtgaaggtgctgaaattgaggtcagaggttgtaatctcagcgtgtatgacttggggcaaaggaaaactgtgtcccaggtgccaggtcaagcctcagaggccttggcaccatggagcccaggagcaaagtctgcaatggggatttttttttcttttttttgcggtgggggagacggagtctcactcttgcccaggctggagtgcagtggtgcgatctcagctcactgcaacctccgcctcccagcgtcaagcaattctgcctcaacctcccaaggagctgggactacaggcgtgcaccaccacacccggctaatttttgtatttttagttgagacagggttttgccatgttggccagcctcgtctctaattcctgaccccaagtgatccatctgccttggcccccaaagtgctgggattacaggtgtgagccaccgcacctggcctagagcctaaagtatccacttgtacatgtagatgccccacgatggaatggccacccatctctgtggccttttccctttgccacagggacaaaccacacagatgacaggatcatgctggctgtagatactcagcaatgattgatgataccagcgatttttctttttttcttttttgtttgttttgaggtagggtctcactctgtaaccaagctggagtgcagtggccttgaactgtaaacttgaactcccgggctcaagcaatcctcccacctcggcctcccaagtagctgggaccacaggcgtgtgccaccacgcccggctgagagagggctcttcatgtcttctgccctgactcccttcctctgcctcccttccagaatcccaggttcccaggcaacctgcagatgagtgaccgccagctggacgaggctggagaaagtgacgtgaacaacttgtaagtggctcctgccctgagcccagggagggagaaagcttttgtgaatgctgacacttctcataagggtcatggagggcctgatggggggaggccgtggctgggatggggaccaaagcccctgggtgacttggccttggggctacttatttattggtggtgcctcatccagaacccctgcctggctatttcacaccccaaagctttcctgtctgtctcgctttctgccctctgactccaacactggtacctatcctctccctctgtcactgtcactgtttttgtttttgttttttgagaggcagtcttgccctgttacccaggctggagtgcagtgacttgatctcggcttactgcagcctccacctcccaggttcaagtgattctcctgcctcagcctcccgagtagctgggattacaggcatgcgccatcacacccagctaatttttatatttttagtagagatggggtttcgccgcgttggccaggctggtcttgaactcctgacctcaggtgatccgcccacctcggcctcccaaagtgctgggattacaggcgtgagccaccgcccccgacctgtcgctgtcactgttgacttcaccaggctgcatggccataatacccacgaggctaagacttggagctggagttgtgtgtgtgtttgcgcatgcacatgagcattggagactggagtagcgtagagcgtgggggaggggacaggtaacagaccggcctcaggctgtggagtgtaagctctctttcctcttgggtccagtttccagttaacagtggagatgtttgactacctggagtgtgaactcaacctcttccaaacaggtgagtctcttccctcccgtctaacccaggctctcatgggaactacctaattcctagtcctcctctccctgcaaagtgtgcagcacaaggggtaggaaaatggagacattcacaccccatctctggtctctccaaccctcgtgcagggagggactgaacctcttcagtatttttctttttaagagacaaggtctcggccgggtgcagtggctcgcacctgtaatcctagcactttgggaggctaaggtgggcccatcacttgaggccagaagttcaagaccagcctggccaacatggtgaaaccctgtctctactaaaaatataaaaattagccgggcatggtggcacatgcctgtaatcccagttacttgggaggctgaggcaggagaattgcttgaacccaggaggtcgaggttgcagtgagccaagatcatgccattgcactccagcctgagtgatacagcaagacttcatctcaaaagaaaaaagagagagagagagagaaggtctcactctgtcgcccaggctggattgcagtggcatgttacggctcactgcaacctcaaactactaggctcaaatgatcctcccacctcagcctcccaagtagctgggactacaggcacgcaccaccacatctggctgattttttatattttttgcagagataggggtctcactgtgttgcccaggctgttcttgaactaccagcctcaaggtgtcttcccaactcagcctcccaaagttctgggattacaggcgtgagctaccacacctggcctcctagatattttccaagcgggtggtttcacgtctgagcagaaagaccacacactgccccttcctactggcctctctcctgaagcgcaggcctccaaaagcccaaagacaggtcttacctctttgccagccactggactgtagccatggccctggccagtccttggtccagtcttgtctgctactcggaactgggctggctcatgggcacgatttctactgaggaggaagggctcatgtctgttgttgagttggcagccatgggaaacaagctggtcaggattggttgtcacccaggactggttgtcacccaagtccacatgagaagctcacacagtcctgttccactagcagggggagtggccacacttccaggctcctgcctgccaagaactgtggtgcctccagaccatcagcccctaatgcttccctgacaagcctcagctggtccccttctctccagcgcgtctcctccccacatctcccagcaggctcccctcctttccctgggggatgtaagcaccagcgttctgagactcagggcgttccatgacaagcatccaactctgaaagacaacgttccacattgcaggtctccatacgcaagcttggtggtctcatgcccaagcctcgtggccttctctgcatgtggacaggcaggacccactcttggggcttggactctctgaccccgaatttccttcagcttccttcagcttgttcatctgtgcagaaatgcctactactggcctcttttccagaatattctgttttgtgttgtacgatggctgggacagggcaacaaattctgtaatacattgaccagtcttcagcacaggatgtggtcagaaaaacaccagaaacaggccaggcacagtggctcatgcctgtaatcctagcactttggaaggccaaggggggcggatcacctgaagtcaggagttcaagaccagcctgggcaacatggtgaaaccctgtctctactaaaaatacaaaaattagccaggtgtggtggtgagcacctgtaatcccaactactcaggaggctgaggcaggagaatggcttgaactcaggaggcggagtttgcagtgagccgagatgcagtgagcaagattctgtctcagaaaaaagaaagaccaacaccagaaacagctggaaactgcggtttgtgcgagaaagggacattcagccgactaggaagctatttgagcagggtgttatacaaaagtcagtagagaaataaaaataaaacgcagaatctagtctatgccctaagctattcccagtcagactgaaagcagtggtgtagatgcatttattttttaaaaaatgcattggggccgggcgcagtggctcatgcctgtaatttcagcacgttgggaggcgaaggcaggtggatcatgaggtcaggagttcaagaccagcctggccaacatggtgaaacgccatctctattgaaaatacaaaaattagccaggcgtgattgatggtgtgtgcctgtaatcccagctactcagatggctgaggcaggagaattgcttgaacccgggaggcagaggttgcagtgagccaacatcacaccactgcactccagcccgggtgacagagcaagactccttgaaaaaaaaaatgctttggaaatgtttgcataaaagtatataaacaagtatacattgttgtggctaacttttcatcatttggattttggtgggaacaacgtatgtggataattcagaattcattcgcatttagctttcacttttttgttgttgtttcttttgagatagtctggttgtgtcacccaagctggaatgcagtggtgcgattccggctcactgcaacctccgcttctggggctcaagccatcctcctacctcagcctcccaagtagctgggactacgggcacgcaccaccatgcccagctaatttttgtgtactttttttagagacaaggcttcattatgttgcccaggctggtctcaaactcctgagctcaagtgatgtgcctgccttttcctcccaaagtgctgggattattggcatgagccaccacgcccagcctgcatttagctttggaatgtgctagatctgaatgcaggcgtgagtgagattcttagaattgtcatccttgggaaagtgcagcctagaagttgcagttcggctgacacaagctctctccccatggctctcacctcttcttggagccggctgcctgcctgcctcccgctgctgtggtgtttagggataagcaagacaaatgtttcaacctttgggtcatccttccagttcctgacagaccgtggaccatgagtaagcggagatggtgatgaggtccaaaaggacttggttagctgagagaatgagtaaggggtagaggtggtgagctcagccatcttttttgtgccacatctcatgacccctagctctggttttttgtgtgtttgtttgttttgttttgagagagtctcgctctgttgcccagactggagtgcagtggcaccatctcagctcgctgcaacctccgcctcccaggctcaagcaattctcctgtctcagcctcctgagtagctgggattacaggtgtgtgccaccacgcccggctaatttttgtacttttagtagagacagggtttcaccatgttggccaggctagtctcgaactcctggcctcaagtgatctgcctgccttggcctcccaaggtgcttggattataggcatgagccaccgtgcccagcctgctctggttttatatgcattgttcattaatattgttaccacgagatgctgacctactcatctctaaattccctctgttctagtccagtgcctggtgaatagcaggccctcaaccataaaagaatgcttgctttttgaaaaacagcaggctaccaggtgcagtggctcatgcctataaacccagcactttaggaagccaaggtgggaagattgcttgaatccaggagttatagtcgggtagctctggtccagaagactctaagtaattcaccctagagtttcccagagcatgtagctgaaagttaacactatgtaatgaattctattcacctatttcatcatcactgctgtttttcttttctctctctctcgttttttttttttttttttttggagatgggatctcactctgtcgccgaggctggagtactgtggcacaatcatagctcactgcagccttgacctccctggtctcaagggatcctcccacctcagcctcctgagtagctgggaccagggatgtgtgccatcacacccagctaattttttaattttttgtagagatggggtcttgctatatgaccaggctggtctcgaactcctgagctcaagtgatccttccacctcagcctcccaaagtgttgggattataggcatgagccaccaaccccagcctcctgtgctttaagaagcacccgcagtgtgcactgtccaatagggcactcactagccccatgtgatcattgaacttgattacaattaaataacatttaaaagtcaggtcctcagctgcactagtcctatttcaggcatatttcagaaagccacatatggctaatatattaaaaagtttatatgaacattttcatcattgtagaattctattggatagcactattgtgggtgattctgatgtgtgctaaaacttgacaaccactgagcttggacatacagttttcaaccctggatgcagattagaatctacctggggcgttttttttgtttttgttttctctgaaacggagccttgctctgtcgttcaggctggagtgcagtggtgggatcttggctcactgcagcctccaagcaattcttgtgcctcagcctcctgagtagctgggactacaggtgcccgctaccacacctggccaatttttgtatttttagtagagatggggtttccccatgttggccaggctggcctcgaactcttgacctcaagcagtcctcccacctcagcctcccaaagtgctgggattacaggcatgagccacagcacctggcctaacgggggacagcaggggaagacttttgacacccactgacatcccaacatacagcagaccaattgaaacagatggtggggcggttctgggggttgcaggaagactttagtgtttcagtttccccaggtgatcctaaccagtctcaaagccaaagtcaagaaccactgcacaattccatgcacttttcccagcattctcattgaagtcctctgagacccttacgaggtatgcactgttatagccacatgtgctcaacagaagagcatcaggaggcacagagtgactgagcaacttgtccgtgatgacactgctctagatgtttctggatgccaaagggcattcctggaaggtatcaggaatcggggccaggcagggaaatggaacagcccgtggttcctgccagttggagcctgaggaagccggtagacttggggatggctgccttgcagtgacagctgcttttaatttgtgtcaagaagaaaagctgccttttaattagaacagttcgggatttttttttttttcagctgccagactaacccagttaccagggattagtgcagtcgggaagcggaatacaggcagtgctaggcttccctctgggccagttccactcacagagggaccgcggggagagtcatttcattgcccgccgcgtgcagagtctgcagaggcagtgggtggccagtgcaagaaagaaaatcagcctggccagtggtgtgagctgagtgtctgcagccagacggccagttgcttggtctaggatggggggcaggaggttagtgtggagggagccccagcgtgagaaattgagggagcaactttgtctctgaaactcaagagggtggaggcaagacttctatttttgttgacaggtgccccaagtttcagccctgaaccctgacatatcttccttctcccaagtcctttttcttatttttcttgttttgtattgttttgttttggtttggtttcttttgagatggagtctcactctgtcacccaggctggagtgcagtggcaccgtctcagctcactgcaacctccaccttccaggctcaagcgattctcctgcctcagcctcccaagtagctgggtttacaggcacacgccaccacacccagctaatttttgtattttagtagagacagggttttgccatgttggccaggctggtctcgaactactgacctcaggcgatccacccgcctcggcctcccaaagtgctgggattacaggcatgagccactgtgcctggcttgttttgttttatttatttatgaaacagagtctcactctgtcgcccaggctggagtgcagtggtgggatcttggctcactgcagcctccacctcctgggttcaagcgattctcctgcctcagcttcccaagtagctgggattacaggcgtgagccatcacgcctggctaatttttgtattttcagtagagataaggttttgccatgttgctcaggctggtctcaaactcaggctcaggcagtccccccacctcggcctcacaaagtgctgggattacaggcgtgagccactgcacctggctgagacccagtctcgtaaagaggaaaaaaatgaagatgaggctcctcctccatgtccgccatggtaggagctctcccaggttatgagcaaatctcttcttccctgagctatcaggggtctctgcacagagtagcgcttagttcacccagtcatgatgcactgaatattctgactctcaggagcaaaggctcctggtctaaccatcattggccccatcagctcttgggctctccaacaagtctgttaactcaccacctctcaacaaaaccacttttttttttttttttttgagatggtgtcttactcttgtcacccaggctggagtgcagtggtgcaatctcggctcactgcaacctctgcctcctgggttcaagtgattctcctgcctcagcctcccgagtagctgggattacaggcatgtgccaccatgcccagctaatttttgtatttttagtagagacagggttttcccatgttggagaggctggtctcgaactcctgacctcaggcgatccacccgcctcagcctcctaaagtgctgggattacaggcgtgagccaccacaccctgccaaaaccactttttttttttcgagactgagttttgctctgttgctggagtgcaatagcatgatcttggctcactgcaacctctgcctctcgggttcaagcgattctcctgcctcagcctcctgagtagctgggattacaggcatgcgccaccatgctcggctaacaaaaccacttcctgactttgtgagagccttcaagttactaaccttctgtttcttcacctgtttaatggggatacgtttacctatctcatgggagtgttgtgaaggttaaatgaattagatgaggtaaagcacgcacagaatcggtccttggtgtatgttggacccctgcctctgcccctctgaagaggctgcctgtaatcccctggctctaccacctttctccctcacttttatttcctagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgtgagtaccgcgggccagatcttcttacatgagattcaggccagagggaggatcccagcctgaggatgtccccagagaaacgcagtccttctcagtgcctttggctgtctgcttctgttccaaaaggccccggagcttctgaccattgtgaggataaaagagcagggcccaggctttggtgaccccagtaaagcccctggcttgccactcttgcgtcccagtgttacaggatctttggggtgtccgttttctggctggaaacctctggggccagtggtgcctttgcccgagttcttgttcggcatccaggaagaatgaggtatgcagacaagtggagggtggacaagatgaagaggagctttattgagtattagaacagctcagaggagactgcagtgggtaccgctctctgtctgtaggcaggttgtcctgtcgagtgttcagctctcagcagaaaagaggccatggagtgggtagctcctctctgcagctgattatcctagcatctctgcaggtctctgaagcctcagcagagagggtagctcctctctgtagctggtcgtcccatctctgctcagctctggctgagctcaggccttttatgggcctcagaggggaggaaatgcaccacgattggtccatgggcaggcccagaaagggcaccccaagttcccactccggtctgtgggattggcagcccggcccccaccggggacccgccctttcacccaggaatctgtctgcctcccgctgccatgcatggcaacagggctcagccccaactttgctctaagatcagagtgggtgccgacagcagggagaagccaggcagcgggaacaggttcagaagaggggagggagagccttctcaggccctgaagagtacagggatgcctgagtctgcagctggggctgggggcgggtgcggggcagcagggctgccacccactccatggagtgggaggcccaagtctgcagctgtgttttgggtggctgcagctgcacctgggaaggtagggttcctgcctgctccggaccctcaagagcacagggaggctcagatctgcagtcacaacttgggcggctacagccccatccagcagggtgaggcttctgcctgttccatggagtgtgcagccctggccatgcctccctgctgcagctggcatgatggcagtggcaggccatctggactggcagctgccatcaccaggatggtcctctctgtctgcctctagcttgagcacgtcaccattcaacaagtatgtcgtgcatcctacgaacagcacaaatatcagcagacctggcctagacctacatgagctaacataatgatttccagaccatttatctacacaatccctttgtgcaaatggaattttatggagaaatataaattataaaacacagctgctcattaaatggagacctatcccttacctagcttcagttccctggggtgcccttagcagaatatatatagtttggaagttctggtcttacagaagttcttacacttttttttttttttttttctgagacagagtctcactctctcacccaggctagagtgcaatggcatgatctcggctcactgcaacctctgcctaccaggttcaagcaattcttgtgccttagcctcccaagtagctgggaccacaggtctgtgctggcacacccagctaattttttgttgttgttgtttgaatttttagtagagatggggtttccccatgttggccaggctggtctcgaactcctggcctcaagtgatccgcccacctcagcctcctaaagtgctaggattacaggtatgacccaccacacccgccagttcttatacttttgtgtccttctggtttaaaatgatgtgtctggggtgggcacagtggttcacgcatggaatcccatcactttgggaggctgatgcaggcagatcgcttgagctcaggggttggagaccagcctgagcaacatagtgaaatccctgtctgtacaaaaaatacaaaaattagccaggcatggtgacatgcgcctgtagtcccagctacctgggaggctaaggcgagaggatcgcttgagcccagaaggtcaaggctacagtgagctgtgtttgtgccactgcactccagcctgggcaacagaacgagaccgtgcctaaaaaaaataaaataaataaaataaagtagtataagacagtatactctgtaactgcggttattgacaagtaatgaatctctttatttagacagtacaagggaagggtgtagcatcgcctagatgctaacctaggatggttttgtggaagggagattggaattagctgcccagggattagaagggctttgcggcaagtaggcctgcctgaagggagctgagagggtggagtgggcccccaagagaagggaccagctgcttagagtgctgaatacagatgaacttttcattgtttcccctggaaacttttcattgtttccaagtattctgttgctcagtagaacatcaccactgcctttttgtaaaatggggagttaagctgggcatggtggtgcacacctgcagtcccagttactctggaggctgagggagttatgagaagagacaggtaattaagtgtttgggtttaaaggccttctttgaaggcagggcaatacccaagacccacactgcctctgggctgaggaaggggtaggagggatactctttacaatacatagttttttaatttactttatttatttatttatttttctgaaacagggtctcgctctgttgcccaggctggagtgcagtggcacaatctcatcccactgcaacctccatctcccaggttcaagcaattctcctacctcagcctcccaagtagctgagattataggtgcccgccaccatgcctggctaatttttgtattgtttttagtagagacagggtttcatcctgttggccaggcttgtctcgaactcctgagctcaagtgatcctcctgcctcggcctcccaaagtgctgggattgcaattgtgagccactgcagctggccctcttttctaaaaataaacatttatttttgttttagatctacagaaaagttataaaaatagtaccgagagttctcgtatacccagttccattttccctttgttcgtatattagtatgaaacatttgccacaactggccgggcacggtggctcacgcctgtaatcccagcactttgggaggccgaggtgggcggatcatgaggtcaggagatcgagaccatcctggccaacatggtgaaaccctgtctctactaaaaatacaaaaaattagccgggcgtggtggcgggcgcctgtagtcccagctgctcaggaggctgaggcagcagaatggtgtgagccctggaggtggagcttgcagtgagccgagatcgtgccactgcactccagcctgggtgacagagcgagacatcgtctcgaaaaaaaaaaaaaagaaacgtgtcacaactaattaaccagtgttgataccttattattaattaaagttcgtacttaaggcagggcacggtgactcacacctgtaatcccagcactttgggaggtcaaggcaggcggatcacgaggtcaagagattgaaaccatcctggccaacacggcgaaaccctgtatctgctaaaaatacaaaaattagcggggtgtggtggcgcgcgcctgtagtcccagctgcttgggagctgaggcaggagaattgcttgaacccgggaggcggaggttgtggtgagctgagattgtgccactgccctccagcctggcaacagagtgagattctgtctcaaaaaaaaaaaaaagttcgtactttattcagattgtcacagtttttaccgaatgtccttttctgccccagaatctcacccggtacatgcatgtgacatttagttgtgatgtctccttaggttcctcttggctatgacgtttcacttctcaaacttcccttatttttgatgactttgacagttctgagttttttgtagaatgttcctgaattctgtttgcctgatgtttttctcctgatttaactggggttaagggttcttgggagaaagatcatttaggtcaagtgccatattcattcactgtccacttctgccatttttgttttgttttgttttgttttgtttcaagacagggtctcgctctgtcacccaggctggagtgcagtggtgcgattgtagctcactgcagcctcaaactcctgggcttaaaagatcctcccacctcaacctcttgagtagctaagactacagtgcacatcaccacacctggctaatttttatttcttaatttttgtagagatgggggtctcactatgttgcccaggctggtctcaaactcctgggtacaagcgatgctccccactcagcctcccaaagtgctgggattacacatgggagccactgcgcccagccatcttttgccatttcaataatcatgttttatacatgtgttccctgattttatccagtgaatgtatgacccatttccaaataacaaatttaaatttaaacaaataaagcaaacactaaaaggattgctgagctgtgatctacagctgcaatatgcaggttcgcacatctgagaggttacagaacctcagagaactggctctgtaggggaggaggctgtcctaagaggttactggtgtgtgcagtgtcatagagttagctaccaaccaagccgggactggaactcagatcccaagcctcaatcccttgttcttttttttgacagagtctcactgtcgcccaggctggagtgcagtggtgcaatctcagctcactgcaacttccgcctgctgggttcaagcaattctcctgcctcagcctcccaagtagctgggattacaggcgcatgccaccgcgcccggctaatttctgtatttttagtagagacatggtttcaccatattggtcaggctggtctcgaactcctgacctcaagtgattctcctgcctcagcctcccaaagtgctgggattacatgcgtgagccactgcacctggccttcaatcccttgttctttgccttctgacagccatcctcttgggcaggttctgcggatctcttccagactaatatcagccctgagcctcaacctaaaacaaatgcaggcaatagctgagaaagaactgctccctcctgggcctgccatggtccagcctgctactgggtcaggtcaccatttcttctctagtccaggacacaatttccaccctattgtgcccggcatggcttgtccttcaggaactaattgaagtggaaggatttggaggataagcgtctccacactcctgctggttcctgctgggctcccttggttaccagacctcgggacagctctaggccagtcgtggcccctggcagtgctggccacatgccccagggtagctggcccctccccctcgagagccccgctgtggcttccctgccctctggtccccctcccctctcacactctttccaatttcttccaggcctcccagctgacaccctgcaaggccaccgggaccgcttcatggagcagtttacaaagtaagtggttcaagtaacaggaatggaggtgaattcaagagcgctataaaatcattaagccatgcaagtgcactgtgagaggtggctggacacagtggttcatgcctgtaaccccaactctttgggaggctgaggcgggaggatcacttgaggccaagagtttgacaccaggctgggcaacatagcgagaccccatctctacagaaaaaaaatgtaaaacaaattagctgggcacggtggtatgcacctgtgatcccagccacttgagaggctgaggcaggaggatggcctgagcctaggagtccgaggctgcagtgagctagattgtgccactggacttcagtctatgtgacaaagtgagaccctgtctctaaaaaaaaattttttttaaatacttgtgggcgtgaggttatcttcgggctggagtgcaatggcaatggcacgatctcggctcactgcaacctccgcctcctgggttcaagtgattctcctgcatcagcctctcgagtagctgagactacaggcacacaccaccatgcccagctaatttttgtatttttagtagagatagggtttcaccatgttggccaggatggtctcgatctcttgaccttgtgatctgcccacctcagcctcccaaagtgttgggattacaggcgtgagccactgcacccgacctgaggttatcttcattctaaggtgataaagtgacagaaaatagctcagacagaggcaaatctacctatagctagggtaactattggttatctaataaatcccatagaagcatatagaagaaagagatttcatccattcattagttgcctgcttatgccccagacttcatcctcttctcttttctgtctccctaagttctggtcttatagcatttatagactgataacccctaaatatgcatctctagccagaccttacttctgaatgccagcctcttgtccccaatttgacatttgtatagcatacttaaatctcaaactgtactttaggttttctcaaaaaaaaaaaacaaaaaaaaacctttctctctccattctgtttttgtttgtttgtttttgtttttgtttttgagacagagtctcgctctgtcacccaggcttgagtgcggtggtgtgatcttggcttactgcaacctcagcctccccatctccagtgattctcctgcctcagcctcttcagtagctaggattacaggcgcccaccaccatgcccgactaatttttgtatttttagtagagacaggatttcaccatgttggccgggctggtctggaactcctgacctcaagtgatctgcctcccaaagtgatgggattacaggcgcgagtcactgtgcccagcccctccccattcttttctatctcaacaaatactgccatcatccatttaggccagagatctggaagtcaccattttcctcatcccccatgtccaatccactagcaggtttggttgataccctacaaatatgacctgcttctgaggtgggatgggagactggactctggaggcagggcttgggcatcggaccaaattaaggacaagtaaaacagggaaagggcggaagcacctctgcataagacacacctaccagtgtgcagtgacagtttaccattgctatggcaacatccggaagttagcgcccctttccatggcaataacctgacaatctggaatttaccactttttttctagaaatttctgcataatctgccccttaatttacatataattaaaagtgggtataaatgtaacagctgctattctgggctcactgcgtatggagtagccctgcgctgcaaggaacaggacctccgctgctggctgtgcactgccgcctcaataaaagttgctaacaccagccgggtgcagtggctcatgcctgtaatcccagcactttgggaggccgaggtgggcagatcacttgaggtcaggagttcaagaccagcctggccaacatggtgaaaccccgtctctactaaaaaattagcagggcatggtggtgcacacctgtaatcccagctactcgggaggctgaggcagaagaatcgcttgaacccaggaggtggaggttgcagtgagccaagatcacatcactgcactcaggcctgggcgtcagaatgagattccatctcaaaacaaaaacaaaaacaaaagatctttacttaggctgggtgcagtggctcacacctgtaatcccagcactttgggaggccgaagcaagtggatcgcttgaggtcaggagtttgagagcagcctggctaacatgatgaaaccctgtctctactgtaaatacaaaaattagccctgtaatcccagctactcaggaggctgaggcaggagaattgcttgaactcaggtggcagaggttgcaatgagctgagatcatgccactgcactacagcttgggcaacagagcaagactccatccaaaaaaaaaaaaaggaaaggaggggaggggaggcgaaaccaggcaaaagggaaggataatagagtgagagttgggaggacagagggggctgagaagggcctcctgacttagctgtgtaaaagtgcactctcttgtttttcctgttaatttcctcacccttgaccataactcccaaatgccaagtttcagcttctctgcctggttccccaggagcaagcgaaggacaagtgtgtggttgtacccacctcctggtacccctgttccatttgagaagccgagtacatattctgtgataaatggcttctttagtccaaggagacaggccctgaggctgatttcctggaatgtcaaattccggtagcttgtgaaagcagttgagcctgttactgttggctccaaaccagcaagatggggatgtgtggtcaggtgatttcatttcctttcatttgcttctagcttagaaaaacatctcccctgagtagccactttgctgttccacacagacacggctgctgtctgagacctcactgtccttgaattcaggggaagcagcagtgatgtcacagagacagagacaggcctaagtcttgggatctgacaggctgtaacgagaccctgggggtttcgtttattggactaagctggagaaagttcattgttgcaggccaaaggatttaaggcccatgtacccctttcatctcagaatagatgtagttaactccagctactcaggaggctgaggtgggaggatcgcttgagcccaggaggttgagattgcagcaagccttgatcgttccactgcacttcagcctgggtgacacagcaagaccttgtctctaaaaaaattaaaacaggccaagcatggtggctctcacctataatcccagcactttggaaggccaaggtgggtagatggcttgagcccaggagtttgagaccagcctggacaacatagagagaccccatctttatcaaaaacacaaaaaaaattagccaggtgtggtggcacacacctgtactcccagctacttggaggctgaggtgagaggatcccttgggcccagggaggtcaaggctgcagtgagctatgattttgccactatactccagcctgggcgacagactaagacccaatctcaaaaaaatatttacaaataggcagggcacattggctcacgcctataaccccaacattttgggaggccgagacgggcggatcacctgaggtcgggagttcgaaaccagcctgaccaacatggagaaaccccatctctactaaagatacaaaattacccaggcatgatggcacatgcttgtaatcccagcaactcagcaggctgaggcaggagaatcccttgaacctggaaggtggagcttgcagtgagccgagatcgcgccattgcactccagcctgggcaataagagcgacactccatctcaaaaaataaacaaacaaaataaaaatgaagaatatataagtctggattctctcaggtttcttggtcttcagtgtttagattcaaaatagagatttgagaatgagaaaaagatgttgattttgccagatgtggtggctcatgcctgtaatcccagcactttgggaggccaaggcagtaggattgcttgaagccaggagtttgagaccagcctgggcaacacagcaagagcctgtttctaccaaaaaattaaaaattagccaggcatggtggtgcatccctgtaattctagctactcaggaggctgaggcagaagactgcttgagcccaggaattcaaggctgcaatgagctctgattgcaccactgcactctagcctgggtgacagagcaagaccctgcctctacaaaaagagagagagagagaaaaaaaatattggtttcttcatgtgcatatccacccaagattaggacatagtaccaaacgattgtaattctccaagtgtttattgaacggctgccctgtccctggcattatgggaaacagctcagcggagctcagtccccacttcccaggaacttatagtcttaattgtggagagaacaaatagtccaaaaacaaagagaagtaatgaaagaagagagctacctttgtagtaaaattcccttcccttttcctatggttagatggcttatcctcagagaaagtcaatttcttttaatgttactctaaaccaaacactcctcggaagttaaatctgcaaaataacaacatgtgttctacagcaatgaagaaattagctttttgattatctactcttccaaaggatttgtagcatgaattactctttcctcaccagcaggtcactgaggaccagctttaaataatcctctgcagcatcataattgaatcccagcaccatggagtttatctccttgacagcctgtgcctttgggctggggagggggcaggaaagccaggtggctgctctgtcccctacatggggctgatgaagacacccagcacccctcaggtccttctccacccctaggttgaaagatctgttctaccgctccagcaacctgcagtacttcaagcggctcattcagatcccccagctgcctgaggtaagcatgcccaaccacacaccctcggcactgcagaggccccaggtactctcttaagggccggcggggcctggcaagcaagcactatttgaggatgtgtctccgtcttcagaacccacccaacttcctgcgagcctcagccctgtcagaacatatcagccctgtggtggtgatccctgcagaggcctcatcccccgacagcgagccagtcctagagaaggatgacctcatggacatggatgcctctcagcaggtgaggaccacttgggagagaaacttggcctttcctctcacctgcaagtacaggggagaggctgggggagaccctggccaaagcccattgactctaaccaggttcaggcttctcttcattcacctagcaccaacctaggctgagcatcctgctctgtggctcccagaagggtcataaatgggtgcagtggctcacagctgtaatcccaacactttgcaaggccaaggtgggaagactgcttgaggccagttcaagaccagcctgggcaacatagtaaggccccatctttacaaaattagccagatgtggtggcacatacctgtggtcccagctatgtgggaagctgagatgggaggatcacttgagcctgggaggccaaggctacagtgagctgttatcatgccactgcactccagcctaggcaagagaacaagaaccaggccctaaaaatataaatacataaaattaaaataaaaaaattatccaggtatggtggcacacacctatacttccagctactcaggaggctgaaacaggaggatcacttgagccaggagttggaggctgcagtgagctatgattgcaccactgtactctagcctgggcagtagagcgagaacctgtctcaaaaaaattaaaaaaattaaacaggtctgaaccgtttaattcgagaaagggggcattctcccatatcactcaactgacccacacacagaattctctggctctctgacttattctcactcctttttggtcaaccacagaatttatttgacaacaagtttgatgacatctttggcagttcattcagcagtgatcccttcaatttcaacagtcaaaatggtgtgaacaaggatgagaagtgagtccaagctgggttcaagcagatggttcaggagctaagttaagccatggtctgcctcaaaacactaaccaaagaggaattcttaatgatactggggcttcttagatacagaacatcttgaagggttgggggcaatggcttatgcctgtaatcccaacatgtggggaggatgaggtaggaggattttttaaggccaggagtttaagaccaagcttgggcaacatagcaagatcccatctttattaaataaaagtaaaaaaattagctgggcaggtggtacacacctgtagtcccagtaactcaggaggctgaagtgggaagatcatttgagcctgggatatcaaggctgcagtgagctatgatcgtgccactacacttcagcctgggcgacaaagccagactgtctctaaaacaaaaccgaaaacacacacaaaaaaggaatgtcttgaccctcaaatattggcccctttaatctcagaagaaaatcaataaccatggatttatgagtattagattagtatctggtaacatttagagtataatttatggcatttcaaagaattgtccccaaattaataccagcttttaatttcctcccctgagctcacaattaaaaacagagggatagaagcactatgaaagcaaactcattccccttctcttcccagggaccacttaattgagcgactatacagagagatcagtggattgaaggcacagctagaaaacatgaagactgaggtataacttggatctgctctgcctttgcgcttcaccaaaacacggtagatttgaatgttaaatttgcatcacactagccaggcacagtggctcacacctgtaatcctagcactttgggaggccaaggcaggaggattacctgaggtcgggagttcgagaccagcctgggcaacagggtgaaacccccgtcttcaataaaaatgcaataattagccgggtgtgttggcaggcacctgtaatcccagctactcgggaagctgaggcatgagaattgcttgaacttgggaggcagaggttgcagtgaactgagatcgtgtcactgcactccagcctgggcgatagaacaagactctgtctcaaaaaaaaaaaaaaaaattgcatcacctagacagtttttggaccacatccttagggtaggttaattagtagaaacaagccaggcgtggtggtgtgcacctgtgatcccagctactcaggaggctgaggtaggaggatcactcaagcccaggagttttgaatccagcctgggcaacatagcgagacctgtgtctctaaaaccaaataaaaactggtagaaatgctaaatccaaaagaaccaggtcttcccgtgttctctgtcataatgcatttccattttacatgccatgaggacagcatttaggccaggcacagtatccatgtgattgatacccagagatgaccttggtccccacgaggctgagaagctgtggagaacaagaccagaccttctcacatggcgataaggagagattggtttgccgggcacagtggctcacgcctgtaaccccagcactttggaaggctcaggcagaaggatcacttgagcccagcagttcaagactagcttgggcaacatagcaagaccccatctctacaaaaaactttttaaaaattagctgggcatggtggtgcatacctgtaatgccagctacttgggaggctgaagctagaggatctcttgagcctaggaggttgaggctgcagtgagccataatcacctcactgcactccagtctaggtgatagtgataccctgtccctcccctcccccaaccgccaaaaaaaaaagagaagagacagctgtgagcaatgttggtgctatattaacaaccgcccctcacagtggctggtcaggtgacttcacccacagggacagccactgctacccccagccactctaaagaggaccacaattccccggccatcatcccctgttattgttgttgattgaggggctcctaatgaccagatggtccaaccctcctgggacgtggagagttgacttaggggaatcaggtatttacttggaagcatggtaggacccgcttctccggcccatgcccgtgacccgtggcagtgggcggttggcctcatgaccggagtccccccacagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaagtgagcggtgggtgggggcgggggcgggccccgggggcaggcgcgggcagcagagcccagctggactcaggatgcggcacagaggctgggtgggggagacccagactgtctttctagaaacagctaggaatgccagctcttagcctcagtccagagggcgggtttgagtcctgcaggcacaaagctgtgtgcgaggcaccgctgagcacagagatgggaaatacagaagacagcactgaagtgcttgccctgggcagtggatactaagggagaaggagagaggattgaggtcctaacaaagaaattgacataaaagctgagggcacagtggcacatgcctgtaatcctagcactctgggaggccaggatggaaggactgcttgaggccaggagttcaagaccaacccgggcaacatagcaagaccccatctctagaaaaaataaaaaagactagccgggcatggtggcacgtgcctgtagtcccagctactcttgaggctgagacaggaggatcgcttgagcccaggaattcaaggctgcagtgagctgattgcaccactgcactccggcctctgcaacagagagccttgtctctaaaaaatttcaaataaatttgttaaaaagctgaaagcccccatagaataaatgccatgtatgtaagtgctgaagaggcatgaatccctggcttgattatttatttgttttatttttttgaggtggagtctcactctgtcgcccaggctggaatgcagtggtgtgatctgggctcactgcaacctctacctcccaggtttaagggattgtcctgcctcagcctcccgagtagctgggattacaggcacacaccaccatgtccagctgatttttgtatttatagtagagatggggtttcaccatgttggtcaggctggtcttgaactcctgacctcaggtgatccacccaccttggcctcccaaagtgctgggattataggcatgagccacctcgcttggcccctggcttgatttttaactagttgaattctttttaaagatgacttcctggagaagtttctgtaagtaggactttcaagggagaaaagcatatatgcattcctaaatcaaaggaagatctttggccgggcacagtggctcatgcctataatcccactgagatgggaggatcacctgagcccaggagtttgaaaccagcctggaaaacatagtgagaccctgtctctacaaaaattagccgggtgtggtggcgtgtgcccatgaacccagctactcaggagactggggtgggaggatgacttgagcccaaggaggtcaaggctgcagtgaacagtgattgtgccactgcaccccagcctgggtgacagagcaagactgtctcaaaacaaaacaaggaggaccttctagggaccctggctcattgcaaggaaggcaagggtccctgctaggttagactcctcaccttggtcctttacaatacagggaaagctcaagccaatgaacagcgatatagcaagctaaaggagaagtacagcgagctggttcagaaccacgctgacctgctgcggaaggtaagaccctcagcccctgtcaccatcctgcaggccctgcacctctagggagagagcggctcaggcctgtggcttccccggggccagcaacccctacattgatctctaaggcattgccgtcatctcgggaaccacaccttttcaggcttccttgcctctgtgtcttgggctgtgtcctgggtgccaatcccatgtaggtcacccaccttctttattattttgtaaatatttgagcatcaagcatctgaaggtgatggctctgttccggctgtgggtaggaaagtgattcctgtgtctgactctagggcacgcacagcctgagtatgattgtcctagaaggaggatgtcctctaagcctgggatctcctggttcaagacactgttcttcttttgcagaatgcagaggtgaccaaacaggtgtccatggccagacaagcccaggtagatttggaacgagagaaaaaagagctggaggattcgttggagcgcatcagtgaccagggccagcggaaggtgagtgggacgaggagcactcgggaaatgagggagggggctgttgagttggtggcgggggctttgtggccttctgctccatgggcagttctgtgggtcggttggcatcacacagcagggagcacaccatggtggccacacagaacagcaaaacaccgtcaccagtgcatacacgaagtaatggaaggacccaagttgcctggggttaatcaacaaaggctttccaaggatgaggctggtggagagtttgaggaaaggaaaacacatgggtggcagagagagagggatgagcgtttttttttttttgtttgttttgtttgtttgttttttgagacggcagtaatcccaggactttgggaggctgaggggggtgtggatcaccaagtcaggagttcgagaccagcctggccaatatggtgaaaccccatctctactaaaaatacaaaagttagccaggtgtgatggcgtgtgcccgtagtcccagctgcttgggaggctgaggcacaagaatctcttgaaccttggaggtggaggttgcagtgagctgagactgcaccactgcactccagcctgggcaacaacagcgagactccgtctcaaaaataaataaataaataaataaataaataaataataaaaaatccttccttgacattccacattttcagtacactctggggtcttgcctcctcctcccacaccctgcacttttttgggggggtgtaacttacatacagtagagtttacagatctcttgttgatcgcttgggacgtttttacatttttatattctttgtcactgtcacccagatcagagtccctctgtttttcttctctttcagactcaagaacagctggaagttctagagagcttgaagcaggaacttgccacaagccaacgggagcttcaggttctgcaaggcagcctggaaacttctgcccaggtaaatacctcctttttttttttggagacagagtcttcttctgtcactcaggttggaatgcagtggtgcgatcgcagctcactgcagcctccacctccctgggctcaggtgatcctccccacttagccccccgagtaactgggactacaggcacacacccctacacctggctagtttttgtattttctttggtagagacggggtttcactatgttgcccaggctggtctcgaactccagggctcaagtgatcctcccacctcagcctcctaaagtgctgggattacagacatgagccttcatgcccggcctcctttcttgccccacccctggctttggcgttgctgtcatccaccatccttggcctggccaagtcagcccccactgcaatcagtgtgtccccgggagggaatcagagtggcaggttaaagagccatcaccttcccagtccttgcaacccggtggtgggttggacctctgggaagtagggactgtttaactcaaccagcgtctccctctttccttgtggtcacctttgcagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggcaagtcacggacatggacacgagcgagcacctgtgaattcccaccgagggcctctgcgcatgcacggaggctgggaggaccccggggctgctgagaaggggtttggggccttggcctgattgtgcagacattctgtaggtgtaatgccagcaggccctgcattgcctgcagagtccatgagggaaagcaaactgctgtcttttttgtatgagaagagaagtttggcatctcctcccagccatgagaagcgggcgcagtgatccatccccacagcctctgtgggcagccgcacatcgtgggcagccgcacatcctgtgcacacagttaaagcgcctttctctgtctcaggcttactggcttggacctcattggccatgacttgagctaagatgctaagagccccagccaggtcatcctgctcaggttcattatggagtctagggcagactctcacctccctggaccatttttaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcaggtacacttgcaattgcccagctggcaggggccaggtccttacagcctgagactctgttgatgttgaatctcatgtgagacttagctcaggggctctcagcccagcagcatgtcagcattaccttaggggcgcccaggccccatcctagatcagttacatgtggaaactctgtgcattagtgcctatacactagtattttagtattttcttccccccccccccccgcccccccgctttttgagatagggtcttactctgttgctcaggctagagtgcagtgccgtggctcactgcaacctccgcttcctgggctcacacaatcctccccactcattctcccaagtagctgggactacaggcacgcaacaccacgcccagctaatttttggtttcggtttgttgctcagactggtcttgaagacctgggctcaggctatccacccaccttggcctcccaaagtgctgggattacaggcatgagccaccatgcctggccttggctaattttttaatttttggtagagacgaggtctcactctattgcccaggatggtcccaaacttctgaactcccaccttggcctctcaaagtgctggaattacaggcatgagacaccacgccaggcccagcagtagtattttctaaagcccccaggtgtgatagctactgctttagacagtgggtcacactgataaaacacccaccaggagcagacaattctgtttctctaaggaaaaaactatggtctgaatcaagaggtgattactcatgaacttcacgtctaggcaggaagcttacccactaggtaagctcctccattcagtgcttaattaacgaggatgaagccagctatgagaacttgctctgaccttgccctgtgttccctctcacagatcacctcctctccacggtcacatccatttccagctgcatcgagcaactggagaaaagctggagccagtatctggcctgcccagaaggtaagaatggccaaggacagtctctgtcggctagtgatggccagacagggttcagaagcacctgaatgcggggatagtgacaggtccctctgcatcaagaaaggcatgtaggcaactcatacaagaaaggcatgtaggcaactcataaaacgggaggagagggtatgaaagtgtcaccatcaaccagacctgagaaacttctctttccaatcctggcagacatcagtggacttctccattccataaccctgctggcccacttgaccagcgacgccattgctcatggtgccaccacctgcctcagagccccacctgagcctgccgactgtgagtactggggcatgaggggctgttcatggaccaggggagcagggggcctttaaaagtctctgttgggccgggcgcagtggctcatgcctgtaactccagcactttgggaggctgaggcgggcagatcacttgaggtcgggagttcaagaacagcctggccaacatggcaaaaccccatctctactaaagatacaaaaacgatgggccagatgcaatggttcacgcctgtaatcgccgtaacactttgggaggacgaggtgggcagatcacctgaggtcaggagttcgagaccagcctggccaacatggcgaaaccccgtctctactaaaaatacaaaaattagccgggcatggtggcgcacccgtaatcccagctacttgggaggccgaggcaggagaatcgcttgaactcaggaggcggagtttgcagtgagccgagatggcgccactgcactccagcctgggcaacaagagcgagactccatctcaaaaaaaaagtgtctattgccttgtatctccagcactgaccgaggcctgtaagcagtatggcagggaaaccctcgcctacctggcctccctggaggaagagggaagccttgagaatgccgacagcacagccatgaggaactgcctgagcaagatcaaggccatcggcgaggtacttggagtagtatcattgaggagcattgttattcttctgggtgtgcgtgctggtgaatggccagggaatcggtgatgttctgagctagttctttctgcacttagaacttgattctagaaagagattgttaaaattggaaaatctggccgggtgcagtgatttatgcgtgtaatcccagcactttgggaggccgagtcaggaggatcacttgaggctagacgggatggctcacgcctgtaatcccagcactttgggaggctgaggtgggcagatcacttgaggtcaagagctagagaccagcctggccaacagggtgaaaccctgtctctactaaaaatacaaaaatcaacccagcatagtggtgcatgcctataatcccaggtactgggaggtggagtcaagagaattgcttgaacccaggaggtggaggttgcagtgcaccgagatcatgccattgcactccagcctgggcataagagtgagatctatctcgaaaaaaaaaaggatcacttgatcccagaagtttgagacaggcctaggcaacaaaatgagaccctgtctctttaaaaattaaaaaaaaaaaaatttaaaaaggaaaaacctcctgaaggactttccagctatatttaattcactggctgttagctgagaatctactatgttgtcatcattacactaggcaatatcaaagaagtataggcagctcccctgtctctgaggatttttatctaggtgggcaggtaatacccaaaatggaaataacactgtgttcattcatttactaaagatgtagtgccgagcatggtggctcacacctgtaatccctgcactttgggaggccgaggcaggaggatcacttgaggccaggagttcaatatcagcctaggcaacatagtgagaccctgtctctacaaaataaaattttttttttaattagacaggtgtgatgtcacgcacctgtagtcccagctactcgggaggctgaggcaggaggatcgcttgagcccaggatttggaggccacagtgagctatgattgtgccactgcactccagcctaggcaacagagtgagaccctgcctctgctataaataaatatgtcctgtataccagaaattgggttaagtatatatagggacagagaagacatggactctatggaaaagaaaaataagaaaaccatttctatgcagtacagttttttttcattttttccccagtgttatgaattggaatatattggttaagatacaaggatagggccaggcacggtggctcacgcctgtaatcccaacattttgggaggccgaggcaggtggatcacctgaggtcaggagttctagaccagcctggccaacatggcaaaaccccatctctactaaaaatacaaaaaattagccaggcgtgatggtaggcgcctgtaatcccagctacttaggaggctgaggcaggagaatcacttgaacctgggaggctgaggttgcagtgagctaagatcgtgcctttgcactccaacctgggcaacaggagcgaaactccactcaaaaaataaataaaaaataaaagccatgaggatagactgtctaattggagttccagaagaagataataaaaagaccacatccagccaaggtgggtggatcaattgaggccaggaatttgagaccagcctgggcaacttagtggcgccctgtctctacaacaaatttaaaaattggccgggtgtgatggtgagcacttttggtcccagctactcaggaggctgaggcaggaggatcacctaagcctgggagctcaagactgcagtgaaccgtgtactctgcagtgaattgcagagtgtactctgcagagtggttcacctgcagtgaaccactgtactccagcctgggtgagagagtaagaccctgtctctaaaaagaaaaaataaaaagatcagggccaggtgtggtggctcacgcctgtaatcccagcactttgggaggctgaggtgggtggatcacttgaggccaggagtttgagaccagcctggccaatatagtgaaactccatctctattaaaaatacaaaattagccagttgtggtggctaattttgtaatcccagcacatacctgtaatcccagctacttgagaggctgaggcaggataatcctttgagcctgggaggcggaggctgcagtgagccgagattgcaccactgcactccagcctgggcgacacagtgagacactgcctcaaaaaaaaaaaaaaaaaaaaaaaaaaaaaaaaattatcatctacatctttgcctccctaaataatagagttagtttcacatgatatagactacaggtaaatggagtcctactgtatatattcttctacaactggctttttcactccacattctgtgagattaatccaagaagataaattcattttcactgctctctcattatctattgtgtgaatatcgcttaattcatccgtctgttctcttggtgatggacacttgggttatttccagtttgggttgttattaatttgcccctatgatcatatatgcacacatgtcagtttctctagagtatatacatagaatcagaattactaggtattaggatgaatctcacacatagaatgttgagtgaaaaatcaagtcatggaaaaatatatacagtaggattccttttatataaagactcaaacattcaaacttaatagggatgcatctatgtggagttaaaaaataataataataagacaggccaggcatagtggcacatgtctgaaaatcccagcactttgggaggccgaagcgggaggatcacttgaggccaggagtttgatacagcctgggctacaaagcaagactctgactctacaaaaaagtttaaaagttagcagagcctagtggtgtgtgcccgttgtcccagctactcaggaggctgaggcagggaggatcacttgagcccaggagtgggaggctgcagtgagctatgatcgcaccactgcactctagcctgggcaacaggcttttatgttttgtctttaaaaaataaaaataaaataagacacaacaaccacgctcttgaattctgtgtctcttggggtagaaggcagggagtaagggagatagaatcagggcacatacaagttcaaataggattccaaaggtattgatgtttcttacagcattccttaagttttaagttgggtggtggataacatgcgtctttattcttatcctttgaaccattcatatatattttataccttagtatgtataacacatcatgttttaaaaatcataggctttgctgtttgtcagaccttagttcaaatccctgccctgccatttgttaccataactgtggtcaagacgttctacctctgatccctggcttcctatctgcacagtaggaataatacccgcctcatatgatcactgtggaagcaaagttaagtcagggtcaaagtggaagatatcatctgtatttgaaaaagttgtaggccaggtatagtaattcaatcccagcacattgggaggccaagacaggaggatcacttgagcccaggaattcaagaccagcctgggcaacatagtgagaccccatctctattaaaaaaaaaaaaaaacaattatccgggcttggtggtgcacctctgtactcccagctactctggtggtagaggtgggagaattgcttgagcatggaaggtcgaggctgcagtgagctatgatcatgccactgcactccatctctggtgacagggcaagactgtgtctcaaaaaaataaaaaattagggccaggtgtggtggcttacacctgtaatcccagcactttgggaggctgaggcaggaggattacctgaggtcaggagtttgagaccagcctgggcaaaatagtgaaacccatctctactaaaaatataaaaattagctgggcatggtggtgcaaacctgcaatcccagctacttgggaggctgaggcaggataatcccttgagcccgggaggcggaggctgcagtgagccgagattgtgccactgtactccagcctgggcaacagattgagactctgtctcaaaaaaaaaaaaaaagaaaagaaaagaaagaaagcaaaagaaaaagaaaaattgtaaaaaaatacctcctgtgtagctagtacaattgacactgcacaactaagggactggggtcttagtggtggcggaatggccttgcagggggaggcagcgatggcattctggaaggaggtggatcctgagtgaggaggagcatgaggttccagagtttgtgtcacagagaggacaagatggggtctgcaaaagaccccccacaacccctgtggcttgcagaaggtgtttgctgggtggcctcctgccttgccatcttgtaagggttacagatggcagaggagaagagacaggaggccccaaggtcagttcagcctttgtgatgtgttcacaggagctcctgcccaggggactggacatcaagcaggaggagctgggggacctggtggacaaggagatggcggccacttcagctgctattgaaactgccacggccagaatagaggtaggaggttcctgcaggatctcctgaaacgatgcctttgcagctgcccttctgcaacactgctcattaaacatgtcacagtcgttcattaaggccatggcaaccccctaagacagaaaccagaatttgccaggcacagtggctcatgcctgtaaccccagcaccttgggaggatcacttgagtccaggagtttgagaccagcctggacatcatagcaagaccccatctctacaaaagataaaataattagctgggcatggtggtgcatgcttatagtcccagctactccagaggctgcaggaggatcacttgagcccaggaattggaggctacagtgagccatgattgcaccactgcactctagcctgggtgagagagtgagaccctgtctgtaaaaatgtttttaaattataaaaaaaaaaaagagagaccaaaatctgaactcgctagtttttctgagtgatagaaaatgagaaggtcctcatgagagaaggtcctcatgagagaaggtgattagtttcctcaagaatcagatactttggtgtcagaacatcctgggttctggccaggcgtggtggctcacgcctgtattcccagcactttgggaggccgaggcaggcagatcatgaggtcaggagtttgagaccagcctggacaacatggtgaaacctggtctctactaaacatacaaaaattagctgggcgtggtggcgcgtgcctgtaatcccagccactcagaaggctgaggcagaagaatcacttgaacccaggaggcggaggttgcagtgagccgagatcgtaccgctcactccagcctgggtgacagagtgagactccatctcaaaacaaaacaaaatgacacggatcacagagccagcccactgcagctgcactccccctgaataggttagagtctggattcttttctgactctctcaagaatgtgggcagggacttggggacttccagattcaggtttcccagctaccacacgatgttggactgaaagtatagtaagacattagtggatccttaatattcaaggcacatttagaaaccatgcttctttttcacaggagatgctcagcaaatcccgagcaggagacacaggagtcaaattggaggtgaatgaaaggtcggtctgagcggcatggtgggacctaggggagcaggatctgtcttcctgacattggtctatactttgcatacttattagggaattagaggagagcagtagcagccacggggaagggctgagttgatgtaatcatcaataacagtattaatgatgacagcaatattgctgtttcactatagaaaagaaacccgcgtggtagctcccgcctgtaatcccagcactttgggaggctgaggagggaggatcacctgaggtcgggagttcgagaccagcctgcccaatgtggtgaaaagtcatctttactaaaaatacaaaaattagccaggcgtggtggtgcatgcatgtaatcccagctactttggaggctgaggcaggagaatcacttgaacccgggaggtggaggttgcagtgagccaagatcgtgcctctgcactctagcctgggcgacagagcaagactctgtctcaaaaaagaagaaaagaagtcctaggaatcacaatttcactattccttacgatggagacccacaattagatctctctcactccccagcctctccttcggtgcctccccgcagaatgttccagcaacctcagcacccttcttacctccctttcccattccaagcttgcctttggctaggagtggggaagagaaccgtcgttttcattgatcttggatcttgatctcagtgtatcctcgacttgtttgtttggcaggatccttggttgctgtaccagcctcatgcaagctattcaggtgctcatcgtggcctctaaggacctccagagagagattgtggagagcggcagggtgagcgtgggtgtgggccctgggcaggaagaggaggcattggtgacagactcccgctccaacggactctgtgatgctgccgtcttactctgtgtgtccacctgagtacagagcagccactcctgtagatatcagcagaggccctggggagaagtcagagctccaggacctccccagagggtggccaggcatgtgtcccaactccagctcccttcgcacaggcagacattgttggaacttgctgtgggagccctttttacattgcaaacctgggtactctgagggggacatgaggacttttgcaaaagaagcggatcctgaatgccagcttgagactggcttttcacagggagttcggcctaatctgtttctaacagcagagtcaactcacccttacaaatagactctgctgtcagcctcttatcaacgcaccacttcgtggtctcacacctttgctgggattatcatcatcttgtttttttcccatttccccatatgccgccgcagctcgggaggcgtaagtccaggggaggggttaatgagcctgagaacggtgccataaagcaagcagccaggcctgctttgctggtgccttttatcttcctgagagctgatgttttctgtttctaaaatagaaagatggactggacaaggattatctgcagattctcagactatcagacacttccaaagcataaaaacatttttcaaatccaagtagaaatatttttttttaatgtattcactgtgtagtctcctttttttggcaaatcgcagagagtggctagactcttttcagatcataacttattcatatgagaatatttattcttatatatacaatacagaaatgtcatggtatggtagaaatgctacaggctttggagtcagaaaagcccaagatttacttccatttatttcctgcatgaccttgggaaaagtctttttgtttgttgttttgttgttttgggttttttgtttgcttgtttgtttgtttttgagactgagtctcgctctgtcgccaggctagaatgcagtggtgcaatctcggctcactgcaacctctgcctcctgggttcaagcgattctcctgcctcagcctcccgagtagctgggattccaggcacacaccacgcccagctaatttttgtatttttagtagagacggagtttcaccatgttagacaggatggtctcaatctcttgacctcgtgatctgcccgccttggcctcgcaaagtgctgggattacaggcgtgaaccaccgcgcctagccagggttttgttttgttttgtttgagacagaatctcgctctgttgctcaggctagagtgcagtgacgcgatctcggctcactgcaacctccgcctcctaggttcaagtgattgtcctgcctcagcctcctgagtagctgggatcacaggcacccaccaccacacctagctaatttttgtatttttaatagagacagggtttcaccatgttgcccaagctggtcttgaactcctgacctcaagtgatccacctgcctcagcctcccaaagtgctgggattacaggcgagcgccactgcacccagctggaaaagccattttggtctctgaatcttcttcttttttgtaaaatgggaatactaatgcttatgtctcagagttactatgaggatgatttgggataatatatgtataaaagcacctgccatatagtacatgctcaataaaaggtggctattactattttttatttccctagggtacagcatcccctaaagagttttatgccaagaactctcgatggacagaaggacttatctcagcctccaaggctgtgggctggggagccactgtcatggtgtaagtatctattggtaccaagggtcctcccatgacccctcttccattgatccactccaaacaatagctaaggagggaaaaaaaaatctgtcccttagaaataaactattgatcaggaagtcaataggaccgagtttacaagggagcctggctctcccaggggacacagggcaggcagcctcccctccctgtttagccaagggcgatggggtggtctggaggtgggattgtggaggagttgcagctcatttgcccgtaacctagtccctcttgtcgttttccatcagggatgcagctgatctggtggtacaaggcagagggaaatttgaggagctaatggtgtgttctcatgaaattgctgctagcacagcccagcttgtggctgcatccaaggtaggacctggctggacctcctaggacgctggaaggcctggttagagagtactaggctaggttaaagagtacttggctgcgttaggcagtacttggctgagttagagagtacttggccaggttagatggcacttggctaggttagactgtacttggctaggttaaagagtactaaggggttagagagtacttggctaggttagatggtacttggctgggttagagaatactaaaggattagagaatacttggctacgttagatagtacttggctaggttagatggtacttggttaggttagatggtacttggctaggttagagactacttaggagttagagagtacttggctaggttagatagtacttggatgatgggatggaactggccttgagaacaaatgatctatccagggctcaggtggattcgattccaaataaaaattcaccctgttaagggtcccatactatcctcttacagaggctttttttttttttttttggagacagagccttgctctgtcacccaggctggagtgcagtggcgtgatctcagctcactgcaacctctgcctcccgggttcaagtgattctcctgactcagcctcccgagtagctgggactacagacacgtgccaccacgcccagctaattttttgtatttttagtggagacggggtttcaccgcgttagccaggatggcctcgatctcctgaccttgtgatccacccacctcagcctcccaaagtgctgggattacaggcgtgagccaccacacctggccttagaggcctttcatgtgacagcaaggaatgtctgtacccagtctgtacccaggtgtgccacacatgtccctcgcggctttcctcacatctgttacaagtggccttagagagtcccagcaatgccaacttccgattagcagtcctggcattcaagaaacactcgaataaggaataggttggcatcatgaacaggttacctggcttggctgtgagattctacaacccctctttattagtgttcaaatttgaatcaggccgggcacgatggctcactcctgtaatcccagcacttttaggaggcctgaggtcgggagttcaagaccagcctggccaacatggtgaaatccagtttctactaaaaatacaaaaaattagccgggtgtggtggcgggcacttgtaatcccagctgcttgggaggctgaggcaggagaattgcttgaacctgggaggtggaggttgcagtgagctaagatcatgccattgcactccagcctgagcaacaagagcaaactctgtctaaaaaaaaattattttttgaatcaatatcatcaatgcccccaactgattctcatgtaaagtgtgccccaaatcctttttaagagtttcacagtatcccagagtgttctttatttgtccttatttcttgtcatcccaaattggtttccacaactgggcacattgtccaaataagtgataatgcttagagtttgggatccaccaagcaaagaagccaggaataactttttatatgatagatatgtcaggagctgactatagtcagcagattttgagaagctgattggtgattgccgtttggcccacatatgtttgctaagaaccatcagagcaattatctgattcagtccttgttgctctaggtgttgtatgaacctaaatctgctttgtcctggtaggtgaaagctgataaggacagccccaacctagcccagctgcagcaggcctctcggggagtgaaccaggccactgccggcgttgtggcctcaaccatttccggcaaatcacagatcgaagagacaggtagcctttccaaagggacccttttcttacccaccctgttgagctcttctctgcatccttccctgtgatcccaaccaaatcccacaggactgtgtctaaattctttcatatttttcatctttttattttattttttctttatttctgtttttgagacagggtctcactctgtcgcccaggctggagtgcagtggtaccatctctgctcactgcaacctccacctccctggttcacacgattctcctgcctcagcttcccgagtagctaggattacaggcgcccgccaccacgcctggctaatttttgtatttttagtagagacggggtttcactatgttagccaagctggtctcgaactcctcacctcaggtgatctgcccaccttggcctcccaaagtttgctgggattataggtgtgagccaccgcgccctgccatttttttttcttttttttagatggagtctttctcttgttgcccaggctggagtgcaatggcgcaatcttggctcactgcaacctccgcctccagggttcaagtgattctcctgccttagcctcccaagtagctggaattacaggcgcccaccactgcacccagctaatttttgtatttttagtaaagacggggtttcaccatgttggccaggctggtctcaaactcctgacctcatgatccacccacctcagcctcccaaagagctaggattacaggagtgagccaccgttgtccggccccctcagttactttcatgcagtgttgacaaatggcaagccaggcgtttccacagagcattggcattggctgcctctcaggtgccagtcagccagggtagaatttgatgagaccttcttgtttccatccttgcagacaacatggacttctcaagcatgacgctgacacagatcaaacgccaagagatggattctcaggtgagagctccatctgtaagtctagatagcctctattgcctagacatggactctgaatattattcccatggagaaaagccagagggaaatgaacacaggtgcacctactaacccaagactgaatgtaaatcttgccggaagaaacagtggaggtagagaaggtgattagtgaatcaccttgtttttttttttttgtttgtcttgttttgttttttttcttttttgagacggagtctcgtcctgtcgcccagactggagtgcagtggcgtgatcttggctcaccgcactctccacctcccaggttcaagcaattcttctacttcaacctcccaagtagctgggattacagacgtgcgtcaccacacctagctaattttttttttttttttgagacggagtcttgctctctcgcccaggctggagtgcagtggtgtgatctcggctcactgcaagctccctctctcaggttcacgccattctcctgcctcagcctctctgagtagctggaactacaggcgcccaccaccatgcctggctaattttttgtatttttagtagagacagggtttcaccgtgttagccaggatggtctcgatctcctgacctcgtgatctgcctgccttggcctcccaaactgctgggattacaagcgtgagccaccgtgcccggccttaattttttatttttaatagagataaggtttcaccatgctggccaggctggtctcaaactcctgaccttgtgatctgcccacctgggccttccaaagtgctgggattacaggcgtgagccaccggcccttttttttttttaaataagatagagacggggtcttactatgttgcccaggctggtctcaactcctggcctcacacaaccctcctgcctcagcctcccaaagggctgggattacaggtgtgagccaccacacccagccaagatcagactcttaactcttgcccactattcttggactaacgttcctttacatgttatccaggatctcttagtatccacaaacttaatagtcttactataaacactgttttagacttctggtatgaattatttgcgtatgacttttagttttaaaagagaaaatccttttaactcatcaaaggcaatgccattatttctctctgttgttctataaagtcatattatgtaaaataggtatcagcgagatcctttaaaaaaaaattgacatagtttttctagaataactggtcatcagtcttggggtgaatttcaaattggaattgttaaagtactccaagatgtgtcactcagcatttttttttctctttttgagtcagggccttgctctgttccccaggctggagtgcattggtgtgatcacagctcactgcagcctcaaactcctgggctcaggcggatcctcccacctcagcctcctgagtagctgggactacagatacacaccaccatgcccagctaatttttccttcttttttttttttttttgagaccgagtcttgctctgttgcctaggctggagtgagtacaatggcacgatcttggttcactgcaacctccgccttccaggttcaagcgattctcctacctcagcctccaaagtagctgggattacagacatgcaccaccacacctggctaattttgtatatttttagtagagacggggtttcatcatgtttgtcaggctagtctctaactcctgaccccaggtgatccacccacgttggcctcccaaagtgctgggattacgggcataagccaccatgcccggccagcaaatattccttgaattaagaaataaaataaattacattaatgagaagtagagctagacaagatcaccctttcctttatagtaagattttccaggctttttcctgtagcagtaataagtgtaagttgcacaaatacctgaaagatatcagaaccatcatatttgcttcctacctgggtttctagggaactgggattgaagaagggttacaactagattggtactcaccatacagttaggctaaacattagagttgtttttagatagtgatttctcagaggaacagaagataagcccacctaccatttaggcatttgtaaagcatcattcacttccagtagaagatcacagtgagtaaagcataagagctactgggatagataaatgaatgggagaatggaaaaattagagcaaagaagagaattgaaattgagggccagataaagtatggaaacggtgaataatatggaagaagaggaattcacaatgcagcagaaagggagtaatcaaaataagatagatgtaggctgggcatggtgtttcatgcctgtaatctcagcactttgggaggccaagacaggaggatctcttgaggccaggagttcactaccagcctgggcagcagaacaagaccccatctctataaaaaaataaataaaaattaaatctctgagagctgattaagagaaaatcccacttactttcccttacaggttagggtgctagagctagaaaatgaattgcagaaggagcgtcaaaaactgggagagcttcggaaaaagcactacgagcttgctggtgttgctgagggctgggaagaaggtaagctgactccaaggatgggcactaacccgcagcagggaggggaagctgtgtggccagggccttcccctagaatggaacagaacaaggaacccaccagatcggtggcttcttccttctcttctctcctcatggaacctgttttctcttccgttgtaaataacctttaagcctaactttgggtgaagttatggtgatttgaaagcttttgttgtcaccttttaagacctaaacattgatcataactcactcactgccattccctcccaggcccagctagccttgccaactccctgggaatttagtttctggccagcagagagttgaaaaatgaataaatagtggtcagtcgagatctggcagacagggacaagtgaattacaaggttctgtctatctagagccagtgaagggcaacaattgccaaaagacagaagggatcaggtgctaggccgggcgtggtggctcacgcctataatcccagcactttgggaggccgaggcgggcggatcacgaggtcaggagatcgagaccatcctggctaacacggtgaaaccccgtctctactaaaaatacaaaaaattagcctggcgtggtggtgggcgcctgtagtcccagctactcaggaggctgaggcaggagaatggcgtgaacccgggaggcggagcttgcagtgagccgagattgcgccactgcactccagcctgggtgacagagcgagactccatctcaaaaaaaaaaaaaaaaaaaaaagaagggatcaggtgctgagaaatggagtggcatggagtcacattcaggctgccagcccagagacttgccatccatcacctcgagtctatatgttgttgtctgcatgtcgaaagcagtcaacttgatcacagccaagactgttcactcttagtggacttgactgactctgggcaccaaccatagacagatcctagtcattcctagacacgaaacttggggactatgtgattacaccatggttataattataatgtatttttgagcccccatggtggcaggttttgttggttaagtgaatgaatgcattcatgagtgctttgcaacataaattatcattgtcttttaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccactcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttggttgggttttttggttttgtttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccaccttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatcctgccagggaaagcctccagttccaacattggctttccaagcaaactggctttgccctctctctgccatccttgtcctccagagactgcaccacctgtagcatagaaaaccaccaccacggacctgccagccatcggcgcagcaaaccagccagctgtttgctgccaaattccttcctctcccaggtccagaccaaatacaagatcagcaccacaccgtggtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgtttttaacctttcccctgggtttccattagggtagttccttgaaatgaatttcatttttcactgagtgcctaccttcccagggcaggtggccactggcttctgtttccctccaacaatacttttattatggtattaagacctttctttgtataatacattgcatctgtgttttcaatttttcaaataaatatttccgcctggcaatggagcgtggtggtgattgaccagccagcgtggctctgaggtataggctccagtgagaagcctgcatttgtatcctggggttcatggaatccacttagccccacacctctgggaatatatcttagaaatattagttttgagccgggtgtggtggctcacaccagtaatcccagctcttagggaggcagaggcaggaggatagcttgagcccaggagttaagagacctgcctggaaaatatagtgagaagctgttctccacaaaaaggaaaaaaaaaaaagaaatattagtttgatattgggcatggtggctcatgcctgtaatcccagcaatttgggaggccgcagtgggaggatcacttgagtgcaggagtttgagagcaacctgggcaacacagcaagaccccgtctacaacaaaattaactgggaatggtagcatatgcctgtagtcccagctacttgggaggctgagtcaggaggctcagttcagcccaggaggttgaggctgcagtgatcacgccattgcactccaccctgggcaacagagcaagaccctgtctcttgaaaaaaaaaaaagacatttgtttgcacttcttaaacatgttccatcctccctgtacgctctcctgtccatgggaatgatcaaatagaaagtcccgaagtgggccaaggactgtggctcacacctgtaatcccagcagtttgggagaccgatgcgggcagatcacctgaggtcgggagttcaagaccagcctaaccaaca

SEQ ID NO: 16329 - DNA, 113538 bp, Human
  misc_feature (1)...(113538): n = A,T,C or G
caaagagaaattaagcatgtaccattgtcagcctgtgtgatttacactgaggagtagagatgtgtgtgattccacacttgccctccagctcctcatcctctaggtgcaaagacagtcagaagacaataaactgccatacacagagcatgttcaatacccttcctgagacaggtctaaacaaaatgcagcagaagagatggctgcttctgctttcaggatgtggggagaggtcagggcaaatggcagaggagagaggatgttggggtaccctttgaaagatgagtcatatctgttcaggtagggaatcaagaaaagacagtcaaggaatagaaaagttataggagtgctgatgcttttaaaatatttgggagaggacaaggggccagtgtgtgccatgtgctgtgttagaggaaacagggcctgagatgaggtttgtcagtgggtttgggggttcgactccagagagctcaggtcatgcagaagggtttgtttgcttgttaaacctggtagagtgtgtgccatgtgctgtgttagaggaaacggggcctgagatgaggttcatcggtggttttcggcgttcgactccagagagctcaggtcatgcagaagggtttgtttgtcaaacatggtaggccattctggggtgaaggagtaaggaggacagcagtttgcttccatgattacttggaaagactgctctggttacatgtagggaatagattggagggaccccaaaatggaaagagaccaggtggaaggttcacggtgggaggctattgcaattatctccgtgaaaattggtgagaaacaaccaggacagtggtgatgataaataagaggtgagaaggaatctaggagttttccaatactgacctttaagttgaagagcatcaaggcctggaggtgagagagtaagaccaagtgtcattttaggctttgtagtgctgtgggtacatgggcatggtcctggcccatgagaggaaaactgttgtttgtgaaatatgttttttctgtcatcatcatgatcattgtcatcatcatcttaggagctaacatttattgagtgcttactttatatcagtcactctgctaagccattatttcacctaaacctcacaatacagtgagtttagctaccattatcatccacatttcctgagtgagaagaataaagctcaaagggacaaaggcaggtcaccttgctaacggtcatgtagcaggtgaggaattaaactgattaaaacactggtctatctgaatccagagccctgctcctaaccagtaggatatgatgccatttaaaaaatacaatttggagtacaatctcatggttacagtagcagtaaggacacccacacattgctggttggatccaggattttccaactctatcaagagagtcagaaaatttcactgagttttaaaggatgtgtcttaagggatgattggggattttcaggttaaaataagtgagaaataaaagagttccacaatggaacaacctgttcaaggtcaaagattttaaaagggtctgggatactcagaaaatagtaactaactcagcgttatcagcattttgagtgcaatgttggggaaggcttgaggctgaggacagggctccctaatggttatcagcttatgccactgattccactaaaaacagtagacatggggataaacaggagctcttggaaggctttgtgaatatttttgattttgcctttcaatcaacagtcacaccatctctcaattcctctgcttcccaccgctcttcccacatctgcctcctgctatcgccaaggtataatatagagctccttctaccataaatacaaggtaaatgtatatggccatatccttggcaaatcaagcaacttgaaatttattactgcaaacaatatttattataaaaacatgctatacaaaaatttgtaggctaacacctccttttaagtgcaaagaattattctcaggtatttcttctatcctgtttccttacagttcctcctcagatcatgaatatctcctcagacatcactgtgaatgagggaagcagtgtgaccctgctgtgtcttgctattggcagaccagagccaactgtgacatggagacacctgtcagtcaagggtaaggtgctgacctggaggacgttttcagaggtagtatgttaaagtcttggctcttatgcacaacagagcttcaggaatcagaaaacattttgtaatccagtcatagaaaatcaaacaggcaatatgcaccaattgctggctatttcatttcaaaagaaggattcatagaggaaatttgctaaatgatggtgtcagtcatttttatggccttagatggcttttgttttccaaactatgaagaacaaaggacataagaataacttccaatgaagatgtgaatttctgaaagtagaggtgggtcagttggtggtttgttcttcctggaagtagagtgcaagagtattagcgtggccatggagaactttggcattattgtgcgtccaggagtaaaaggatctccttgcttcagcacttttaggacatttatccagagccacacatgtctgacatgtccataaatagttcaccttgagtggaagaaggatgatggaaatggttaagtgcatttgggcatgactgtgctgagcattcaataattggtatgaaaacatcagttaaaaccatttccaacttaatagcaagggaaccagaaggacagtggggcttgccctcttggaaataaaacttgccccaagtcaaacttgaagaggtgggcacagagccacttgaaatatttacactgttactaaaagctgtgattaagtctaggaattatacaagaaacaagagcttcctcaggcattaaacattcaaacatgaaaccaagtaagcaggaaaaatgtatggaatatgcctacataacattcaaaaataatattgacctacaagaaagtttaagagtaaatcttagtaatattgagaaagacaaagctttgccaggacaagaaaagccctaaccgtaacagaagaaaagtgataaattcatattaatactgaaatactcaaaactgtgtgatttaaataacagaaatttatctcctcacttctctggaggctagatgtctgagatcaaggaatcagcagggttggttcctttcaagagcctgagggagaatccattccacgtctttcccctagatgctgatggtttgctggtaatcactggcattgcttgacttgtaaatatattaccctgatctctgccttcatcttcacatggccctcttcctagatgcatctgtgtccaagttgttccttttaataaggatataagccataatatatcagtgtccacacgagtaacttcgttttaacttgattacctctgtaaagaccctattcctaaataaggtcacattctgaggaatcaggggttaggaattcaaggtatcatttttataggcttgtaacttaactcgtcatagccttcatcaaaattaaaaaccttcggtggagacacagactggataaaaacatttcttgtacatatatttgacaaaaaatttacatctagtgtatatgaagaattcttccaacacaattctaacactccacttcaaactgaaaaaaaaaatgggcaattccaaaagaagatacagtatatgaatggcaaataagtacacaaaaatatgactaacatcttcatcatataaataaaaatcaaaccaagatgagataccgttatataatccctaggaagactaaaattataaaggctgataatatcgagtgttggtgaggatgtggatcaactgaagctttatatattaactctgcaactgtgaaaacatataagccctataggaaacaatttcacattttgttataaagttaaacatacacttagcgtacgacccagcaattccactcctaggcatttattcaagataaatgaaagcatatgctcacaaatgtacattgtacacaaatgtttttagcagcttcattaataatagctgtaaacgacgaataacccaaataaccattgacaggcaaatagattaattgtggaatattctaacaacagattgctactcagcaattaacaggaacaaaccactggtgcacataacaaaatggataaatctcaaaaacggcatgctgaggaagttaagctaaaaattaaaaaatacatgctgtatgaatttgtttgcatgaaatcctataataggaaaaactaatctagaatggcagaagtcaagtcagtggttacctagggtagggattaggggagaagtgacggcaaagggccacaagaaattctgggggatgttggaaaagttctgtatcttgaaggttatgttggtgtcaaaattagtcaaaactaataaaactgtaaaaaaaagtgcattttattgtaggtaattatattgcaattaaatttgaagtataaatataccgaaatgtagacaataatgatctgaatttttttcttaatttggaacattaattatgtcattgcacttatcaaataagagactggatcttttaccaggagcatcattcaatcttttgctgctttttactttgtggactgagaacacgtatttttgctcctgccttgttatagggaaagataatgctaataaattagcctaatattcttggtataaagacctcagctattaaaacctagaatgtctctatatcataaagtaaaattaatgagagtattaaagtatatgtaagggatatcgcaaaactcaaatttaatataaacagagcaataatgttccccaagacatgggttccatgataattttgcctaaagttagagataattttggatttatattatatacaaaactatgtctaacttttatatatttggtaaaatcaaatgtctttataaatgcttgaaatcccagaatgtagttatttgatcctaaacacacagttctctaagcttggaaatcatttaaaaggcattttaactttgtgtaaatgtcctgaaacaattcattataatggtacactggtaagattttccttttaaaataagggagattcattcatattcccaatcttttacagagtgtaatagttgcaatttagcctcactggaaaatcctaaatttaaatgatccctctcttctttaaatctcacaggctgtgctgtactttgaagttgcctttgttttctcataggcttggccttaactttgttatccttaattttcactattgtcttcccccttccctctctcaatgacatttaagcatttgaactccaaaaaattgtttcctttgaaaagcgcacgggccatgctaatcttctctgtatcgttccaattttatacctaatgtaggtgacgggttgatgggtgcagcaaaccaccatggcacgtgtatacctatgtaacaaaactgcatgttctgcacatgtatcccagaacttaaaatataataataaaaaaagaaaagctctggaacatgaagtatttgtaagtttaaaatttgcatctgcagggtgactgccaatatttattttcagaaggatgctccttctcacttgcaattagggagttgttctaaaagattagaagtacattcaataaaacttgaacatcaaacagcatttttttggaaaaatttgttgatggattcaacatggaagaataagaaataaaggttgcaatgacattttctttcaaattccagtaggattatggtggaggagttagctaatgcaatatttgaaatatatgatttaaatttggggatctataaacagggacaagtaaatcagccttcatttaagaaaaatattttaatgagcagttattaaaaattaaaaatagtaacaatcacacttacagtttaagatggcaatatgagtacatgctgttcaccccttacaattacagaaaagaggtaaaaataaatgaataaataaatccattatcacattggagaaaaataatagtaagctttgatggatcagaaactatgaggattctctgaaatataaaaagtagacagatataatgaaggaaaaaatacagctcaaaatacagaaatgcgatctctacctgagatgataatggttgaagagtgaaggtttcaggtagtgctgcactggtaagtgagtaaagttgattggagtgggaggaggcaagggaatgagaggagtctgggtagcctctgcccatgttggtggtgtaaatactcccatcattgatgtttctggggaacccctttgaagtaactttgcttttcaggtatatttgtttcacaaaaacaaacaaaccaaagacatatccttcttaccaaaggagggtaaaagttttgaagcatccccaagtttccaaaggtggatcccaagacatcccagcttttctactctgtagactgcgtaagctgctggagccctgtcgacctctcatctccttggcagtacttaaagtgtaccaggattcccagaacctgggcattttctgaggacacatgcctcacttttgaggaaagctggatgttaccaggatcatgattaagtgttgtgaacataacgaaaagcactatgcaaacgtccctttggggttttgctgtttctatgcaaactgctgaacttttgactgtgtattcattcttgatctttagatacaaaaatctatacttaattttttcaatagcagccaatggcttattaaaaatatttatatagatctgctagagggtatggtacttgtgtagcagccttcacacatatggaaatctgtacttagtgacccatggcccaggaagtaggatgatgatggaatcacacaggctgctgcctcaaataattttccaaaggaaaaagtcaggtcccaaaacaagcaagcaaggtgtattggaatacattgtgaatcagctgcacttcaagaattacttcctttcccgttcctgaaagacaagagaagggaagctgggccagcataaactggcaggctcttctaggcacatgagtaatgtgaaaaagttgcagggatgggagtggcagaagatcctggagtctgttgtgttctaaggagggtagtcgtcccctcttgcaatgccatagtcgtccactgcgatgcctcacacacctggctccattgccatgacatatttggaaaggctagatgtttgggaaaaataacaaaggcttccttcctgtctcccctccactgagattttaagatgacaactcttcacctatgagttgctcatggagtctactcagatacagtaacatctcagggagcaagtgcatgagctatttcatacaagtgaattttccaggtaaccaaagctgactcttttatgcatttactcaagttatttctaatgaaagcatttaaaacatgaattaggttgtactttgtgtatttgtgtctagtgaatgccatttagcctcatctttatattgtaacatcaagattatacatatcgattgtatcttggcatttggggactgggataactaggaatatgaccctttaatactgtcaatactgtttaaattcttgtgtctttttaaaaatagctactgtattttttctttcttccattcaatcagacttgtcagttcttcctaaagtcagtgcacctgtcttttagcagccgcatttcttctgatctgcttctaatttgtcttgagcaagaatccataaaactaagttgattagtcctaaataagaactagtggtgggaaagggccttctctgagtatagggcattagctttcaggaatgtgatcaatggcactgatgacacctgtctgggggaaataatgtttggctttgttctagatatatgaggatgataaatgagtgaattccatggaagtaaagagctaatactagcaaaatcaccacctatggttatcacctggttaggcagttttgtcttctagtcactctggtagatgttcaggttagaaatgtactgatcagctgagcgcggtggctcatgcctttaatcagagcactttgggaggctgagatgggcggatcacctgaggtcaggagttcaagatcagcttggccagcagggtgaaaccccatctctacaaccacgcctgtagttgcaactgctcaggaggctgacgcaggagaatcgcttgaacccaggaggcggaggttgcagtgagccgagatcaggccatttcactgcaacccgggtgataaaagcgaaactctgtctcaaacaaaaaagtactgatccatgactgtttctgctacagcgttcatttttcatgctagaaattcctaaagagaaagttttagaaggaatcaccaagttcttagcactccaaataaaagatgcactgacacgcacttgtgtataggtatcgatccctgttggatggtggtgttagcccattggcagaacatggacttcagagtcttatcaacctaagcatgagatctggactgagttgttaacgccctgagtgactttcgaaatgtcgatttatctcactgatcctcaaaaccctttactgcaaaatgggaacaactttatcagtttattttaggaatcaaaagagagaatgaatggaaagcaggtaatagtgttgaatcctaactcaacagttatttctgaactgtagttgtgccatatttgcatttgaatgcattctttgaatccatgtagcatacagatagcctgggtacttgttatgatggtattatgatgagtgcatactgcatgcccagccctgttttgtacattttttgtgttttaactcattgaatgtgccagcagccttgggagaaaagtgataatttttactattttattacctcttgtctttgtctcttattccttgacagtccagaggtctttgattcatttctttggcctgagtgtagagtgggaatgatatagcagttttatttgtgataggcaaaaaggcaaatgtccttcattgggtatatggttaaactgtggtacaatcacaccatgaaatactacacagcaatacaaaggaatgaactattgttacatttgacaacttggatggacctgaaaggcattgtgatgaataagaagagttggtctcaaaaggttgcatattgtatgattacacttttataacattcttgagttgtcaaaattgtaaatatgcacaacaggccagcagttgccagtggtgagagtggcaaaaggaatgggaagcagaaggcagttgccttgggttgatggagctgtactgtatcttgattgttatggtacctatatgactctatatgtgtgactgaatgttgccgaactatacacaaagacataaaaataagtacatgcaaaaactagtgaaatccaagtaaactccacagtgcaattattcataactttatttatttttaatttttaattttaattttaatttactttaagttctggaatgtgcaggatgtgcaggtttgttacataggtatacttgtgccatggtggtttgctgcacctatcaacccatcatctaggttttgagcccagcatgcattaggtatttgtcttaatgctcacgctccccttccccctcacaccccgacaagccccagtgtgtattgttctcctccctgtgtccagagaacatgcagtatttggttttctgttcctgtgttagtttgctgagaatgatggcttccagcttcatccatgtccctgcaaaggacatgatctcattcttttttatggctgcatagtattctgtggtgtactaaaacaccaaaagcaattgaaagaaaagccaaaattgacaaatgggatctaattaaactaaagagcttctgcacagcaaaataaaccagcatcagagtgaacaggccatctacagaatgggagaaactttttgcaatctactcatctgacaaagatcaaatatcaggaatctataaggaacttaaagaaatttacaagataaaaaaacagtcctatcaaaaagtgggcaaaggatatgaacagatacttctgaaaagaagacatttatgtggccaaaaaacatgaaaaaaagctcatcatcacagatcactagagaaatgcaaatcaaaatcacaatgagataccatctcatgccagtcagaatggcaattattaaaaattcaggaaacaatgaatggttgtggagaaataggaatgctttcacactgttggtgggagtattaattagttcaaccattgtggaagaccatggcgattcctcaaggatctggaaccaggaataccatttgacccagcaatctcattactgggtaatggtatttggtatatacctaaaggattataaatcattctactataaagacacatccacacatatgtttattgcagcactatttacaatagcaaagacttggaaccaacccaaatgcccatcaatgatagactggataaagaaaatgtgtcacatacaactttataaatacaactttatatataatactatatgcatacacacacacacacacacacacacacacacacacacatatatatatatatttagttacataagatgacaccattgggggagatgggtgatagtactgggtacctatctctaccatttttgcaacttcctgtggatcgacaattatttccaatgaaacaattaaaaaaatagaaatacaaggaaaatgagtctctagtattccattaacaacctattcctatatatgcttatataagaatttgttgtttctaaaatattttcacatgaatcatctcaagtgggtttatagcagctccctaaaataggtcagagaaagaatagtttgtctatttcacagggagggaaacagatggaaaggttaagtaatgacaaatgagtcacagctaactaaaatggtagctttatgaaaagaacctagttcctgattttcaagtctggagctctttatattatacaaagatggcttccatagcttgaggttggaataggtataatgtaaaatgatatattgaatcaaattctgcttgttatctggggcacccaagggtgctcactagctttgaacatcacccatactcttgccttgcctttcctaagtccacacctaccttcctatgtctagtctctttctagcttccactcagtattcttctaacaaaagcacagcctccaaatcaaagccacattcatgccattgtccgctgtaggtccctgttgttcctctgtgtcaattaaaataaacctgctgagacttcccaacgtcatttctcttctaagccatcccaggtaacagttccagccactaataggaattgcctattagttgacctgctgcatcatccagtcttgctactacttctttgtctctctccaaggcagctaggagccttgtttctaatctgaagtcatgtttagagcctaattaatccctggagtgtgagaaagaggtgtctgagatgagaaatcaaggttatacatatcttgctcagtggaacagttatgggcaaacaagctgttcctctcacatttttgcaaagcaaatttatgttcactaactttggttcttgttgtaaatgagaagtgtgtgaaggtctagcaatgtgcttttcgccatatgggtacccatatgttttccccctttgcttgcgtacattttcgctttggcatgcacatatgcctgtatttttgcaacttaacaatattaaaactaatcccatttatgctccttttgggtgagttgattgagtcataaattcctgagaatctccttcttgggaggctgaagttcttttgtgcaagcgggaggacggcagagcaatctatcctagcagagggatgccttcagcaagcgtcactgtgcagctgatggccctgacccaaactccagagtgctaacctaacactggaagtctcagaaatgtagattcataatgccttcacattgacccccaccttccctccccaaggtggaaaaccctcactaagaaataagtagtaattacctagggttctctttctaaagtcccaggtgaattaacacatcttacaacaaacaattatgatgtctttaagctgtggttcttgataggtgaccacactttctacttaatactcctcacactgaattgagaaactatgcatgtcagaaatgggacagctggaaattaggcttgcacagaaatgatgcttagattcttcactgggcattttagagaataaatatgagaatggatatcacttgtatcatatctagtgaaaaacccaactaacttaaatgtaaaattggaactggaaatcctgcctaccgtctgttgtaaagctgtctatctttgtctcttatgccctcattcattcactcatttaatgcattaagactatttgctttccctttagcaacaatgatgtgtaagatagacgttgttcctgccggtctggagcctatggtctagtgggagagatagctatttatcaggtgatcaaggccatggcatctcacagtgtggtagctgctgtgaggatgggaaaaagtgtggtatagcctagggtaacttttccctgagatagtgacatttgaacagacacctgaagattaacagaagtcagggaggaggggaactggaatgagtgcatgtattgaggctgggctgagtagaagccttcaaggcagggaacagcacatccaaatgtcccgaggtgtgctggagctggctcttcaagttaaaaagagctgtgtcttgaatgcatagaaagcaggtgagacaatggcctgagatgggatactcatagaccagactgcctacagccctttaaagagttaggtcctttgcaaggacatggatgaagctggaagccatcatcctcagcaaactaacacaggaacagaaaaccaaacactgcatgttctcactcataagtgggtgttgaacaatgagaatacatgggcacagtgaagggaacaacacacactggggcctgtcgggggtgggggcaatgggagggagagcatcaagataaatagctaatgcatgcgggtcttaaaacctaggtgatgggttgataggcgcagcaaacaactatggcacatgtatacctatctaacaaggctgcatgttctgcaaatgtatcctggaacttaaagtaaagaaaataattttttaaaaaagttttgtctttattctgatagcacttggaaatagcaaaagagtttcaagtaagagagcttggaagtaagatgttcattgtctggatttaactaagaacatctcatttctgatctactcattctctatgtaaatctgcagttgactaaacctctgtctatttccccacctagaaaccagaaactaattagtaataatatgctttacatatggaggaatggaggatggattctgatagtatctattctgaatactttctacattataatatgagaatgaatattaacatgtatcatagcaaatgaaaagcccaactaactcaaaagtaaaattacaattggaaaggcacccattgctgcctgctgtatgttgtaaagccttctctatgcaattgctatatcaaattatgctattgaaatcagtcagacactgataaaattgagaccgactttacaagttctgtagatctaattggcctcagcagtgggtccgcagtgactcttgctgctgaacaaaaaatgtgggcttcaatagaaaataataagcagcctggttccatactaacatactgcagccacctctggagataatgcactttaatttagacactgagctccttcatctggccagatgttgaaggaatcttagaaaggtttgtttcctccttccctcctggatgagcacccttgatagtacatttgaaagacctctgggtccagctctgtgcacctaccacccttggtgttcccttttcaaagccatttatacttctttctaaaaatctctacatccctagggtaaaattcctataagtcaccttttcttgcttaagctgttttaaattaggtttccatcacttagagccaaagtagctctgattaaattcacatgccatgtagagggcagtatctaactgagccaagtagaacataatccctgctctaaactgagagccgtgtagaatggggagacacgtacatggtaccacaaggtgactggggcctaaccagctgtgaaaagacctctttcatatgtagaagagatagagaggtggcggcctggagtcattgattaacttttcaagcccactgtctccaccatgggttgaagaacttgtggctggatttagaactctgggtgggcagcagaagaggttcgacatctaaatcagctagagtcagtctgagaaagacaccttggctgtgggtctgagtcatagagtaattaacaccagggggtcatcaccgactgagtgcaccaagcgcacaatgtttatttaatgcacgcatgcctaccatgagaaaggtgttgaggataccaccttgagtgactgaaactcagcctctctgtcatgatcaacctctcattactctggaaaaactttatgaagagcaattagtttgtttccatcaattgattcactaacctttccttgggatgatatgctccaccctggccagaaagtatcccttgcatctctctgtccttaggttatttgagagcaggtatggtacctggggcttacatattcagaagaacacaaatgacttacattttgcaggcgatcaaaaagtgactattgaatgggtacacacacatgtatccatcgtatatcgatcctgtagcgtgccagagaaaaaaaaggggaagacagtggagatttgcaaagacaagttcccagatgcaggaagcactctgtctgtacagtgaaggggaaatctgatgtacagagtgaaggatgtttggagaaggcacttcaagtcctagctgtattaggagcctgcaggaagttgcagacttatctcccaagcatttttcttccatttcccccactataactattagccctggatgacgagtgagcttactgctgacgttttaattatattaagttttaaccaaatagtgaggctatcctagtttaggcttctagacacggtgatctgtgatctggaagatatttttcaattcgtgtccaatcacttttttttactggagacctatgacttgtgctggaaaactcattgcctttaccaagaagatgcataacaagagttgggatgacttacctcaacagatacaatttgatttttacaaattggtgagtgatcttaccatcttacgccatccagttctctgtgtgacaccagaattttgaccttccctgtctctgcaggctcttttcttcctgctttcttccaagagcacctgaaatcataaacttcaactatgctgggtcttagctcccacatgtccgaggttgaagaatgactctagaaatgatggtagtgtgaagaagatcattcctccccagtttaaaggtagtaatcatggttaataagctgtttctctgtatgagattcagaagaaggaggaaaaggggaagaaaaccaactaacattgcttagaggattttaactagagtgggctctccagtctcacaaatgttccagccttggatagggaacctccactggagatgaatagggtcaagaggaggtgatctcatgaagtaaaagcagttgattttcacttcgaacctgggcttcacagctgaaggctgtgattgactcacacaataacaaggactggggttgagtgaggaggtgagggaatttgatctcccacagaacacctaaagtatagcccaactctccctaccctatttccctccttgtagcctgcaaagtgggaagcctccttaatcaaagaaggagatcaatgaagtcctttctgcctgtcttttgtttttcctttcctgtccccttccttgtgttatttttcttattctatcaaattttcccactccagaatcccttaatggtgagagtaatcctcctggggtgctgaaaatagtttggttttaatgataccttagatgattttgcttcctaagagaaagatttagtaaagtcattgatataaacagagccactagtcccctgcttttccaattctcttccttttcccaacaagctctgctcagctcacctctgctcttcacaccattgcagtctaaatgctttcatcctgggcctctccaggacctcctcctgctccacttagcccatgcttatttgtccctgcacaactggagcctggtgcagtaattacagctgtggtgaaagggtttgtctcccttgggcactcaggacgttgccagtgctgctggtgaagatctgagccacttttgtagggcatcatagggccgtggtgctctgggatgtcagacagcaagatgtttggaaccctacccactcctctttctctcccctactctgcactcttcttctttttactcctgacccagccccaaacttcctaccacactttgtatctttttggcaggattttctgtcccagaaggcatgaaagcagttggaacaaaggcagtttggcaaaaaaatattgagtcatattttaagactctcctgatattactgcacctctgattctgtctaaggagtaaagaagcttcagaggctgcgtgtagctggaattatactcccgagagcccaggccctccagaacccagcaggaatccacaaagaaaagcagactctgctgaagcatagggcttgactgtacatccttatcccctagtgttgctatctcaaatcacctcatcctgatactccttctctccttacctgccttcattcttaagagctactgatccttcaagctctgtcgcactggcctttgtccattgctgtttctggttgtgggcgactttcaagcctcccatgcttgctggactgtctcaacttctgattttttgcatgctttgactataagtcaatatcataaaaccatgccatggcatgtcctcattgtcatcatcattatcaccaaaatcatcctttaaatttattgacatgccactttgacttaatcttggttttcaaaaaggtcttctgtcaaaaggcagacaaaaataaataagcaagtacttaaaaatagcatatagacagagactaccatacacactttacacagaaggaaatggagactttggctaaatgtattgcatctggaaacaacattccttcaattatttatttattcatgcacttgttcagtcattcaagaatgaattagtgggtgccttctacgtgttatgtactgtgtttgaaacagaagaataaataaaattatagttttctccaggaagctcaaagtttagtgaaaggctcagacataatagcatttaattatagtacaataaaagtgggtgcattagtgatatattcatcatgttgtaggttcacaggagaggatcatttaactccagttgttaaatgtgaaagaatcagggatggcatcctggaagaggtgactgctaatctggctgtaaacatagattcagagttattcaaaagaaggaaaatgaaatgggtgaggtagaggcaaagagaaatattctaggcaatggagataagagaagagacatgaaaatgggaaattgcatggtatacttagaaggataaaattcattttttcttattgaagcataaagtatgaacttgttgtaatccaaataaagttgaactcatttgttgatggtcccattatgacactgctttccatggaaacaagtttgatcacacccgctaagaaaacaaaaacaaaaattaatgtaagcaaaatctgtattcaaatcttcaaaggggtccccaaaggacaaatgttttccataacaggtagtaaaatagttgaatgttgcttttttgccagtctttctatttcactcacagtttggcaatcttttctctttcccttccacattccatgagaattctatgctacccagatctctactttcttcccttatctgctttcctctttccataataattttctcagatttctaacataaaccaaataggcttcttctcttaacttcttcattaagcagcactaaccattgttctgcttaacattagggctacaaatcaagaaaacatctataccttgatatgtaatgaggtttgagaagtacatgaagagtgaatcatgaatggctaaacagacagtgaacataagggaagaacaagggctttttatttaaaaaaatcttgcggtcataatttaaattaccgcagcttttggtgagttttgacaaatttatatatctatataatcactatcctaatcaagatacagcatattaccattacctcaaaagcttccctgtttcttattcttcccaaaacctatccccactttcaacttgaggcaaacactgatatgttttctgctgttatatattagacttttttagagtttaatatatatatattacatgtatatatttagcaaaatatgtatatgcattctatatgtatatataatctacatgacacaaatatatatttaaaacatgtgtatatgaactatatattgcaccctacacacatatctacactctgaaaaaaatgtaaaatcttgtataattttagaacatatactcttgtttctggatttcttcactcaccttttgagttttattcatgttgtgtgtggtttttttattgctaagtggcattctattatatgattgtaccactgtttgtttactcatttgccagttgggtggacatttggttgtttctactttttggctattatgagtaaagctgctataaacacgtatgtacaggcctttttctggacatatatttacaattttcttgagtaaatacttaggagcagaattggtaagtcgtatagtaagtttatacttaacgttacaaaaagccaccaaactattttccaaaatggttgtaccaatttgtattcctataagcactatagctgttccacaggcttgtcattgtatagtatcctgtctttgaaatattatctattctaataactgtgtaggctaaaacatatttggttttgagttgtttttctttgaggattaatgagtttgggcatatttttcacatggtcattggccattggtatatctaattttgtgaagtagtggttgaaatcttctgactgtttctaattgggctgtttatcttttattatggagtcataatttatatattctagatacatgtcttatgtcagctatatgtattcggaataatttctcttagcctatgctttgccttctcattttcttaatggtgcttctaaaggaatcttgtaaaggaattcagttttacatttggatgaagtccaatttatcaatatttcacacttaatggaggttaaaaacgttatattctatgttttttttctagatgttttagaactgtaacttttttgtttagctgtaagatccatgtgagttagtttatgtgcatggtatgagctaacatttgagattcattttttttccatacagctctacagttaatccaaaagcatctgtggaaaacataatcctttttctaatgaattaccttagtttctttgttgaaaatcaattgactgatttctttctgggaatctctcttattttctattcatctatatgtctattcttatgcctgaaccatactgttttgattacaatcactgttaatgttttgaaatcagacaatgtagattgccaaacttgtttttttcaaaatagtggccaatctatgtcctttgtattttcatataattttataatcggtttgacaatatttaccaaaaagatgttaagattttgattgggaatgcatttaaattatatgttaattttggaacagttgacatttaatagtattgagtttttccaagccttaaaatatattcttccctttattaagtcttggctaatttttctcaacagtgttttatggctttcagtgtgtggttccaaattatgtcatatttttgaatgattataaaggaaattttaaaaatctcaattgttcattgaaaatacacagagatacaattgacttttttatattgaccttgcctactgtgacagctaaatgtattccttgattctagtactttttttagatacttaagattttttacataaatgatatgtcctctatgaggagatagttttactctttcataccagtcagtatgcctcttattaatttttcttgtcttattatactggctcagttctccagtaacatgatattaaaaatacattgtaatactgacatccttgtctaatttctgattagaggaaaaacactttatttttcccattaagaataatattatctgtaggttttttacagatgatctttatcagattgagaagttattttctattcctagtagctgatttgtgtgtatgtgtgtttattagtccgttttcatgctgctgataaagacataggaacaaaaagaggtttaattggacttaacagttccacatggctggggaagcctcagaatcatggcaagaggcaaaaggtatttcttacatggtggcagcaagagaaaatgaggaagaagcaaaagtggaaagccctgataaacccatcagatcttgtgagacttaatatcactatcaaaataatagcacaggaaagactgggccccatgattcaattacctcaccctgggtctttcccagaacatacgggaattctgggagatacaattcaagatgagatttgggtggggacaaagccaaataatattactctgcccctggcccctccaaatctcatgtcctcacatttcaaaaccaatcatgccttcccaacagtcccccaaagtcttaactcatttcaacattaacccaaaagtccacagtccaaagtctcatctgagacaagacaagtcccttccacctatgagcctgtaaaatcaaaagcaagctagttacttcctagatacgatgggggtacagatactgggtaaatatagtcattccaaaagggagaaattggccaaaacaaagggattacagggaccatgcaagtccaaaatccaacattgtggtcaaattttaaagctccaaaatgatctcctttgactccaggtctcatttccaggtcatgctgatgcaagaggtgggttcccatggtcttgggcagctctgcctctgtgggtttacagggtacagcttccctcccaactgctttcacgagcaggcattgagtatctgtggtttttccatgcacacagtgcaagctgttggtagatctaccattctgcagtctgaaggacagtagccctcttctcacagctcaactaggcagtgccccagtagggactctaggtgggagctcccaccccacatatcccttctgcactgccctagcagaggttctccatgagggccccacccctgcagcaaacttttgcctgggcatccaagcatttccatacatcttctgaaatctaggtgaaagtcctcaaaccttaattcttgacttctgtgcacctgcaggctcaacatcacatggaagctgccaagccttgggatttccaccctctgaagccacagcctgcgctgtacatgtgcccctttcagccacagtggctcagctgcgacacagggcaccaagtccctaggctgcacacaatacgaggaccctgggcctggcccacaaaatcactttttcctcctgggcctctgagcctgtgatgggaggggctgctatcaaggtctctgacatcctggagacatttcccccatggtcttgggaattaacattaggctccttgctacttgctcaaatttctgcagctggcgtgaatttctccctagaaatttttttttttctatcacgtagtcaggctgcaaattttctgaacatttatgctctgtttcccttttaaaactgaatgcctttaacagtactctttaacagtcacctcttgaatgctttgctgcttataaatttcttctgccagatacccaaaatcatctctctcaacttcaaagttccacaaatctgtaggacaaggacaaaatgccaccagtgtctttgctgaaacataccaagagtcacctttgctccacttcccaacaagttcctcatctccatctgagactacctcagcctggaccttattattcatatcattattggcactttggtcaaaaccattgacaagtatttagggaggtccaaacttttccacatgttcctgtcttcttctgagacctccaaactgttccaacatctgcctgttacccagttacaaagtcacttccacattttcatgtatcttttcagcagcatcccacttctggtaccaatttactgtattagtccattttcacgctgctgataaagacatacccaagactgggaagaaaaagaggtttaattggacttaagttccacatgtctggggaggccttagaatcatggtgggaggcaaaggcacttcttacatggtggtgacaagagaaaatgaggaaaaagcaaaagcggaaacccctaataattgcccattagatctcataagacctattcactatcacgagaatagcatgggaaagacccccatgcttcaattacctccccctgggtccctcccacaacacatgggaattctgggagatacaatgcaagatgagatttaggttgggacatggccaaaccataacagagtgtgtgtgtgtgaatagatcttccattttgtccaatgttttttttggcatccattgaaatgattatatgattaattatgtgaaatgattttttaatggtagaccaaccttgcaaccaagaataaatctggtgtggtcatgacatactcatactatccttttttgcattagttgattaactttgtcaatattttgttactgattttccatctgttttgttcatgagggcaattggtctgtaatgttactgactggttttggtatcagtaattctggcctcataaaatgagttgggacatgttttccctttatttattttctgaaagagtttaaaaataactgatatcaacgtattccaaagcagtatttaataatattaatggttaacggttactttgccatttttattattgtaatagcaatatttctagtgttttctattaggtatgatgatggtttcagagagctcctttaccacttaaagaagaataccccttttcccatttcaataaaatgtttagtcaggaaaagataggtgttatcaaattttcttcttagataagttacaaaaatagtcatattattttttccctttcagccatatgtatgattttaaaatgatgtttattttttaatgtgaaaacattcttttttactccatatttactgtttttgctttagtagttataactaggaatatctctagtttatcatatttttaagaaacatgtctgtaagttttgtttacaacaccatactcaaattaattgatagatcctctatttgaactatgaattgtttaaaatataattaaaaattatattccttaaatgttagagaaaaattgtctctatagttattcaggttcaaacctagtttgtgagtattttttggcaattttaaaaaaaatttttgttgtttttaattcagaaattttacctttgaattaatttcggaaatgtataggttcaattttgataactgttcgatagttgtcaagtttatagatatttatgttaatgtatgagcacacaatagtatacattatataaacattgtacaaagtatatgtaattgaatatacctatagttatatataattcatatggtataaaatacttcattaatactacagtacaagataaatattaaacataaacatccagactgagagagaattctgttattcagattgtgcatagccatattgcattgtttgcttctctaaactttatgaaagcaaaaatgagtaataccggattttaataaagtgttttcagcttatctatgcattttaatactttttgctttatttttgtattttacacataaaattcaaaagtaattagagctttaatatgaattgcttcttttatcagtataattttttttttttttacaatttaatgttttaggcttacagttaaccttatctaactttaagattgtatttcctactttgattttgttaatactaaatgtacatttgctcagccttttaaaaaagatttgtattagtctgatttagatatagcttttgtaaacagagcagaaatatattctgttatcttttttttaatccaactgaagcctttttttcattataatggggagtttaacccacttgcaggtattaaaactgatgtgtttgtttctcgtcagctttttgttttcctctttttgttctgtctagtagctttcatgttttgtatcttgtgctatttgaaacaaattttctttgattttatcctctatagttttttgaaataaatatttgattttttatagtggtggttagatttatattttccaggagcatttgcagcctgtgtgagtcttattattcaagctgagtaaatgtttcctcacttcctctatgggaggtaagaattgcggcagcctcctttcatcctccttcctatcttggcactgtgtttctcagactatcaaaatcaccttttgaagtcacaatccgcgtttacatgttgagacattggcattttcatttagcttaattatcagatttataacaattcttccacctcattctttcgtattatgattcctttgtaggtgacactagttagcttttccctttgcttcatcttaagttcattggaatacatttcaagacgttttactaaaaagatgtgtgattgttgtattttctgattcttaggatatgtcttccttcaggtgataaacatttattgaaaacctgttttgcaataatagctggactaggtgctagagatacaatcataacacagactatccctcaagaagtgtttacctatgaagatttttttgttgctgtcaaatgcaattggagtatttcctgagcataaaatccaaaggtcacaatctttacccttaaaactcctgtggttaccccttcattatatttggcatttagtgatgaagtagagcaagctgaggtcttcttttctgatagttgtaattgtatgagtaatccattttctgtgtgaagataagaagatatgcctttatctgtgaggttgaaaattctttccgggagatgtgatgtgtctcttctgaattctcctaatatgcagtaagtctgttattaggcacacacatagattttttttttttttcgcagaaagtgggcatgtgttaaatatttaatggttggttctgttgtagctcgttctaaggaaacttagttccacgtgtgttggctctttcttctgtttccttcagatcttttgtctttctcttgctttcttaatctccttctgtcttttcttctgtatcccgggagagctgctcaggtttgaaattcactctgttgatttgattttttgaagcctcacatctgatatgttttacttctgatggagatttaaattttgttgctgttttaaggtcacttgcttgctctccatatctaactaattggacgttttcgttcatctcaacaacttttcttcttcggctctggtctatgtcattcttttccatcttttgccccttaagcagccttttcctgaaggctgtacttttctgcttctgtggaggttgtcaggtggctgtctacaattttaattagggttctggaagccgatttttttattgtgatatggtgcacatagcataaaacttaccactttaacctttttaagtgtacggctcgatcacatgaattgagtacattcacactgctgtacaatagaagtcatttattaaagcacggtcttcctggaatttttgtgactagtctttattttcctttttccacagtattttctcaatactcattctcgaaattggtgtgatctgtgtggtaagtggatggtgccttgcccctattctctgccttttgagtaaattttgagtcctgttttaattctactcttcaaatatttattaggctgcagagcttctggtttatttcacagtctctagcttccacctgttatacttctctttatgaaatggtactttttttcttgtcctctgagatctctgatgcatggtaatggttgaagaatttgaataatttagggcttggggggcactcattgactcctctggtttgaagctgcattggtattgcaagcccattgtgattgcttagaaagtctatgagggtagactccagggggacctcagtgaccccgcctcctgatattcacacccttgagcactcttcaccgtgttgcatcagtgctggtctgcatgaccatagcatacagccacacaatagctcgtggctccccagccaagtcataaaggccacgcttaccctgtgtcttaccctctctctcccgacaagtcattctgagagcagccagctgccatgccatgccctgacgacaccgagagttcttgtggtgagaaactcctgccaacaacctacatttaacctgccagcctggagcctggagcctgcaagccgcctgggaagtgcatcttccacttccaagtggatcctccagcctgggtcaacattcaaatgactgcagcaccaagtgatatcatgactgcaccctcatgagaaagcctggaccaaaagagacacagctctgaattcctgacccacagatatagtgtgagataataaatatgcattgcttggagccactaatttttgaggtgactttttagtcagcagtaaatagcgaatgcgtccatccaagtcagcgcttgtattgttaatggctgctcggcctccctttttgaagctttattatctgcataagggtaaagatagctatggaggcgtgtacttacttcttgtcttctttgaaatctttgtttcataaagataaggcatgccatgatttgagcattgtctctattaattaaatcaagtctatcttccttattagtattgtttgattgattttaggaactagattattcttcaatcttacttttcccaaaaatatgagtatcatttatttccaagtttttgcaagttatcttagtgagaagctgagagatgcatttgggtcttctatttcaatacaattttgaagcagatatctctccttgcttttaacaaaggtgcataaaagataccattatatctttaatatgctaggttactctaagagatagctaccacatctgtattttcttcaattttgcaaacgagataaaatatacagtccttggatcattgaggtagaaaaccatatctattttaaataaagatgatttttcttctttttctttatgtattccttcattttttctgacctcattgcattggctaaatttctgaaaaatattcaatattaataattataactagcatcctttgtcttcattctgttatcatcaaattgcctctagtggtttttgtactagttataatgctagtttctattttcaagatctcacttattgagatattataaataaatgtttaagttttattaaactcattgttttttaaatttttagagttcctcagttataatattgatactttttttcattcttggcattagtttcagacacaccatatttttaatgcattgttagattttatttgctaatagaattgtattcttgtaggtaaagcaccaaatgcaatagtggggacaggaaaatgtatgctgcctgacaatgcataagtgatcaataccttctatcagtagaagttgtggtaattactacgtgcactgactgctgtgaatttcagttttccaagtactgtgttggttctaggtactaataatggcaccaaggagaacctttgagatagggtagcaattttcctgacacctcaggaaaaaagtgtagcctcaaagttccaataaaacatcaccagccaacggagatgcaaaaatattgttaaactcaggttcttcaacattgcctttgtaatcaaccagtttccttagtgcctatatcccaagcgtagtgctagcttctgcactggcagtgtagaatagcgggggaagaccccaggtgactctgctgccaggggaccttgaataagtcacctaccatttttgagcctctagttctcatctgtaaaatggagcccatcagtcacccctgaactcctgtgaatattgctgtgaggatcagctataagggatgcgaaactgcttttgaaccagaatccactagaggcacttaaaagtatgtgtgttatcatcgtcatcgtgagagaggattgttaagccaaggcgccccactctctccagtgagcaggattcctgtgcttccatatgttattacaggcactgtgaaccagggtttacattttactgctacttaattaccccttctcatctcccagccattttcacatttaaataaaactcttgtttcacttaacaatggaagggctaaaaatttgcatattaagtgtgagtcagtggcatggatatctaattaaaaccatctttttccttttctccccttttcatttttgtcccctgagctgctgacattattgcaactgtattccgtggccccattctgtcagcctgtgtgttctgaggaaagcaaccaggaagggtgcaaggagagcaggagcttaagagaaggaggaggagatgtgatgtgtaactggggacaacaaaggcaaacacagaaggaactgtgatgggagaactggcacattggtgctggccaggaggcactattaatgcttaaaaagaggatgcaagggtgaagaagggagagcctgataaataaataaaaagtaccagaaaaaagagaaagtaaaaatggaagggaaggaaaggaccaaagacaacaagatgggtggagagaagcctgtagaactcacagtgagggtgatgctgtgtctttaagaagcaggtggctcaggagagaaactgcccgtgtcagcagagcagagggtggtgggtaaaggtgacagatcctctgggaaattcttgtacagcttcataaaacatgtctataatacatgaacatgtagagattgtcatcagaaagcatgtcttttggtcttgagtatctatccactttcctgaatagggttttatggtatcatttaacaatgcaggtgtgccccatatcctctcttttagatcttgcttttcttccttatagttcgcacagaaacatgactcagaaacagattcatctgaaagcatttgtataacttcaagatatagcagataggagggtctattcttcctctccccttccccatcgctaagaccatactaactaggaatttgtctacaattagctagaaatttgttaaaatcatttaccctgtatcttcctttgcttatttggttcatgaaacacgttacctatttaaaaaattctatgttgatggagaaaatcagcccttgataatggtagaaggtgagaagcatagcccacgttaggagttagtgcaaccatatgactattatggtgattatttctaccatagttatcatgacaaccatgcctcttggcatgcaagactgtccatctgtctgtgtacagctccttgggcagatataggctggaaaaagcaaaaatgttcagcaaatcaagaccaactggcaaatgatagttcccaaagggagaggtaaagaagaaattttgccattgaagtacaggccccagcgctatggcacccgggaccaggaatccacttagataaagggaaccatcccatttgtcaattttggcttctgttgcaattgcttttggtgttctagttatgaaacctttgctcatgcctacgtcctgaatggtattgcctaggtttttcttcgagggtttttatggttttaggttttacatttaagtctttgatccatcttgggttaatttttgtataaggtgtaaggaaagggtccagtttctgttttctgcatatgggtagccagttttcccagcaccatttgttaaataggaagacagtgtggtgattcctcaaggatatagaagcagaaataccatttggcccagcaatcccattactgggtatatacccaaaggattataaatcattctactataaagacacatgcacatgcatgtttattgcagcactattcacaatagcaaagacttggaaccaatccaaatgcccatcaattgtagactggataaagaaaatgtggcacatatacaccacggaatactatgcagccataaaaaagaataagttcatgtcctttgcagggacatagatgaagctggaaaccatcattctcatcaaactaacacatgaacagaaaaccaaacaccacatgttctcactcataagtgggagatgaacaatgagaacacgtggacacagagaggggaacatcacacactagggcctgtcagggggtggggggcaaggagagagagagcattaggacaaatagctaatgcatgggttgataggtgcagcaaaccaccatggcacatgtacacctatgtaacaaatctgcaccttctgcacgtgtatcccagaacttaaagtaaaacaaaataaataataaataaagggaaccatgtggatttacagcatgtaaagacaccagaaaacaagacaaaggaccatatggacaactgcttcaatgccctctggctcctactggaagttggcttgggaagctgttccctggacccaaggttaagttcaggagttacatatcctcttggagtagtgtttccaaattttgactaaattttcctgattatggaaatttttcaggttctggtaaaaattatatatttcatgtcccaccccagacctatcaaattggatgaggattatattaatatatttaatccaacaatgaggcatgattgataaatactaactcttagaggagctgaacaatttcacttgcaggggggccttgataagaccgagacaagacactgccattaaggcatgatggtctactgatgacttagtttccctgaggatgccaaagagtcacgtagttttcacactgttagacttactttaacatcagtgtcccgactcaatcctgatttgatgtatgaggtgattaagccactccagatctgcatttcacaacctattaccttcctcttcactgcttcttgaaatgtgactttaagccacagacaagataaataggcctatacttgggttcttcatgtactatatgcctaagagccaggaactagcatattgtcctcgaatgttggcttagatttgagtagtgttccctgttggcagaacataccgtgatgttaacttcctgcagttaacatagtcacggacatgagctgtgctcttcctcagttgccagcatgtccttgaaagtaattattccttgcatcctcaggacaactctatgacatagttctaatgcacatctctgttttccagttaaggatgctgaggcatagagaggaaatcaattgtctaagatcagagaggcagtgagaatcagaataggattcaatcccaggcatgcaagttccagactttgagcttttaaacatggaatttctctgcctcctctgcgatgctccatcaccatgcttttcccatctatgtgaaatgagtggttttcagcttgagctggttctgccctctgcagacaactgatgtccttttgctcttggatatctcatattgtgccaggcctaacaaggaaacctacggcatagtgatgaggcaagacccctccagctgctgacaagccctcaatcttagctcttctgagggaggcagcgtaacaggcatgagcagccatgcccagctctgctgctcttggcccctcatgtcaatggagcttagattgtctttgcagactgctcctctgctctttgcatggtgccgttcctattcctatgctgtcttagggctggcagagggaccctttcctcagctccctgcacctggaatcatcacatatctaccattagtccctaggggccttgtccagttttggttcttgttccttctccacctgactagcctggatctactttctggctgaatttcaaggtgtgctaccatgcacggggaagcacactcacagaattctgagagcatggcttttgcctgagacgcagaaagcctaaaatagtatctccataggaattgtacccacatttgaattcaaatccatttgtgtagcacgtaccacttcttctggctttcattttttttgagatttggagcaaccacatttttgcaaaatataaatgttcattcctcttcaaatctacagtgtcccatttcaataaagtcatgcactgtgtcttgatacacattattttaaaaccatcaggacttgggttcttcgggtcctatatgcctaagagccatattttaaaacatcaggacttgggttcttcggatcctatatgcctaagagccaggaattcaaattcgccctcaaactactaaacatgaaaattcaaacttccactacagaggaattgtagaggaaaattcaaacttcctctgtggaggggtcgtagagtataaataaagccaagtaatcttgacaaatgccaacatccttagacattggttttagacagtctctccttcaaaagttgtatgattcttctgtcttaaattgaatagatataatactgaacctgtagctgcatggcaaaaatttgagttgtgaccagtgtgtttccttgaatataatgaatgcatagtcagagtccatttaaaatgaaatagggagcatggaaacctatggaaatatactagggctgtgagaatcacaagaaaaaacagatgaccaatggcctttgttcttgatgtgtaggacttcagctggaccattaactctgtaaaatcttcaagttttatttctccttgaacctctaagctatgtaacatcactttatgccataatttaagtaatgttaccaccatttttcttttgatttgaaacggaattattgaaatagagtgtttttctcttcctttggtcactttattttgcagtcaagagttaaaatctataaaaatatagaatatgtttagacaaataattcatcatgttttctaaataatttatcgtgttgtctaaaaccatgaagttttcgattaaagaggtggagtcctagtcaatatattttgaaagtttttgaagagatctattcatgagtattgactgcaaacaaaaatgtcaaactgctgtgcatcagtgttttttaaaaaaatttaaaaaagtacagagtgtagcctcccattttcatatagcattgtggttttcttctctacctttggtagttgcttcaaggaatgacagagtggaagccaaaggtctaacaatggtctgaaacattgagtgccacctggcctggtcaccttcctgacctcttgttctatcattattcccctctgtccacttgagaccaaaagggctcttttctgttctttaccatagggaaaatactcccacttcagggcatggtattggttattacctctgcttggaatgttctttcttcagaaatatgcatggatcactccaatacttctttctgctctctgcccagaaggcttccgaatcactgagacattttctgatcaccgcccataaaacagcaacctttccacatcaccctggcatttcctgtacccacagcctgtcttaaattttcccaagcaattttcttttttttttttttgttcagcttttattttaagttcaggggtacatgtgccaggcatgcaggtttgttatataggtaaatgtgtgccatggtggtttgctacgcagatcatcccatcacctcagtattaagcccagcatccattagctattcttcctgatgctctctctccccactccccactccccactccgacaggccccagtgtgtagtgttccttgccatgtgtctatgtgttctcagtattcagcccccacttataagtgagaacatgtggtgtttggttttctgtttctgagttcgtttctgaggataatgggtttcagctccatccatgtccctgcaaaatacatgatcttattcctttttatggctgcatagtattccatggtatcacttttttcaccatcactcacacacacagagacatactgacacacactgaatattttctccagcatcattgttaggcttttaaattaagcagtgcatataaggtacctgctcatcgttattattgaggagaagatagctgatcatcattatggaaggctctgtagggcatcgtcaaacctatcctgatcttctctttgcttcttcctatagagaaaactttaattttctatatctatctgagagcaacctggtagcattttgtaatattgggttgagactctcttagtcttagatttgtagaactttataatcttggttctactttgttctatatgcaagtacattttgagtgtaacaaagcccacaaatcttttcctgattttgtttacatgaccttgaatttattgagtgatgagagctctgtcagaatcagatttcagagctccttggcccaagccaggaagtgggcatgcatgactgaccaagcccagagtggcaggaggccaacctgctgtgtcttatcttgctttcccatagctcaagaggacaagagcagtgttctaggagaagccaaattattttcctaacaagaaccataaagcattagaagtaatttcagaaaaatgtaagatatgtattcctataattctgacacttttaagagatatgactgtaaataaaacacattttacaaagggtgcatattaccagcatgctataaaatgcttctagaacttattttaataacatctcccccttcagacatatagcacttttactcttgagaccactttcacatccatccgtttatgctatctcacaacatagagagggaggacagcctggtcacgttcttgcacttgactgaggctctgaagagtatgatacgcacagcctctgtgccaggactgcagtggggggaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataggcatgagccctgcgccaggccaagagcaaacattttaaaccactctatacaatattcatcctatataagcctcaaataattttacagtcctgtgtgagggtatccttgcaaaatgtgggtatgtgaaactaaaatcatggtaagctatcctgaagggaactgatgggcatatattataatttgatgtagttcttggattaaaccttcactttcaagtttgatttctgagcaaatgtcttcccccaacaaatgcatagttgtttcaacctcctcccctttatctctagggtatgtttcgaacatctcttttaaaacgttaatattctgagattgtagttgtcttattacagttttcagtataaatgtcattgcccttgtcactcttattcaattgagagctcctaaaagtcagagacagagtcctaatggatgaaggctcaataaatgttttttgggtaaaatggaacagaagggattacaatggaagaaatgaaatgaattagaataatctaagtgcaaaatgaatatccagataagctacaaagaagagagattcaaaggaggtgacaatgatgtaaactttgagaaaagcactccaggaaaaaaaaaaaaaaagtcatccacaattgttgagagagaaaatcctttgtagtcgaaatgtattccctgtagggtctgagcttcattctcaaagcacaggttgtgagaaattgagtcttaagacaattaatagcttcctcttgtttcttctaaaggaaaccatcaaagagtcttgaagagttacaggtgtcatgttccattcccatgggacacctctggagctggtgtttgtgttgacatggaggaaaggaagtttctgcaacaaatgttcagtttttgttttgttttttaaaaaatattataggccatttgtttggcaccctcttacagaatggccatgtcctcaccagtggatttaaattaaaaaatcatagaaatcttgcaagataaaaattctagagttcttttttttccttctgatgactgaagacactataattgttgagatttttgcctgccttcttcatgcagaaccatctttttagagaattattagggttttgtagacatcaatctggaaagaggcaggaaggaaaagaacatgagatagggagggaagaaatccctgtttttcttcccctgtcaaaaatagaagaaaaaataaatacactaggtcagtttttacttgaactcactctttgcaaagaaaaaaactttatttcatactttttcaaaatgcccaataccatgaacactactgaaaacagaagaaaaacatctatttttaaagaggtaattgttacgcagttttattataagtagcagcagatgaggcatatgcatgattcacagcagtatgggaagacaaacccaacacgtttcaactgacattgtccttcttgcatttacaaaagtattattgacaacaacttcttggatttgaatggaatctgacaacagagaccattatttctggggtcgaaggtgaccataacaagagatcataaagtggtttggcaaatcagaaggcctgtaaggctgccaaaggccttgccaggcagggaaaggcaccctacagggagcacagctggcaacagctgggacatggctcttaggaagctccagcagaggttgcccgtgctcccacaacaagcggaaattgttttgcacccggaaatcaaaacagatgagaaaagatgcacatgggagcagggtaggggcaactgtgaagcatgggataaacaagctcctatgccttgcatttggatcaggataaaatggagttgaacaaagcaaactatgtattattaatgttagtgttttctttaaagatttgatatgggcaagcacaaaacattgtaataaaaacggaaaggctcttcaaaattggcaattctttttcttcagttctctcccactgggatgctctgtgcatcttttctccccttctccttttttgggaacatttttgaacaaagaaatgggagtccaggaaggagaggggaaagaaagctgatagcagacacagaaagggagagggaaatataaaagctataaagggacgtggacagagacgcaggaggtgaaggcagcctggattaaaagctagggagaaggaaatcataagagaacaagagattcatatgcttctaaaatatttattacacaccctgggggatcagtgtagaaattgcattccctttgggaaaacatttgcacatatcctccttgtctggatataaagggaagagcatctcagcagctttccagatgggaggagggaagttgcttctttctggagcccttctcttccctcttcccgagctctacttttgtgctcattctactgagggcagtcatggcatcttccaccactaccgtagttctacagcaaaagtgtagttaccagcaggtccaacttcctatccaccaaggtttgctggagattccaccaccacactcaatttagcctcacagaaaaagacggacatgaaatatttactttttatggcttctttgttctcacatctggtcctggaaacaggcaatctagttctatgttgaatcacgttgaatctgtcaatcatccatccagtatttattgtgaaactactatatgccaggtactgtgctagtccctctggagggccatcatccattcagtcatcaagtatttataatgtacctgtcaggtgctagatgctgtctactgaagcgttcatttattcattcattcaaaatatttactgagcaatttactgtgcaccaggcactcttctggaaattacacataggacaacacaaaacaaagtccctgccctcatggtagggctgaaagacaataaataaatcctatatcatgcttttaaacgctattgatttgctgatgatgctcaaacctctcctctgaattcctgagtcacagattcaactgcctgcttgatttatctacaggaagccaaactgggcctctcaagcttactatgccccaaatcaaactgaatttcctggccccttctcaacctgtttcttcctcattctcccccagttaaaacaacaacaacaacgacaacaacaatgacaacaacaacactccattcttttagttgttcaagtaaaaaaataatggtgtcatccttgattccactctttctctcgcgccctataccccatacatcagcagatcctgctggttctaccttcagattgtgtcagaatctgaagctcactacctctacccccaccacatcagtgcagcatctatcatctctcctgcagttttgcagggcccttaactgttacctttgtttctcctcgcgggcccctcagtcatgcccaccttttgctccaagccctccaagacctcccttttcactcacagtaaaggccagaatctttaccatgggtctcaaaaccccatgtgtcctggccattgtcacctttctggtgacacctcttatactcttcctttattccctctgtcaagcctcaggctcccttaatgtcctggccacaccagttgcctgctccttctctggttgtgaccttctctccctgtgcaaatggctcatgctctcactcacttcagtgtctctactcaaatgtcactttacctgtcagactctctttgttcactggatagtaaaaaaaaaaaaaaaaaaaaaattaggtatgtcccaaaccccacctacaatatctccaagttcctacgatatctccaagtttcctttatactgcataatttgtcttccaacacctactgtcccagcatatgattccttcatttgccaagttgctgaagatccaccctcctccaccaggatgtaagctctttgtgagcaggacctttgtgtatcttggccattggtgtagaccccacccctagaacagtgcctcgctcaaagcgaaggcttagcatgtatatgttgaataaatgaatgaattaaatatgtaatatagtttcaggcaatgattaatgctatgaataaaaataaaacaagggaaggggaaagagagtgagtgggtggaattccagttaatataccatgagcccctctggggaagggttatttgagcagagacctgactgagatgaggtggtccgtgcaacaagtaggtatctgaaggcaggctgtccagccgagggaatccacactgtctgagcaaggagcactctcgggaaagagcaaggggacccctgtgcctagaagataagcaatggggctggagcatgagggagagccacagggctgagcacatggagcagtccaggccattgtaaggagtttggattttattcttagtgtgttgggaagctgtaagtgcttttggagcaggagaaggacatcagctgactcactctttaaaagaatgaatctccagggcccgtgatgagcacaccgaggggaacaagttagggcaggaagccagtgaggagttgctgaggtcattcttggggagagatgtgcgggcctcaacatcatgggagcatacacgtggtgagaaagagttgcagctggaattatcttaaaggtaagccaggctttgctaacagattggatttggggtgtgagagaaagagaggactcaaaagtgagtccgaggcttttgaactgagttcctgtgcacatgtagtgacttttatcaaaatgaaggaaacagagggcagtttgtagggggaaagtgagaatttggcatatacaggacaaacgtgaaacatctttagacacgggagaagacacaggttcttcatttcttttttttttttttctttttttttgagatagagtctcgctctgtcacccaggctggagtgcagtggcacgatctcggctcactgcaaactctggttcacgccatcctcctgccccagcctctcgagtagccgggaccacaggcgcccgccaccacacccggctaatttttttgtatttttagtagagacggggtttcactgtgttagccaggttggtctcgatctcctgacctcacgatccgcccgcctcggcctcccaacgtgctggaggttcttcatttcaaagcaaaggtcaggccggaagatggaagcgtggaaggcatttgagtataaagcacgtttaaggctctgacacccagtaataccagcaagaagtgagtgcagccagagaggatggccaggcctgagccctggagctcttcaccaagcaaacattgggagaaaaggcagcgcctttgagagaaacctcaatggcagttccagtgaagtaggaggagaaccaggagagtgatttcagggtatggaaaataagtgatttccaggagaggtgttgataagtaggatgcagtttctattttcaaggtgctcttgagcttgtcaaaagagattacagtatagcaagcagaaggaactacaagagaggtgagaagagggcacagtcatgagcagcatattcatgtcaataatgggccacagacaatgttcacaatagcaaagacttggaaccaacccaaatgcccatcagtgatagactggataaagaaaatgtggcacatatacaccatggaatactatgcagctgtaaaaaaggatgagttcatgtcctttgcagggacatggatgaagctggaaaccatcattctcagcaaactaatacaataacagaaaaccaaacactgcatgttctcactcataaatgggagctgaacaatgagaacacatggacactgggaggggaacatcacacagtggggcctgtcagggggtgtagggctaggggaggaatagcatgagcagaaatacctaatgcatgcggggcttaaaacctagatgattggtggatggatgcagcaaaccaccatgtcacatgtatacctatgtaacaaacctgcacattctgcacatgtaccccagaacttaaagtataataaaataataataataataataatgggccacagacagaacggtggtcccataggatcctaaaggagctgaaaactcacagttgcctagtgacatcacggctgtcctaaggtcttagcacaatgctttactcatatgttcctggtgacactggtatagcccaaccatttgcactgccagttgtgtgaaagtccagcatgtataattacatacagcagaaaatatttgacaataaacgatcgttactggtctttgtatttactataccacactttttactattattttagatcatactccttttacttatatattttttaaaaggtaactgtaaaacagcttcagacaggtccttcaggagggatcccaaagaaggcattgttatcacaggagatgacagctccatgtgtgttactgcccctgaagacctcccagcggggcgggatgtggaggtggaagacagggatagtgatgatcctgaccctgtgtaggtctaggctaatgtgtgtgtttatgtctgaatttttaaaaaaagagtttaaaaataaaataataatacattttaaaaattggaaaaagcttaaggaataaggatataatgaaaatgtttttgtacagctgtataatgtgtttgtgttttgagctaaatattcttacaaaaaagtcaaaaagaccttttacctcatttcactcctgagagcatgtttggtcaccagctggctgtcctggagccaccctcgaaaattccaacagggttctcgttcttgtcgcttctgctcaaaccagcatggtctgacctatgtgccactggtgtttctatcagtatggaaaggatacaggtttcattaagatggacaaagtgatcttccttgaaaggattatccaagggatctacccaatgaaaaccatgatacctctttgtacttaaaataaacattttctaagtcaaaaagttaaaaaaattatgttggtaaagtaaaatagttgttagagtaagataagactaatgtatgactaaagaaaaaatttaaacaaaaataaatttagtgtagcctatgtgtggagtatggtaatatcccaggccttcacattcactcaccactcactcactgactcccagaggaacttccagccctacaagctccattcatgataagcaccctatacaagtataccttttcatctttcaggctatatttttacagttccaattgcttacagtattcagtacagatttgtaccctaggagcaataggctataccatctagcctagtgtgtagtaggctgtgccatctagcctagtgtatagtaggctgtaccatctaggtttgtgtaagtgcactctagggtgttcacacaagaatgacaccgccttcaacacatttcccagaagtatccctgtcattaagtgacatgtactgtagtatggtatttcagttatttgattactttgtctatagggcaggaggtgatcaaagaatgcttcacacaagactgtattttcacaaggcctcttagaagggtaggtgttctccaggtaaagaggaaccaggttttcctggcagagagcagcataagcagctgcataggcatgcggttggggaggcccagggtggctgaggcatcaaatgcaaagaggcacatggcaggagctgtggctgcaaaggtaggctggagccaactggatctctgcacatccagcagaaaaacttggattttatcttgtaagcagtgaggagaggatagagtaaattaaacctatctacatggatagaaatattcaaggcatagaagtaatcaaattgagaaggaaaaactaaaatgcgtattagaaagcagtaatgcaatactatgattgagtaagataagaatcatggccaatcgtgagtgatgtgcataggcccactgcttaatggccctgagcttcaatgtcctcagctacaagcttgctgagatatcttccaactcaaagcatttctgtgactctatctggccaggtaataagatcagggaatatttcctggaggaggaaaaccccaagctgggtcctaacgggaaagtgtcattcatagtagcaaagaggaagggagaggagagtctactaagggaagcatcacgagaaaagcaagaatgaggtgttcgtgcagcaaacagcaggctgcatgaagagaggaggcacatttgctgctcaccgttactgtagtccagggcctcatcagcaatttgctcccaataaatgcttgttgaatgactgtgggaacagataaatgaagaaaagtgggttggcccatgggtatgttggagattatagcagatgatggcccaggtcagcagggacttgatcctataggacccgggaggcaatgaggcagtgacatgttggaaattcctaaagggacagaagagacgttgcccgtcatgggcacattttagaaaattctgacaggtggatttgtcattgtacatgatgggctgagtaaccgtctctcagtgacccgagtcaacctgtttttctttatgtagcaactgttgtttgtttcagggtgaaaaatcctcactggagatgagagagcccagctgtgtttgggttttacaagctgtctcaagatttttctcaaatgttttggtttatggcaaagttgaaaatacagcattatcatgatccttattaccattatcatttattcaactacccactaataattaatgtttactaagtaccaataatatgcaatgagatgcaataagcattgaattgctcttggcctctttccagtgggcttgttgtaaataagaaaagaatgagttaccacccaaattttaattgcttcaaaatatgtttgtttcacaggctctccttggttaagctttgctaaactgattgaaaccaagaatgctgactttaggctagccatccgttttataccaacatttcccaaaatatgttgtgaggaaaggatattgatagatgatgtgtaaaaaaagagaaaaaaaggaaagaaagaaaggaataaagaaaaaaagaaaagaaagaaaggaaaattaaaaaagaaaaggaatcccagaaaaataaatttatgagacaatggcttaaataaaagtaaatatgttccttactgcaggattttggtggggtttgaatgggtcaatgtgcctagcaagcaccgagagaggaaaatattccaaacttatttgagcagggaatcattttctaaaaagattataaaagtatggtttaaaaaaaactgttctgaagttcaaaatgcattttttttaacaatgaagaaattgcatttgtcaggtcccttccctgtcctctcaattcaccaaaaccttggtggcacattcttactatcatcaaagaaccattgtggggctcacaaatgactaaccctaagataggtgcatcactccttcatgctgggtgacacgtatgctgtcaacagttggttgaggaaaccctctgcagaatccccacagcactggggccacccacacaattgtatgagacatgaggagagtcattttcactgcagtataaagatttgaggaccaagcttttatgagtattaaggcaattggaatccttgactcacactacaatggctaaaataaatgtgactgacaatactaagtgttgacaaagaggcagggcaactggaactcctgtaagttgataatcactgcagagagtttaaaacagggtgagcactttggaaaactgacactttcttcagaggctagccacacacctatactgtggcactgcaattccactcctaggtatttatttaagagaaatgagtggatctgtccacaaaaagatttgtacaagaatgttttatttataatagttatacagggaaacagggtacatggactaccattggaagattgggtacacaaatgatgctgtattcatccatggaatattactcagcaataaaaagaaaatatgcagttttatatacaacatggataaacttcaaaataaacaaattaggttaagcaaaagaagccagccacaaaagattacatagtatatgattccattaatgtaaagttctaaagcagtcaacgctaagtcatagtaggagaaattgatcagtggctgccttgacatggggtggcaggagccacatggtgggggaattgactggaccagtcctgaaggagttctgtgggagaaaggaaacatgctatttcttaactgggaggtagctacttgagtgttcacgcttgccaaaacacatcaaactaaacacttaaggtctgtgcttttggttgtatgtaaattataactcaaaacaaacaaacaaacaaacaaaaaacacaaagaaccgtgaattggaaccccctctctcctacagcactgtgagacctgttagctcctgccccagtcctggactgtcataaacacttatttatgaggtaaatgcatgcaatacaaagtaacttgcttgtcatgagtcgggggacagtgttccctttcatcatttggaatgaaaatttttaatacctagacactaattcttaggtcagtttggacagctctcccgaacagtgatattaagaactaattcttttttattttattttattattattatttttttattattatactttaagttttagggtacatgtgcacaatgtgcaggttagttacatatgtatacatgtgccatgctggtgtgctgcacccactaactcgtcatctagcattaggtatatctcccaatgctatccctctgccctcctcgcaccccacaacaggccccagagtgtgatgttccccttcctgtgtccatgtgttctcattgttcaattcccacctatgagtgagaatatgcagcgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcgttgttggacatttggcttggttccaagtctttgctattgtgaataatgccgcaataaacataggtgtgcatgtgtctttatagcagcatgatttatagtcctttgggtatatacccagtaatgggatggctgggtcaaatggtattgctagttctagatccctgaggaattgccacactgacttccacagtggttgaactagtttacagtcccaccaacagtgtaaaagtgttcctatttctccacaagctctccagcacctgttgtttcctgactttttaatgattgccattctaactggtgtgagatggtatctcattgtggttttgatttgcatttatctgatggccagtgatggtgagcattttttcatgtgttttttggctgcataaatgtcttcttttgagaagtgtctgttcatgtcctttgcccactttttgatggagttgtgtgtttttttcttgtaaatttgttggagttcattgtagattctggatattagccctttgtcagatgagtaggttgcaaaaatttcctcccattctgtaggttgcctgttcactctgaaggtagtttcttttgctgtgcagaagctctttagtttaattaggtcccatttgtcaattttggcttttgttgccattgcttttggtgttttagacatgaagtccttgcccatgcctatgtcctgaacggtaaagcctaggttttcttttagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtaatgtgatgcctccagctttgttcttttggcttaggactgacttggcgatgcgggctcttttttggttccatatgaactttaaagtagttttttccaattctgtgaagaaaggcattggtagcttgatggggacggcattgaatctgtaaattaccttgggcagtatggccattttcatgatattgattcttcctacccacgagcatggaatgttcttccatttgtttgtatcctctttgatttcattgagcagtggtttgtagttctccttgaagaggtccttcacatcccttgtaaattggattcctaggtattttattctctttcaagcaattgtgaatgggagttcactcatgatttggctgtttgtctgttgttggtgtataggaatgcttgtgatttttgcacattgattttgtaccctgagactttgctgaagttgcttatcagcttaaggagattttgggctgagacaatggggttttctagatatacagtcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttggctctgtttatatgctggattacatttattgatttgtgtatattgaaccagccttgcatcccagggatgaagcccacttcatcatggtggataagctttttgatgtgctgctggattcggtgtgccagtattttattgaggattttgcatcaatgttcatcaaggatattggtctaaaattctcttttttggttgtgtctctgcccagctttggtatcagaatgatgctggactcataaaatgagttagggatgattccctctttttctattgattagaataatttcagaaggaatggtaccagttcctccttgtatctctggtagaattcggctgtgaatccatctggtcctggactctttttggttggtaagctattgattattgccacaatttcagatcctgttattggtctattctgagattcaacttcttcctggtttagtcttgggagagtgtatgtgtcaaggaatttatccatttcttctagattttctagtttatttgcatagaggtgtttgtagtattctctgatggtagtttgtatttctgtgggataggtggtgatatcccctttatcattttttattgcgtctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgttagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttcttgttggtttcaaagaacatctttatttctgccttcatttcgttatgtacccagtagtcattcaggagcgggttgttcagtttccatgtagttgagtggttttgagtgagattcttaatcctgagttctagtttgattgcactgtggtctgagagatagtttgttataatttctgttcttttacatttgctgaggagagctttacttccaactatgtggtcaactttggaataggtgtggtgtggtgctgaaaaaaatgtatattctgttgatttggggtggagagttctgtagatgtctattaggtccacttggtgcagagctgagttcaattcctgggtatccttgttgactttctgtctcgttcatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttatcattatgtaatggccttctttgtctcttttgatctttgttggtttaaagtctgttttatcagagactaggattgcaacccctgcctttgttttccatttgcttggtagatcttcctccatccctttattttgagcctatgtgtgtctctgcacatgagataggtttcctgaatacagcacactgatgggtcttgactctttatccaatttgtcagtttgtgtcttttaattggagcatttagtccatttacatttaaagttaatattgtttaaatgtaacatttacatttaaagttaatatttaaagttaataattaatatcaaattgtgaatttgatcctgtcgttatgatgttagctggttattttgctcattatttcatgcagtttcttcctagtctcgatggtctttacattttggcatgattttgcagtggctggtagcggttgttcctttccatgtttagcgcttcattcaggagctcttttagggcagggctggtggtgacaaaatctctcagcatttgcttctctgtaaagtattttatttgtccttcacttatgaagcttagtttggctggatatgaaattctgggttgaaaattcttttctttaagaatgttgaatattggtccccactctcttctggcttgtagagttattgccaagagatccgctgttagtctgatgggcttccctttgagggtaacccgacctttctctctggctgcccttaacattttttcctccatttcaactttggtgaatctgacaattatgtgtcttggagttgctcttctcaaggagtatctttgtggtgttctctgtatttcctgaatctgaatgttggcctgccttgctagattggggaagttctcctggagaatatcctgcatagtgttttccaacttggttccattctccccatcactttcaggtacaccaatcagacgtagatttggtcttttcacatagtcccatatttcttcaaggctttactcgtttctttttattcttttttctctaaacttcccttcttgcttcatttcattcatttcatcttccatcactgatatcctttctaccagttgattgcatcggctcctgaggcttctgcattcttcatgtagttctcaagccttggttttcagctccatcagctcctttaagcacttctctgtattggttattctagttatacattcttctaaatttttttcaaagttttcaacttctttgcctttggtttgaatgtcctcctgtagctcagagtaatttgatcgtctgaagccttcttctctcagctcgtcaaagtcattctccgtccagctttgttccattgctggtgagggactgcgttcctttggaggaggagaggcgctctgctttttagagtttccagtttttccgctgtttttttccccatctttgtgttttatctgcttttggtctttgatgatggtgatgtacagatgggttttttgtgcggatgtcctttctgtttgttagttttccttctaacaggaccctcagctgcaggtctgttggagtacccggccctgtgaggtgtcagtctgcccctgctggggggtgcctcccagttaggctgcttgggggtcaggggtcagggacccacttgaggaggcagtctgcctgttctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagctttctggctgctttgtttacctaagcaagcctgggcaatggtgggcgccccttccccagcctcgctgctgccttgcagtttgagctcagactgctgtgctagcaatcagcgagattccgtgggcataggaccctccgagccacgtgtgggatataatatcctggtgatccgttttttaagcccgtcggaaaagcgcagtatttgggtgggagtgacccgattttccaggtgccgtctgtcacccctttctttgactaggaaagggaactccctgaccccttgcacttcctgagtgaggcaatgcctcgcccttttttggctcatgcacccactgacctgagcccactgtctggcactcccttgtgtgatgaacccgttacctcagatggaaatgcagaaatcacccgtcttctgcgtcactcaggctgggagctgtagaccagggctgttcctattcggccatcttggctcctctccctattaagaactaattctgtgcattttgttttgatgtgctctatctccttgtgaaaaaaaaatgcctgaacatttgatacatgttcagctgatgagtagtcctttatttttcaattaggataatcactgacttttatatttaacccaaattatattctcttggtctcagcatacgttttgcttcttcactggtggatgcagcctttcttcagcctcttgaagcaaccatgggtaataagcgcaactgtaaatcaaaaccagttaatcttagaagccaaagaatgaccacaaacaaacttaagaactttactaggctcaagcagtattatcttgatgataaagacaacagttatcaactattatttaacaagtcattaaatggtaagtggaaaggattcactcaccatgttcactgttgagtttagaacatctgtatttttgttttctatttttaaggactttattcccccaatgttgctgttagatttttgcttagaacaagaagatctttgatgtgaatgactctttggggggctcatgttaaggatgtgttgtgtatcccgttatctgtctcttcacttgtcttcctgttcttcatctttctcatcttcctcttcctcaccatcatcatacactgcacttattaagcacctactgtgtgccagccactctattctctgtactttcctttgcactgtttcattgaatcattccctatcttatagttagaaatggtattttaacctattttaagcttgaaaaattgagatttagaaaatgtatgtaaattatggaagaacacagtttaaacttagaacaattggtatttgattctaagtctatttgaatacagccaaatttattatatactgtattatatcatttcacatgccttgaccttcattttagcatagttaatcttttactttacatgtgagtatattctgcaaacttgctgaatttctaacttgctaattgtcttcaactttaaataccttccattattttacttgaaaaccctccatatatttaaaaatgaataagcaattctatttgctattatctcagaaatatatgcatacatttgataaagtatttcccttttagatatgttttcaaagggtcttcatctgtaaatcaaaatctttacaagtaaattactctatgcaccccaagagattttataatgaaaataaaaaataagtagacaggtaatactctttcctaaagtcaatgattaccttaatacatcagtctatgttccctgtctttgggcattacacctacaatacacagcacctgagaataaaaacacagcacacactccagaaaaacatatgttcattcccgatgaatttgcttctgtcttgaactttgcctccattcctcatgttggaggttaagagtgctctcctctctcaatcttacatttaaaaacagggacagctttgccctcttctcttagccatatcttgactgttccaagctttccagaatgacagttgcttccaacacagaaggtatgcctagccccagaaggcttcccactccaagaagcatctcactccaagttcggctggactgataacctcttccctctttcctgaagtcctcatccccagtgtgctactacctgtctcagtctgagatgaaaggagacgtctgtaccactgtgcaggaagagtggattctctgtggctctaatccctgtgtacttctggaactacctggtgcagcacaggctaactggggaaaagaatgtgcagccaggaatgtgttgtgggccagggagcttgagatgggtgtatggggacttggcttcaagagccatcttgggcaactcactctggctctgagtcctcatttgaaaatcattgggttgcactctgttatctgtggtctccaacctgggaaacctgggaaccacagggtgaacatgagagtccatgtattattgccagtgtttaaaaatcttataaaagcccaaagataagtggtcaatttacctatttttgacaaaaatcatattaattcagcataatggatactcagattaaaaggacacttgcattcaattttaaaaattgggaaaacaaatgcaatttgtttagtagataaaatatttcaaacaatgggattcatggaagtaacactttttttaattttttttaatttttttattattatactttaaattttagggtacatgtgcacaacatgcaggtttgttacatatgtatacatgtgccatgttggtgtgctgcacccattaactcgtcatttagcatttggtatatctcgtaatgctatccatccctgctccctccaccccaaaacagtcccctgtgtgtgatgttctcattcctgtgtccatgagttctcattgttcaattcccacctatgagtgagaacatgcggtgtttgggtttttgtccttgtgatagtttgctgagaatgatggtttccagcttcatccatgtccctacaaaggacatgaactcatccttttttatggccgcatagtattccatggtatatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacagtggttgaactagtttacagtcccaccaacagtgtaaaagggaagtagcacttttttaaaggtggcttaatgctgagaaaagctatatgatttctaagattttttgaacttcaagagtatggctctttgatttgaaatttgcatgtaaatatagtgtacatgctaaaaacatgagagtgtgtatatgtatcttacatagtgctgatagcgtcaagtacttttaaggattctacacatcttcacaataaccatttgaggtagatactcttagcatctccatttcacagatgagaaaactggggcgaaaagaggttaggttacttgcacagggtcacacagatggatttgtctgtgtgtcactctatcataaatgtatacagatgaaatatctgtatatatacctgttcatatgtaacgtacatttgaattcaatagccatacaatgtttggcaaaatactgcatgttacatgagttttctgtgctgaaaggaggtgtattattagtttgggcaggctgtcataagaaaatattacataatgggtagcttaaacaacagaaatatttttttttttcacgtttctggaggctggaagttcaagtgcaaggcgcatgcaggcctggttttctttgagatatctctttaacttgcagatggctgccctcttgcagcctcttcacatgttcttttctctgtgctcctgcatctctggtgtctctttgtgtgtcctaatctcatctaataaggacatcagtcagattggatttggcccaccctaatggcctcattgtaacttaatcacccccttaaagaccctgtctccaaacagtcatattctgagatgctggaggttagaatgggggtggggcacagttacagttcagcccatagcaagaggttaatgaatttcttgaagcagctcttcagagttccatgtatagcacacattttaaaatcgctccgaataactcctttgtttctgtacactcactgactcacttaagaaaaatgcaataggagaagaggagaagcaagcctatctaataactggagatttaggccagccctcaggccttcataggtcttagtgggggcttatgtatttggagggctttcataaagaactctccaaaacccaacctttgcttctctccagtggaatctgttgtgactcaggcagggacctcagggctggtggagagaagggaagaagaaagcacagaaacctagggctggtgaaataactagcagtatggcaggtgggagcagtatttccagtaatggtaatggagagaacatggcagctgtggctaagaaagagggtgctagaacccaagggggacagttattttgtgaccaggggattatgcctttcatcaggtggccacacagttgaggtgccaggtatgactaggcgttttacaccatagtgactgcaatccacgactttggaagacaggcccacaggaaccagatatgtgtcctggttccaataacatatgctggttcagggtggtgctccaccctggtgaggacaggagcataaacagggaactgagacagaagaccagctatatgaatgatggatagcaacaatctgttcaggaagggaggctagaagttttccgcagtggccagccatttgggggccactgcagaaaaatttctggttcctccaaatagtgaggcctgagattctgagaacacattcaatcttgataagggagaatgtgaggctgagctgggcagatgcaaagggtgcatgtctttgctacctatcacatctggggccagcaaggactgaagaggacaggccacagggtcactgagaaatgcctattgtttcatcttcctgcttttccatatcccctgggctcttttcgctcctatgtgaagaggtccaattcctcttaatttactctctccttgacaacagattccagaaagcattctgttctggtagcttctccttgcaaattataaacagggtaaaaactgggccaaggaattgacctggggagcaaagctacaaaggcaggaggcaggctacctgacccaatccatctctctctatcactaatgtttctgactctgtgattatgattttatgaatatgattgctgctgcatgttgggtctgtctgctggtaaatgtaggccagtcgtcccctcccacaggcccgagcaggctcctctccatcagctgaagtccttcatctctcccatccttcctgctacgtgttccagggatggctcagctacatacctgaggcctggcaagttcactgatggctcctgcaggtaattggccttagattgtagagagtgctgttaatttctctacaaatacagtgttctgtttggattttcatctgtgccatgacttttgggccttatgtaaagccattcctttacgtagttatggattatgatttttttgtgtgacagagtttcactctgtcaccaaggctggagtgcagtgacatgatcttggctcactgcagcctcgatctcctgggctcaagtgattgtccagcctcattcttctgagtagctgggaccacaggtgcacaccactatgccctactattttaaaaattttttgtagagacagaatccagccatgttgcacaggctggtctcgaactcccaggcttaagtgattttcccacctcggcctcccaaagtgctgagattataggcatgagctactgcaattatgaattttggctccagtgatagtggagaagcacctactctgaaaaatgcagtctccttgtcagtttcattatttcatgccctgcaccaatagggagggaaatggatccttgacctagttaggtttccttagtgatcactctttcatatttgtggaattggtagggctgcctcacttacagattgggtctttccccataagggagtagcatccagaagaggtagtttctgtgtccacagtagctcgagggctctttttctgtccttcaattgattttcttccttttcatgaattttcacacattcacaaatttattttcacaagttttcacaaagctgcacattggctgggaatctgcccctgggaatggctttgccaaaggtcattcacttggcatttgctgtttggcaccccttgtccttaatggaagagttgactgatttgaatgagaatttttcattgccgtgcattaaacagctgttctctctaaccagatgcttaatatggttcctcttccaagcctagtgaagggagctggctcgctagtttgcagttgagagaaatgatctaagagcctaaggatacatagaaagaatcccctggtggtttggggtaaaatctccttcttgggttaacattcagagcatacgaggcatttttaaaaagtggcctgttgatttgatgaaactgagatgtcagcgcagcactgtgaggtagtgagaaagatacaaatgccatcaggccatgcttccactgccccctgcagtgacgatgcacagagcacttgtgctggggactgtgggtcccagtggggagagattgttcagtgcaagctccactctcccacacagttcctgctgctggaagctcacctccatttattccatttatctgaagccctggccaagctgcaagctactgtgacccagttaccatggagaacttgtatattcttggcttccttgctgcttttacaggcagaattacagaagagaatgtctttgctgctaggaaatataaatattacagagagatgctcattttctccctctatgatgattattaccaaagatatgcaagaagacttcattacagaacattgtccttcataatgagccttccgtaggcttttacagggatggataagcctgccagaaatggattgtgttaaccctcggctctctcctgaatagacacaaactagaaccatttgcacatttagcagatttttgtggagtgcttactatgtgctaggctctggtgatacagagacaaatgagatactgtctttgccttcaaaggtcttagagtctaataatggaagctagaactccaaacaaaaacacatgttgcaatgactttcaccaagtgcagagaagtatttaaaaaggtagggatattccctttatgtgacatgtatgtatgttggttattacatatttgtcaggaagacgactgaagaagcacccccaagctgagtgttgaatgtggaatatttgttcaccaggaaaagggagggccttccagaaccatctttagcaaatgagttttgccttcatgatgtaggcctgctgctactcctccaccgtgtctgtgtttcagacaaggaaaagagggtgagggaaagtgaaggcaaatggaaaagaggcacatgtcagctgagcctgctttcaatgtgggctggagttctcattgaatgggatgggctcttgagctacaagagagcctagattgttgagtgtatttagctaggtccgtggctatccttaataaaattaggagttgctcaataaagagtgggtgtggttgacagcctccaagatggtcatgaatgattctcaactcctggaatgcatggccttgtgtcatttcctctgacactagttcatttacagcgttgcagcttctgtcttggtcttttgttgtgaggataattaggcagccctctggagacacccacagatggaggaaccaatttccagttgcgagagtgagccaacttgaatcaggtcctccagccccaagcaaactttctgatggttgcagccccagctggcatttggccacaaccttataacactgagacagaaacagtcaaccaaggcattccaaatccctgacccacagacaccatgagagacaacaaatgattactgttgttttaaactactaagcctggggtatgcagcaatagataattaatagataactgagtcaagaggagaacaggagcagtacctgaagagcagatgactagaaggctgtgccccaccatccacagccatcccctgccatgtagacaaagtgcctcacctgccatcaaaccccctcctcccagctgtgttttttggcctcacctttcttccttttctcaagcaacttaccactcggctgaaactttatcaagggctgtattgaataatgcgttaccaaattcatcgatcattttttgatgctcatttaactggaaacggttgctcatgagcttcttttcgaaccacttttcttgacttctaggacctcacattgtcatgggttctttcctgcctccaagaaacttgttttcagttctatctgaggttctcctttttcttcttaattcctaagtgttggcttattgaagagtcaggtcctagaacgccttttcttctgtctctactttttaataaataatcctaactggtcttctggctttacacatcagcgatatgatgctgactcacaaattcatatttagtagaatggttaagagcatgaacatgggaaccagacaatctgggtttcaatcctagctctgtcacttggtaactggatgaccttgggccatttacttaatctcagtttcctcatttctgtagttaggatgctaatgatatctatgatcacacttaaggggtactcaacagacatgagtggcttccactgctgctattattactgcttttactattgctactgatattcctcaaacttcaaacacattcatgcgttcatgctcacatacgtgtcaaatctgtctactgggcatctctattgagtgtctagtagatatctcaaatttaagtccaaagcagaatcctgcattttcctgtgaaccttacatagtttctgccctaattcactcagtctcagtgactgacacggctatccatctcattgtagcacatagaaaaaaatctaggtgtcattcttaattcttcaccttccttcattttgaatagctgatctagtaggaagccctggggtccttacccccagaactcatcccaaatctttccttgtctctccctctcctgtactgttgccaacatcctagccactggtgcttcctgccttaactacaaacatgccctctgcaccctccatgcttccatttttgcatcccttctgcaacaatgtgttctctattcagtagtcatcttttaaaaacaaagtcagatcatgtcacatcacttgcaaggtcaaaatcctgaaatgttgtctgagagcactttgcatgaaattcaaacatctcttgcaggactgggccttaaactacctgtttggcttcttcttatgaccactaccatcccccaccacaaacacacatacacgtacacacacactcacacactccccccacacacatacacacatatacagacacatacctacacacacacacctcccacacatacacacccccacacatacatacacacacatacagccccccacacacatacacacaccacacaaacacacacacacccctccacacacacacccctccacacatacacacacactcacacccctccacacatacacacacatacacacacactcactcccctccacacatacacacacatacacccccacacatatacacacacatacacccccacacacatacacccccacacacatacacacacaccccacacacatacacacatgcctatacacatacacatacatccatacacatatacacacacacagatacacacacacaccccacacacatacatacacacacaccccacacacatacacacacatacatacacacacagtcaccacacacacacaggcacacaggcaccacacacacacatacattcacacacacatacacacatacacacgcacccccacacacaaacacaccccagactcacatacactctctcacacccacacatgtgtgagccctgccctgtgcttgctctgctctagtctcacgaaaattctctccatgtcgcacccagttattctctaaagcatcaccttgtttcacttttaaattgtgattttgtttttattttcctatcttttccctcttattttctttttgcttccaactccctcactagactataaatttcataaggacatgtatcttacatcttttattgattgatgaattcttggcacttaaaacagctcagaacagagaaggtgttcaacacatttgtctaatgaataaaattcagaaaagacaaaagcagttgtccaagaatatttctagagctcttactaactggtttgggtagtggttactttcaataacatacagaaggcaagataattggaggtgaggcaatgagcataattctagacatgttgagtgtggagtgcctgtgggatatctgggtgtgattggatcagtatggatgagatccatgattttagagtgcaggagagttctgggaggtatatgtagttttgagatccaccagcgtttaccataaatgacctaatttagtttgagacttttccctaaaatgagcttccagaaagaggtagagctgctttaccttaaagtcctcacagagcgttatgtaatctaaaatgctctcttaattacttgtttagaacaataaagtaatgttttggcagatacattaacctgaaactacctcaatcaatactcatttggaatacttgggatgttttctgaaagaatcaatttttttaaaaaaggctaaagatttttaacattgatttaaataattatttttgtagctgcagtataacaattacaagtgttaggtattactgtaacaagatttttagaaatcgttttaaaaagcaacataacgagtgcagatcacaaacctctacaatccatacaactctatgaaaaatgaaaacaactaacattttatgcaaaaaggcactagttgttcaggattgaatttccactgataggtatcttgagaaaggatgggggtatggatagaaagtgtgcatgcttttataattagtttgcctgcagagggaaggagaggtgtactttggctacaggggcatttacaatgtaaggagttgtttctaatgataggaaagcactggccattcacataggttgaagaaaaagagccagaggagagtgagcagtttagagatcaacaagagctgaagcatgagtaaaggctaagcagaaagagagggaggctgggttggaagcccagataggaagattagctttgtccaaatgaaggagtacgccttcctttcaacctgtaggtcacaagattagggacacattgtaggtttgtcagcgtggagatcagaagctagagggatgtcaacagcctccttgaacgcatctattcaaccttgctgttcaccgtgacaccaaacactttgccctggagttgtcagctctcctggcttttgaatgcagcttgaatagtggctggaagactctgaactttgaattcagaatctttgattctcatttggtttcatagaccattatcactaagatttgtgagaggctgtgatctccacaattcttgtagtaacatgtgaggctccctttccttctgacccagaaacccctttctcacagtgctgccttggggagagggaggagaaagttcatttccgcactcagtattctccagtgagcataccctcatggcatctgggcgttggtgtgccagccttttaaatgacagcattaaactgcatctccagatccacttccaactcttacattttaaacatctataaacacttaactcacatgatgcctttaaataataaaacaaggtggaatataattaaggggcaaaatgagttgtacagacaatttgtgctgtgagcagtctttttaagttgactaatgtgacattgttctgcaggaaaagaaaacttcagcattttattttcagaactacctgacccaaattaggtaactggagtgtgaggagggaggattgaaaaagtcccagagcacctctcaggtgacgggaactcttgctttcctttgtaatcccactgaagggagacggaaggctagaggagcagggctgcacagggactcggcttctgtccaaggcgtcattcctgcctgcagaacaatgagccttcaggccagtggacgagtctgttatcagcctgcagcaggctgagaaataatctccagccactagcaacaatgggtgccgtatctcaggccaggtaatgaggagtctttaaactgcatcagctcgattttattatcctttagttttacacttctcagcctagaatggtcttatctgttcctttttgttgttctgtggaaacccctctccctccacaaaggaaaagatattaggtggcctttttctttccttcttttttcaaatttgaagccacagcattataataaatctctataaaaatacacataagtgcatgcataattaaaattacctgcctcagtttcttttgtgcaatatctgatccaaaatggatgaatgtgtaccaaccacattttaatgacacggacccgaggctccagccccgaatgcttattggggtcctgattagggagcagatttatctatatccaggcaaaccctacaactcctcggctggaggcacatcctacaccagcttttatatgtgctcagagacatcaaggaagaaagaaaatcttggactgcccaggctagctgtttctatcttgctgattcagtccaaagtattaactggttctttccatgcgtttctcttaaaagctgttttttcgttccaacaaacattgaccaggattgaagcaagcttttttttttttttccgagacggagtctcgctgtgtcgcccaggctggagtgcagtggcgtgatctcggctcactgcaagctccgcctcgcgggttcacgccattctcctgcctcagcctcctgagtagctgggactacaggcgcccgccaccacacctggctattttttttttttttttttgtatttttagtagagacggggtttcatcatggtctcgatctcctgacctcgtgatccgcccgcctcggcctcccaaagtgctgggatgacaggcgtgagccaccgtgcgcggcctaaacaagctttatgtctcatacagaatcattcagacttgctcccatggagcctccctgtgccattgtcttctatcaggagacattccacatgagtctgaaagggaggatggccctggtaggaaggggagttggcctacttaagatcagaatttatttctctatataggtgtgcattggtggagctctgcatcaaatgattcctaattcacaagaatgaaaaagacaggaatgtgaagcagtgagctgaatacgtgtcaattagcctatgatcccttttagtttctcaactttaaagataggtataggttaatcatgcaaaataaagaacttggttttatttttaaaacgcatctggaagacttcaaagtgaattccaaaaagagttaaacataaaaatgaaaaagcattaaaaagtatataagatatttgtataagtgtgagtttgggaataactttgtaattaagactcaaagtgcagaagttataaaagcagctgacagatttggcaatgtcaaaaaacttattacagtgaaagagattcataaatgaatttaaaagaaacatatcagtctggaagaaaatattcataatatctgtaagaaaaaagatgctatacacaaaataacatagaattctaagaaaataatataagaaaatgtaaaaaaaagtccaatcgaaaaattgattaaataaacaggaaatatacagtaaaaaaatacaagtggataataaaaataaaaaggatgattgatttcactagaaatcaattcattgcaaattactataaggagatattttacagaatgaaattggtaaaattcaaggagataaataacatgtggctttgttgtgaataaggaaagggtcattctcaggtaccctagcggagagtgaaagttaggaagctcagtgtagaccaattgggtagccttcactacattttaatgagtatttctaagaatcttttccttagaaattcttgtattatgaccaaatgtgtgtagaaggacgatcatggcaatgtgctaatagagagaaactggaaacaacctaaatgcctgtcacaagggggagcatttaaataaattatgatgtatctttttatgtagcccataaaaagaatgtggcagatccatatagacatgaataggtctatttcatgaaaaagttaaaaaataataagcatattttgccatttaggtaaataaaaaagatcgatatgtatatacacacctctgtatgcataactacacagaaactgtaacattaagatgtagcattaattgctaaccatgctttcctctggggaagggaatgagaagagggtagtcatgagtaggagctactttcacatcttgtacatataacacacttcttaattgtttgaatcttttatcagggagtttactcattttttaattgtgtgaaaagaagtaaagaaaaaaatattgcagatcccaagtcatatgtttaatttattgttaatcaatagaggggcttactctgcgtggcgttaatttgaaaaaccccgagaaagcatcaatgatttgcccattttcccagataaaaagtagtttgttaaggcgaggaccatcaaaacaagaataactaataaaagtagagatatttgattaatggaaacttttatttattcattcttttacttaacaaataattgtagagccgctgttttgtaccaggccatattccagacattagagattaagccatgaactaagcatagttcttgctctcgtggagcttacattctagtggccaggctggaggcggtgggtaggatggggtgggtgtcagacaataaacaaatacacgagtacatatacagtataatgtcacgtggtgtgaagtcccctgataaaaacataggcaagattaggaggctggggtggggaatatttgtgatattccatgtggcagtctgcgacagcctccctggtgataacttccagacagagacatgaaggagatggggacacaagcactttttggaagaagagttcagagggagtgcagcagctgcagaggcctttggagggaaatcttctccatctgctgggaaggcagccaaggaaagggaggggtggcaggagttcacagaaacaagagaaaaagtcatgaaatgtattttgtttatgtgctaagttacataaattacagaaactatttagtagttcaaactccagggagttgataatattatttccatttacaggatgaagaaactgagtctcaaagcagttaattacttgcccaagactacatggctgtactgtgtctgagctgtgtttgaacctaggtctctttgaatttcagaaatatgcacagtagctagactagcaatagtcaaacctatcagcatttcagacactatggagccataattcccaggggaggggcccaataatatgtatttttagaaagctacttaaatgccacagatgactgaccagcaaagtttggggactatttatctagcagtctgtgcacctccattggcaggtgagaagatgaatgtcctcaaaggtcaaatggctcaggagatatacctcactgtggcaaagcatgttctaatcccagattccctaaccctcagctcctctcaatccttgcagtgtggtacagcagggcttctcaagggtgatgatgcacgtgagaatcacgtggaatcttggtaaactacagatgctcttcaggacatctgcaatgggatctgagattctgcatttttagctagttccctaaggacaccaagtgcttctggtgtgaggactacactagagtttcctggaaagcttgttattgctgtccaggcgcccactctaggtttagagatctgagaactcagccctttcatctgaatgtgtgacaatgtccttaatacactattttgtgctcagtgatagaaaatagtgtttcagtgagtatgtgatagtgttgagaaaagagatggtgttgaatggaacaaaatgaagagggaaagacgtgaaatgatgtgcattgctgatgtagtgagatctttcaaagtgaaactggaagattgtatttacagaggagttgggagaagagacttgaggcaattaggcagacaagtcaaatcttccaaagttctggcttcactgttggataagtgggtatttttaacttgattaatctggataattggtaagggagaagttctatcacttctgatgtggacagagattgcagcagcaggtgcagagtggtcatggccttgttgggactctggaccctctttcccccaaggtctgggtatttgttcatccttgctacccctgtccctctccatgtctgaccttcaggggcaatttccagatacaaacttgagtgttgccttctagcaaaacctaattatccaggcacggttaccagccaccctctttctgtagaatttcactttactgccatgaatttcatgtttatctaagagatggatcagggaattaagaaatattgtcttcatcattggatgaccattcttccccccttctagagaggttatgcaatgtaattgagcttgcatttctgtatgtcttatggcagaggaacctgctctaagagccttaccaaggagactctagccaggaagcaaacaccactgcattattcagatattataaatcatcatctcttttccaatgccactcgcttccagctcagaatgaccaatgaacagagttcatgtcaatgttgctggacacccagctttcctgtgatctcctgtgtggggctcaaatcctcagagaggctgaagttttcaatttcacaggttgttggtacagggaagcccaccaggcagcctcaggaaaggtggtgtggaaatggcacacatcctgagagatatggtaggaaagaaacaaagtgttttttcttctcttacacagtcaacacagaacactgaatacttcacctctgatcaccaaaaagtgtgtgtgtggcgggggcggtgcggtggggggattcttcccaccagcaagtaattctccagtggacactagttgcacgtactgctacttattctattctattctctacctgaagatagtgttggatcccacagatttagtgctcagactcacaagactggcccccatttcaaaaaattgcaagtagtacattgtcacctatatttattccagaacagcttgatatggtttagttctatgttcccacccaaatgtcaccttgaattgtagtttccataattcctaagtgtcatgggagggacccagtgaagggtaatttaatcatgggcgtggttaccctcatgctgttctcgtgatagtgagtgaattctcaggagatctgatgattttataaggggcttttcccctttcgcttggcacttctccttcctgccatcatgtgaagaaggacatgtttccttccctttctgccatgattgtaaatttcttgaggcctccccagccctgcagaactgtgagtcaattaaacctctttcttttataaattatccagtctcgagtatgtctttattagcagtatgagaatggactaaaacacagctataaggccaagttcttgctacttgctcccagggtctaattaatttgcagatcagctcacagaaatcagagaaacaccatttttttgtttacccatgtattacaaagagaattaccaaggatccagataaaccgtcagattgaagagatgtatagcgtcaggtatggggaaggagcatggagcttgcttgacctttctggatgcaccaccatttagaacctccatgtgttcccctttccagaacctgctcgaacccagtccttttgcaatttcatagaggcttcatatcctaggcatgattaattacataattggccattggtggtcaactcagcctgcagcccctctttcctccatatgcttggttgcttttctggtgaccagctgccagcctgagctatctaggagccctcagtccccagtcatggcattagcatacaaaggacactcttacagctgcagagattctaagggttttatgagctgtttgtcaggagaggggaggaagaccaaataccaaatacttatttcactttttcagaacctgactcatgctctgttctccttgggttcactcagtatcctcaggtacatcattaacctcactcagccctactgcccatctataaagtggaacaagtcattctaccaaatttcatgggatagcatttaattcatgaaatgctttgtttatccatcatatgaaatgagctagtccacacaagtaaatatctaaataaaactccaaagcaatttttaaaatttcaattattgctccagagctctttctaaggaatgcttcctaagagaacactttcccttctttggcttgttaaacgtagtatatgtgatattttgtaaacttattttaatgactcaaggtcgtctttgtgaactgtgtttattgtgcagtgctgaagtttggcgattctctctggagctgttgaagtgcatgattatttgcttctgcaaaagatagccccaagtcgctatgcttttgaatactttctatatttttttcttattcttctttgccatcaagataccaagcatcaatttttgctgctgagatatcatttatctttagtcaccatacatcttcctcctgccctgttgacttcagtccctttaagtttctactttggcaatggttctcaaagtaagattcattgacccctgaggatactcaagaccctttcagagggtttgtgaggttgaaactcttattgctgtgaggtcaaagctgttttcaaggtaatactaagacattgttagcctttcccaatttgtcctgttagtacaaaagcaatggaggtttcacatggtggagccttggcactaatcaatgtagcatcattggctttgctagcagtcattgcattcctcactgccacaaactcacagtaaaaaaaaaaaaagtcactttaacttaagaatattcttgttgagccagcataaattaatttgattacatctcaaccctggaacgcatgagttttcagcattctgtgagatgaaatagcagtatgcccaaagcacaaagtacaatgttttcccaaggaaaaatcacctgttagactgtttggttgccagctcaagtagccatcccacccccacaacagcactgtatttgaaaaaacaactgacatataactcaacattattcacacttgagtatctagcagatcttttcttgaaaatgaataatgtgggcctgtcacttggacgaaaaccactgacagcatttgttgctaaaaatggaatttgagcttttgagctaaaattagaactttggaaaacttgtatttgctttcatgagcttgacaggttcccagtgcctaaagacatttctgatgagattggtggcaatattaacagatgtgattttttttttaactttcgtataacgaagtatgtcaacatttggaagatatgcatatcgcagtgaataaagatcctctacataaccaatatgtaatgttccaaaatgatatgtggagcaaaaaaggaatctatattaggcaaggttctccagagaaacagaaccagtaggatctctctctctctctctctttctctctctctatctatatatatatgtatatgtgtgtatatatatatatatattctctatatagatatatattatcctatatatatgtagatatatatataggaagtagatatgtatgtatgtatgtatgtatgtatgtatgtatgtatgtgtgaagagagagagagagagagaaaggaattggctcatgtgatgattacggaggctgagaagtcccaagacctgccttctccaagcacaagacccaggggagcagatggtgtagttccagttggagtccaaaggcctgagtaccagcagaaccaacagtggaagttctagtccaaggctgacagcctgaaggcctgaggccaggagggtcagtggtataagtgtgagctagagggcaggagcgggttcctgttccagcctgagcaggcaggcagaaagagcaaactctccctctgcctttctgttctgttcaggccctcagtgaattgtatgatgcctgcccacattgggaaggatggcccaatgaattttaatggaacagagtacaaaacattcattgacatggtctcagattctgaaattaagctttaagaaactaccatttgttgagttttggtgtacacaaaagaataatacacacaattgtctgaaagggctattaaatgctttatttcctaactccctcactttatgagggaggctacattttcttcacatatgtcaaccagaacaatctattgaatagactgagtgtggaagcagatgtggggatctacctgtctctattatggcagacattggcattatttaccaaaatgtcaaaactgtctttactgatctttatgttggaaaatatttatttttcatcgtaataggtacttacgttaaaatgtaatgggtttatcagtgttttttaaaaaaagaatcattatttttaaaaaaattattcaaatttctaacatggcaaatgttgataagcataatactacaaagcaagttgttagaagtcctcaataattgtttaagaatgtcatggggtcctgaggaaaaaagtttgacaattgctgttcttattagttcttattccttttatattattgtctcatcaaaacctcacagcaatcatgcaagacaggctgaaaaggaatcaccggtctttatcttgctgctgtgcataattaaactgcaagtctagaatccacactttttagctcctagtcaggggtgtgttcactgtggttggccagaggaagtgggtagaatataaccagatttatgcaacttatcttctatgcatgttagttgggtccgagtggggttctgaggtatccttttatgaatcgtcatgctctttgatgcatggattgtgtagtgtccatcttttgctgcttaaatgcctttgtttctcccaccacccctacatgttcatgtcttacttcctcagcttatgtgttacccaagagaccttctctgtccactcaggatagaatagtctttcccacatatctccccacctcccatcccacttcaacctgcttgatttattttttcctgcatcactgacccattgacaaattccatgttattggtttgttgactggctctcctctctggaatctaagctcttccacggcagacactttgcctgtccttttcactagcgtggacccatgcatagacctgtgcctggcacaaaatagctgatatttgttgaatgaaataattcattcaacaaggcattgagtgagcataacataggaagagacagcccattgcctcagttccccagagggctcagcagaccgtacaccaggcagctggggcaggagtgctttagccctgaattgggaatctgggtggcaggccatggacagcaccagagaaagggaaacaaaggttcagggcaagtggttggcacatagtgatcactcagcactttttagtggatggaggtcttattgctttggcatgtcttcacagtccttattaaggtttgctgttatattggtatttgtttggttatctctttaccacctgcctcctccatagaaggcaggaatcccatagcattcactgacggagcatccataatcagtgcctcaaacaagttgacactcaataaatatttgttaaagcatgaatctctttatcatgaattctatgtgtttgtaaatgtatcagtgtaggtttggtctttctgaacaactctattgtaagcgtcttaagagcagagtagatgtctcaccacttgtgttattggtcttattacctatcggaagcagccatgccctacgactgtgttcaaggccactcatgcatggccctgctcaattcgtcagcctcatggagcctcttgtgttttcagagcatttgactccctctatctctgtgcttcgtgacacggtacctctgctgcctggaatgccctttcaaaatgtgttgattatgctaattcatcctcattctctgggtctcagctcgggtctcagctcctcccagaaaccacccacagcagtctggttctgtggcctcctgtcttccccttgcctctgcggcatccctccccccatgcatgagccacattctattgtcatcatcttcatcacatcaagactgccagatccctgaagggagtgattgcctgacacagctgtattccttctgcctaatgcaggcattgacagattaatgagcatgattaataagctttcgtttaatcagggaattgtaaaaatagagtattacagaaaagtatggtttaaatctttaaggaatttcaattggactatgttgaacaatactcaatagacaataataacacacatttatttgataacttcctctgacaagtccaatgcactttacgtgttcactactgctctttctcccacacctgatgccttaggtgaatgccattgattcttcatggaagagagttgggtacccaccctcaccaccctctacatgaaacacaggtagaatcatttatcatttgtggattatgggctaatgtggaaggcaagaagtcttttcagctattttctattgctgctgacaacagtgcacttggaaatgagcaagacagatcacgagggtatttgactagatatatggaatttcttctcattaaaatccctgaactctaaaaaaattaactaaaactaaatttaaaatttcctgcccggtgtgacctctcctgccttaaaattcctctaacatttattagaattatgagctatttaattctcaaggtcttggacatcttttcttttgttctgacttgttcaatttttcattgttatgtaaagtttcatatgtttatgcactgttttctcaattgcactgtgctctcctgaacaatgggaaactgtttatccttttagctgcagttcataaaatgccaaaggtttcctctgaacctctgtaggtgtctctgtgagggttagagaaagcgaggagagacggtgggagagagacaatatgaacagctgtgagaatgagatagtgagcactagactacaaaaccttgaattcctatacctcccctctaccccaaccccaaaatagcagctcagattttgcaactcgataaaattttaatagaggattttattggcagagagagagaggattccactacttaagtttgacagtcaataaccactaacgcatatcatctgttatgtcatctgatgtctgtgctttctctctaaaatgtaagctgtgtgagggcagagattatagtctatagagtaagttatgccttacatatgaatgaatgaatgaatgaatgaatgaatgaatgaatttgacaaagaaggtttttgacagacaacggtagtctctatcaatatgtaatggcttaggatatttaaacacaagagaactgcttttgagtctggaatgatttaaatgtacagtgaacatataatgtagtgtctacactgagaccgttttgaaaatgacgggactggcatccatattacagaagatgaacaaatgtaaacaaagactatctccagcaagggagatagcatgctcctaagtggcatctcaaagggatctcactcgagggcggatttgaagatttaacctttgcccacgggaacctcaagtcctatttgtttctgccctattagaagtggttattacttgcagggaaccatccagtcccacagggacactgctatgggaaggaggtgaccttttgagttaagggaatctcaccggtagcatgtaagccatctcaggtcactgcacactccaggcttctctcaggctaagcagccagttggcatctctgaggcgcccaccagatgggtgtacaatacactgtgtgatcatttgcaaagtaaaggaaggctgtggttctgtgcttaatttacagagtgtacaattaaacagaaatgagatgcgcaaactctgtgaaactttttgcaatgctggtatgaggagcatgggatttagataagatcgtttaagaatgtagctgttatgttttaggagacagggttcgacctgtaatatatccaggtttatgtgatacattctattataatggtcttatactctgttcatgaaattacaaatgtctcacaggaaaaggttagtcagatgttatactggcaatgcccctgacatgtttattcagtccagggtcagagcatgattattaaaccctactgaaaaaaataaattgacattttagactgaaaatcacatcccttctagggggtgtgcatactggctgtgtgcagatattatatgtccctgcagttatgaagcaatttatgtgctggtgtggatttccaacaagtcagttcatcctgtttcccatagagtaggctagattggatctgaaggcagcccttctctcctctctgtaatgggcaaaatttaataggttacagaaagccacaaaccctattcaacatggctgctgccatgttcccgaaggccctgggtgctggcttctcccatcatctgtcctctgtcctcagctgggagccctctgcgaggctgtcgcagtgagcagtgtgtggaagaggcagtggagcatctccgcagtagaggggctgttaccgcaggatagtgagggcctggtgcctcctgatgagatattagcccactgaagcctgacctcggaagagtgggctctggctcactgagcatcggtcctcacccttccaaatcaggcttccaccatcacacttttcagattagttatctcccaggaatggatgcaaacactgattttctcagacctcatttcccaggaacaagttatgacctgggagaagctgggtctgtaaaactagcaacgaaagctaaaggtgaccctctcatcctttgaagtctaaaattatagaccatacaaatgagaccaattaagaaacaatgtgctttgcaggatttgatgcaatagatacatgttgaatgatgtctatttgccagtcctggtttcttaaccttcccccgcaaaaacctagcatgtgttgtgcacatagtaggcatcttcccttgctaatcatatagaagtgacaaactatgttgagaaggcaaaacatgaaaatagcagttgccacatgactgcaatttccttcagttcacttagaagggcagaattgtcttctgcaaccagaatccacttagccaagagtcatcagcaatgttcctcagaaaagtagtaccagtaaggaaataacctgcagtgtgaattccagaatgtctcttcctcctcaccctgtccatgctgtgtccctaccctctgtgccatcccagttctgcctgctgaagtgagaacatttcaaggcttctttgagcactgcctgtagccagagctatgtttctttgtaccagccccacgcccaaccagctaaatagtatctgctctgtcctcgaaaccctgccgaggggcttaatcaccatgcattttttgggttatttcttgctaagcttatatttagttatgagtaatcagtcttaccctcagcactagacaattagatgacataagactggcactgcattttgttgctgaatggactcactcgttctttgtatttttctgcggtccttttgtggggcccgatcatgtgttaggaattacacccggccctggggatgcccctgggaatgaaatggatggtctttgtagtcaccgagcttccttctctctagtgggagatgtcagcgattcaatacgcatttacattttggtgcaggtttctcagctttggtgctagtgatatttggggtcagataattatttgtcaagggagactgtcctgtgcaatgtagtacagctttcctaacctcagccataaagaccaaaactgtctctagacactgccaaatgtatcctgtggacaaaattaccaggttgagaattactgctctaacatgacaaatgcgaagataaatgtacgttctacaggaacccagatgaggggcatctaacaaagaccctaaagtcaaggaagtcataacagtcaagagcccagtgggaaatagatggcatcttcaactttgagcaactctaggcagcctgaataagacaatcccttacaagatgtgggcatggtgcagggagactatacagaggagacttataagcaaggtcagatatgtccaggggaaaggaggaggggtggtatatgaatgacacctattatttctatgtttgaaatctcacttataagaatgtttgtgttcatggttgatttgttggggctgcccgtctggctggtgagaaattcaatctgagtcatattttgggagactgtctttcctcactggagtatacagaatgctgagaaagggtctttagttattagtccttagtggtaggcttattgtgtaagagttcaaaaatgtttgttgagtgaaggaacaaaggaagtgagggaggacatgaaaaaaggaggtgaagaaggaaggaaggcaagaaggaaggaaagtaggaaggcaggcaggaaggaaggaaagtaggaaggcaggcaggaaggaaggaaaaaaggaaggcaggcaggcaggcaggctgaaagaaggaaggaaggaaggaaggaaggaagtgaggaagggagggagggagggcaggctggtggatcacagcttttagatccagcttcatcgtcacccagtgtgaggtgctgtcgctgactggaggtctgccttggagatcgtgggaaatgacaggtagtctgccactggtggggactccttcacaaacccaagctttggacctttcatcctcccccagcttggtgcccacccacctccgtgagcctagactctgtttgcttgtttctgtgaaacaaaagcttgaatagtaataatcttctgggtgcctagcaactgctttagaccccatgacacaaaagtcattaacaactctgaggcaagaagctaagaattgaggatttgcagggcctgccacatttttggggatggggcagggaaaatgtttctcattccttccattcttctacagctttgagaacagaacacaaatcagttatccaatagcctagcctgtcctgtgacaatggaggagcgtgacattgaacccagggagggagcaaagcggtttaggggaattgaaacctactctgtaccgcacagaaatccagtgagggcagagtttgaaaaactggtaatacagaggaagagagaaaacggggcacaaaaaacctagaaagttactgcgttgataacagtttttactgagacccataaggaactgcagcacattgatggaacacacacaaaaaaagtcttttgtttgtgcttttgttctccaccaatctacatgaggttctgatgggatggatggcccacaccttccacccagtaggaggcactcagacttttagggccctagatggaggccccacagcaggggcagcaacagagccgcacccctcacctagagctgtgcagagtcctggcatcccctcagtgctcctaaacaggaatggaatcgccagtcaagaaggtgctattttttatttttacctgttcatgtgttgactttttgggactgaaaaccccagagctgggtattttcttcaacacagaagccagaccagctgcataaaggactgatcccaggccttctagagtgttctgtgcctctgtggtctcaggaattcacctgctgtgtcctcccgtctgcgcccccacccccgccccagccctatacccttcctgcttccctcaccatctcgtcagtgtccttgctaattcgacaaagttaatacccgattaataactcctatgatagaagagttcctggatgagctgtagcccccatttacaatctgctggtgatagaaaaattatgttcagctcagtaataattgatggaaatggtctcttctcttctgcagctgatttgctttgtaattgagatttaataatgtaaatatcacttgttttcttctcaagatgaattgccttctgatttgctaagctcaagcctctttagggctttcttattgctttgtctcttctcatgagattctaggtgagatttattccttatttagctgtgtttctctttatacacacatacacacacccatgcacacacacacacattgagtcaatggttggaaggaacacatgttacttttcaaacagctactgactatcgaaaattagagctaacgctttttagaaatcatcaaaccccaccccattattttaactaatgacagaacaagaagcctagggtggttacgcaatttatccaaatggacacagaaagtcataatcactcctgagcctagtgtggtgttacttcctcaatggtgaggaaggtttgaaaagaatcaccctgcatcttactttctttactgccatgcatttataacacttgtgtgtctgtctgtgtatgtgcagaaagcaataaatatcacactgttttttacattaatttcgtgacttactctcaggatacgatattctataattgaaaaaaaaaaaccctctagagtccagtggaagtagagtaagctcactgcattggaacggtggctgcctctccatcatgactcattttctgcaggaggcccctctacgggcagccctaaaaatctgcagacaccaccgtcgaggcaccaggctccagcacccgccccatatggtttcctgtgcagcagcctcttccaaactacctgtttctatccacgatcctgcagtccaggcctgctctgttggagccctagtcaccttgcgttcctctttgtctttctccctcacagcgacattttctgccaagaagatggaggctccatgcttcctaaggcaacaaaaacaaaactgataaactaatttgggctggtgggaaacaatctaggaataggtcagatgcgtttatttgatcaaggcctggagtgtagtgatgaggaagcacatgaagacccagcaaggaaggcaggggtctgtctcccctggggcctgggcagggtgctttggaggacgaccagccctggctgcagccaccatgtcacatcacagcatgctcaaggctccatctcccagaaccagagccagcgcaggtttctggggcagaaacagaactcacacctccaaacttcacttcctagaagctccgagcccaaatcaaatgtcgagtgctgtccaaggattgggggagagtgcacagaatctctatcttctggtccagaaagaccctcatgaaaagagccaggaaagagcagtggctgagcgacctaagaaatgagctggccggatcccctcgttttgcagataaagaaaccgaggctggatgaagtaaagtggcctgctcaggggtcctggctagttagtggcagagcaaaggccgaaaccttggcctcctcagcttccatttggcacctctgaacctgttggtgctgagctgccgtagtcacagtccggttataacagttgatgtaaagctgaaagtttgggcatcatactggaattgtcttcactgtcctggcagcccctttcctggttgctctgtatctggttgggaaggattagcgaagtgagccatgtaactaagaagggatatttttagtaaaggcgaggaggacagaaagtaggtagaagcatcattttcctgcatttgaagtgtaccctcagacgcatgaaaatgggcctcaaatcatctaagtggatgattagttatacctatgagacattattccagtctacccatcaaggagagggaggaaagaacagctacttgtcaagatctacatgaatagaatcttagaaaggaaaggaaagaattaatttcccccattaacacaagacattacgttcagacacacatagtccttcataattgtcaaaacctctctttcctccccatcaccaagcagctaaagcacagtgacagatgagagctaccttgaaattgtcatggtgtctctatttttgtgtgtggactgtcaagacctcaaataaagccagtgtggcctgggccagctctgcagggaccttatgctcctttgtgggacagtgaccctgagctcctgggttggaactcagtccatcaatgccatgattatcagatttccagaacttaaggaattatttgggttccttagtcatagaccatattgctaggtgatgaaaggttataaaacattaaaatggatagtgaccttggaggtcatctgatgcaatttttgtattgacagaaaaaataattgtggtttgaagggctgaaaacacttactgaaaaatcacatatttgtgacaaaactgggattagatcctcggtcttctgatctcaaattcagtggtttcctccttgagttctactgttagcatgagtcacagaaggtcatataaagtgacttcttgggtgactaggctaagaagggaggctagcaagacagatgcctttggtgagaagtcagcttatcatagtctgaggtagatggtaagagggagacagacttgcctagaatagcacaaggtgcagatgaggagagcccttgccagctaagttttcaaagggacccctgcccctagtggagacttcgccccttgagtgcacagctcctgatcctttcctctcagtgcacactagggctcagtgcatgagcaatgctatctcctcgtgatacttcagagctcagacctttatgctctgcgaagtgtgcaggatgtctctggttgtggcttgcatgccaattgtgctgcctgggttagtgggtactttgcctacaagctaatacaagtattttgaaaatattgatgaatgctgatggttggcatcattgttaaacggctgtgatgccaggaactaatatagggaaaggataaaagagacagcatcaaataaaaggaaagaaagagaggaagtaagaagagtcaggctgcatcaaggcttcatctgcaggaactgagctgtgctgttcctcaaaagggcatttccccaataccctgaaaagaccctaggactatttctttcagtgctctgggccatcccaaccacttcagaaaggggcaggtctggtacttggtctgccaggactttgagccaagagcccttgagcccttgctggctttccttctcctgggggctgcagtgctgattccctctctggttggcttaggctccaaccagctgcaattgtctgtcttccagagaagagtatagctgatgagcctggagctctgggagaaagagagcacacagaatctttcttgaccatcagtccagcagagtcctacattggagcggccacaccctatttggtcctaagccactgcctctcttaagaaggttgagtgttgggcctgccccaggcacagagtaagatgtcaccagtagctaaggccctagggcctgacagcagacctttcagtaggctaggagtatgtcggccacctggtttatgatccagaccagtgtactttaaagaatgaaaggtgacagttaaaaagtacactgtcgaccgggtatggtggctcacgcctgtaattctgtcactttgggaggccaaggcaggtggattgactgagctcaggagttcgagaccagcctgggcaacatggtgaaaccctgtctctactaaaaaatacaaaaaaaaaaaaaaaattaactgggcatggtgcatgcacctgtagtcccaggtattcaggaggctgaggcaggagaattgcttgaacccaggatgtggaggttgcagtgagccaagattgcgccactgcactcctgtctgggcaagagagcgtgaaactctgtctcaaaagaaaacaaagtacattgggaagacaggtgtcaactggcactatcccaggaaaacctaactatgggtccacccagctcaggaaaacaacaaaggcattcctgacactgctatacgaataaattaatcctcagggaaaacaagtcagacgcagttggcattagaaggaaagttttaattcccccaaaggcaagcaaagggcaaaggacttactttgatgttgtaactaattgaaggttttgtatactgcccatctgctggcagatgccagccctgtaggtctgctttgggctcaagaagccactttgccaaagcgcccttaggtaacacagtattggcagtccactgaccacgccagggcacaagacactcctatactacaaaaatacagccttcttgaagaaactgggcctgggtgactggctgtgcttgagtaggttgctgcagacaaggttaaggcaactttctttagacattgtaaatgaaagaggcagtgtctccttccatgcattgatcaggtttctaaaaaaaatgctgtcgtttaattatgaaggtttttttttaaagcagtacttttacttctcagaactcatttcactttagcttgttgatactaaagtaaccctgttggtttagaatccaaataatcataatcataaggggaaaatgtgtaaaataaataaaaacttttcaagtgtacttaaacattttgtcaataacttagctgtttaagctctactatgtaaaaataatgatttttctccttctacccctgcattctttgggtctgaactgttagtttcagtttattttttatactttttagaataaaaatgctagcgactttttttggcccaaataggctactctgctcatcaaatggatttaagcttctatcctcagtcatttgtctgcctgtatggaattctagtgttttgcatcctcattctctctctctcttcctccctccctccctccctcctctgcctctctgtctagctcctctcttccttttctggcacacatactgcactttcatttaaagggaatgtgccacatcctcacaggtaccctggctgtttctgtgacactcactcagaaccactcccaatgagtcaacagtatcatccagatcctaaaaatgttgtgtcttgattcttcccacacataatgaacccatctcaaaaaaaaaaaaaaaaaaaaaaaaaaaagacacaagcagagccaagctaaacacacctcttcactgtgctttggaaagaagcctcttgtcttcatgctcttcgtttgactatctggggatctctagctgctggagactgacctggctatcaccaccctaccccaccacaagatttctttttcctgacccacctacaataaagctgctgctgttgacatcatgatggtatatttttcatagaagctgacagttgacaggagatctgagcacactgtaagatgtgcacatcctcatacactccttggctctgaatgacttctcagcagaggaagcctgggagcatacatgtgtaactggaacttggaaaatgaaagcaacaggagtcctcaacttaccaaccctgaattctcacccctgactgtacattagagtcccctgggaagttttagaggatgctggtgctgggacccctcaccccagaccatgttcaccatccataagcatgaacacaagagtctatttttaaagtgctccttgggtaagtctcatgaccccccagggatgagaacatctattttaggtgtatcctcttaaacctgatttcagagagtttccttgccatcccttcttctgcctccacctacaagacaaaaccctttaggtcctctcctctttaacttttcccggtaaagagttcaagagccccagtgtatgagagtttctctttggggacagttgtactggaggagtcacttgagtccttttgtctttgtgtcatcctcggctactcccggtctgacagtgaggggcattaaacacttccatcattctcacacatgcatggaagggaggatctagaaaactcacccctgccagggaattcctctgagcccccagctatggagatctttattaatgtactccttcccccactggaagcacagttaactttcacagtaacacattgatcttgtgattagccaacttactgtcagcctcagggaaggcagccagcatggccgccctggatgggggcaagccactcctcccgcagaggaggtcctggtggccacagcctgagaaaggtttctgagcccaaaacaaagagcttctgtcaccgccagcaagtgagacattgaccaggcgcttggcctccaaaccaaaatgactttagcacaattcaattgcttgtgttaattaaaggaaaatgaaacagtgggtttatcacacttttcattaactccaatgcagcaaaggtaacaaatctggaagttgggagcaggcaaggatgcaatgtactgctgtccacattccttggtttaattaaggagggcgggctcagagttgcttgttgccagtagggttctaaggagagtcaaggattggaggttggggcgggggacggagttggggacagaaaatgtggggcagagcctggcagaaagagagtggattaaataggagagggagagggggagttctgcagggattaagttttcaaacctagccatcaggcataatgtgaacacatactgtgggcttagcctacgttagctgctgtaatgagttaaggaagtagaagatgtgacatctactcagggtgcttgcaacttggacaatggactaggaagaagggtaaacagtacaagactcaggttatatgagccatactgggtcccaaatgctaaaactctaccgtaattccaaattcatgcatgtttctgatgtgtatccttcaaaagaagggggctctcacatcaggaggtatgtgatggagaaggatgccaggagatctctaggataaaaggagaagtcctattcataaccctcacaggtttctagagggcagctttcctccaccctgtccactctttgcctcccccatgggaggcgggtgaccaacgtcatggtgaagtggttgcttgggcatttattgggcctagttaagaagacataaggctgccatctagaagtgaaggcattactcctgtgtctccatcccctccctggcctgatacctgggtctggcgtcctccttaccccagactctgcattgcgacacagctcatactctcgggtccactttgagcctgtgactgagtactaaagtcaagcattctactgtgcaagtcccactgtctctaattctcagagagaaaggcaagaacctcatgtcagccttggatcccaagtggggattgtagcccagcggatgttttgatctgctcatagctcagttttgtgattatgttctattagccaaaatcctggagggaaagaaagatgagtgataggattcaggcacatgtctcctcaggaacttttgacagtctgtacctttccctgcacatatcaaggacaagaagcagtggggaggaggtggtttcagacagccttatctccttcctgtggtctatcttactccagatgtccatgacaggatgtccagcagatatttacaaacatggttcttcccttacagaagtaaaatctgtgttccttgacagcttgaattgtgacctagcttttgagagtgggtaaaaggcttgtttctaagatggttcaggcagcctagttgtggccttacaggccagaggcatgcacttggtcgtcaatcacctggacatttgattccaactttgcaaattcagtgttgatcaggatcgtctgtaatagtctctcttgctgggcagcagggaaactccttttcttgttttcccagaaacccaaccatgtgagccaaaaagacccctgggtggccaccctctgcccactcccactggcttccttctggcagctcatttccctcttgctttcttgctcctcccacttccccttccccacaccttgtcctccctgtgtggctgcctcctgaaaccctagatcctcctcactgctctcatctcctgttgttcttttccttggtggcacaagcccccagaaatgttgctctctgtgttacctcctggctggtctggtacatgctgcagcagttgctggcattttatctcagcgcagcttctgcaggtagagccatgccctagacagcaaacctagaaggacagtcagggtggagatgcttagaggtgacttttaatcattccaaatggagaaaccagatggggattgcctcaacaccaagttttttttgttttgttttgtttttgcatactgtgaatagaccaacaaagggacaggtcacctgtttagcctgttcttacgctgctaataaagacacacccgagactggggaatttataaagcaaagaggtttaatcgactcacagttccacatggctggggaagcctcacagtcatagtggaagagcaagggacatcttacatggcagcaggcaagaagcttgtgcaggggaactcccatttataaacccatcagatctcataagacttcttcactaccaagactacagtatgggggaactgcgcccatgattcaatcatttccacctggccctgcccttgacacgtggggataattacaattcaaggtgagatttgggtggggacactgccaaaccctatcttcacctcctaaaattgtccccagaggtattcagagagaagataagatattttgtcaggactttgtataatccaaaaaagtggaaggctaaaatctttgacccctcatggttcttttaactttataactctaaggaattggctgaggcaataaacaggaaaattggatgcaagaatgatggctgagatatcgctggcacaaaaggacataaagggagaaagaaaagagaagtcggtcaggaagcccccatattttgctctggatttcctgtttgatctttttcatccccaaatagttaggtttctctcagctctaataaatctgtttgactcactacaccttacttgaggcatctagaaatgacaaagaactaaaaaattgagcctaagatacagaaaaatataaactgctttgagtcctggccccatgagattgcagactatgcaaggtgaagatccttgttttccatattgtctctgcccccattccctcaccacagcgtctgacacaacacctcgctcatcctggatgtgagcagaataagtgcagtgaggtcagagccagcaggccagccagtggtccttctcccctgagttgtttttctgtctgttcctccatttctagcagaacagaccctgcttgtggatgtttcatgctctttgtattctgtgactgtgctgttggaatgtgtgtccctactgaaaaagcccccttagatccacagaaccctgaggcttctgctcatcctatccccaaggatgcaacctgcatctgaggcaacaacccccacatccccggatgaatggcctcatttgtatttttgcagatcttaattttgctaatgcagtgaattgaactcatcttctttgaggcactctttccatggaaacagcctcagtttttacatatttcttccagtgattcagaatctgctttctgttgcttccaaccttgttatattgggatgctggagtgcttagagcaggttcataatgcctctgggttattgtcttactacaggacattttgctataaagcaaaactgttgagcagacttgcagttcctgtttgacaaggaaaatattgcagtcttacagcctttttaaaaaagtccttggtgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgcagtcccagctacttgggaggctgaggcaggagaatggcgtgaacccgggaggcggagcttgcagtgagccgagatcccgccactgcactccagcctgggcgacagagcgaaactccgtctcaaaaaaaaaaaaaaaaaaacaaaaaagtccttggtgaacacatcttcagaatctttccaatggctcacaggccatcttgcttaccccacctctgtctttctttccttcctcctccctctccttcctatcctatcctgttcctccctcatctgtttctccctgcccgttttccttcctttaactcatagtcagcaatttggtttcctggcagctagtaaagaggattaaaacattgattgccttctgccccattatctgcagcatggaatcagaactttacattgcaaccagaactggagagggcagccctacagcttcctaggtctccaggcaagtagcaacctagattcattctgctttaaaaatttcacccagcattcaaagtagttaagaaaataacaggtaagtcaccttcactgagtctgagatggagagaagtttcaacaacattttccctttttcaacgaagaaacatgttttggtgaggatgcatgttatgtgggaagatcatgaagaatccatgcatcctgattctcagcctcagtgtagccagcctactgagccctaaactccaagaacagtgagtccttggaggggcaggctccacaagggtctcagcctgaggggctcttagtatattttcctaacacactgaccctagaagacttcacgtgtgtgggtgggagagagcccacgaacagcgcggcacagtgcatcacagcttcactgctcagggtgggggccccggcccagccatggaggcagcccctgggcatgtgtcagaaacgtggaatcccagactccactccagacctactggatcagaatctatatttaaaaaaaaaaaaaactctaaagaatttatatgcaaattaaaatctgagaagcacattgtacaaacttgacaaaactcattttctcacttaatgaggtagtattataacgatccccattttacatgaaatgcactttttcttccttccttccttccatttctgctgttgcataactggtcccataaaaacagcatcacagacagtgaaaacaaatcccacattccagaagttgccatgtcatctggtaattccactggaaggatgcaggacctgtcttacccatgtaaatgcacacgggcctccccattctgtgaaaccatcccctccctacgtgtaggtcaacatttctaagtctactggcattcatggatctcattttatctgaagcttttaaggcatctggctgaggtccaccaagcagcatgatctgggtctttcttctctctaaggaaaggggaacgttgaccctgcctgagactctagccaggccctcagcaggtagcccatgtgtttggttaaatgcaatgcaatttaattactcatggcaaaatcctctgtggtacattttgaaaaaataatggagtcatcgtagtagaaatccaggcttctcattctaccacatttatttctttcaggaaaaaaaaaaaaaatggcgaggtgtctggaacgtcattttgatgtgtttgattccattgttgtttaatccttaaaaaggcttagattgatcaactaatttttctttgttaaatttcatttaaaaagtaatctcagaatccctttcactatgatattctgttagcctatagagaaataaagggagtagggcaagaaagtgtttgcataaccgtaatgcaccttgaagagttagtgtatgaactagcctggatcattatgtctgctgtggtagaggcttttgatccagtagcaccatccagcaaatgccggcttaacccagacccaggtggcgcatgctctggagtttctttcttgaaattgtctaagttcccatctggtggctggaaccatcgggggtgagcagcatcattcaggagagacgctcagatcctaggctgggagcatgtgggtcactatttcagaccccatttcttcagtctggggatctttcaccctgcacccttcagccacttcttatgtgggtccacccagatttcccaatgactctgaacctcacatctatgggtacattttgggaccctgtcaccaggaccaggtttgaggagggtagccaggcaaatggattgctcccactagccaatgcattatttcctccatggaattgcacagattggactaacagaacggtgctgatttgcagtgacatttctataaatagatgattggtagccagtatccagagactgatggtactccctgggtgggcatgacctggggtaggacatggaggcagggaagacaacaagagccagaaagcacatggtctggggaaatgggtaggtgggtggtggaagcccccaaggcttagacttggagcagagtcagggcacctaagtacctgcctccttaccccctatacccaagcccacctccacagacccttactgctgcacaccttacacactacacactagcccacctcctccaccttcctgctgcacaccctacaccctgcacactggcccacctccacagacacctttctgctgcacaccctataccctggacaccagcccatctccacagacacattcctgctgcacaccctacaccctacacactgtccccaccttccaccttcctgctgcccaccctatacacttgcacaccatcccacctccacagacacgttcctgctccacatcctatgtcctacacactggcccaccccctccacagacaccttcctgcttcacatccatggtggacccaaacccattggattagaacatgcttgcacaaggttgtggcgaaagctcacacttttgttgccctgaaaactactgtggccctcaggactgcaggcctataagaaatgcaaatggctgtgccttatccttgggctttatcttggttttgatgggatctcagtgttttgacagaactcagaacatttgtgatggaagacagagggtctgttgtctttgcactgaaccacagggagtaagataaggggtaaggcggagaggccagattgttgcaagaacctgtaatggtggcataaaagcaatacaaattttgcagcccataatattttgaattataaatgacaagtttcacaagtacctgagaatgaatcctccagggagctccaccaaattgagtattaaatccactaggctattctggcaaccacagatccagcatttggggctatcacatttgtgttggccaatgcttattgagcatctattacaaagccatcgtggggtccttcctcgttcattcattctcactctatcttctccaacacaggtggaaacaaaaccaactactttgcatctatttatattaaagggtagaatgcttacttattcgttctacaagtagtagtttgtattctgcatacaaaaacatttctacaaatgaaaaattaagatgtgctccacagtaacataccctaaagttattccatagttttattatattattgatcatgacagttctttttaaaatatcagtttggcaatgcactgaagtatttatcatgtcatctctgagttaattatcacaataatcatataagaaaaataatgacatgttcttaccaaatgctctaagaaagttaagtgacttgactgaaaatacattgatgcaagactcaagcacagaatttctttcttcctttgccgtatcttttgagcaacatgatgccctatgtctttgacttgatgtcctactccattctgatggctttttctcttcctcctcctacaatctctagatgtgaatatggttctgtccctggttacacagtttcctgattgtttcctgtctgcttctttcttcccagaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactgtgagtggacctgcagccagggggttctggggaaaagacggcacagggagtaggtggacaatctggtaatggcagtgccattttccaaaggacccaggttcctgccaacaggaaaatacttcatcagatggctttgcccaccatggcctccgtgccatttgtccctggaatcttcctgtgactgccagagttttcagcaaatggagagaattgttaactgagaatgggtttggaggcctgaaaaagaggttggggtcaatgcagtatcttcaagcagcttatttttcctgaaataaatgattattttactgggaaagagggttgtcacaagaaatccatttacatagcaaatggctggatgtgcccttcatctctttcacgaaatcactctgtgtgtgcgtgcgtgcatgcctgtgcatgtgtgtgtgtgtgtttcccacagatcctccctatatctcaaaagccaagaacactggtgtttcagtcggtcagaagggcatcctgagctgtgaagcctctgcagtccccatggctgaattccagtggttcaaggaagaaaccaggtaccttttaaatgacacctggacagttctgaagcagagctgatggtctatccccacatgggagaaggatgaggatgaagaaaaggggaaagataaggcaaaacagaaatatactatgccctcttttgtaacaaagtctatttttacaacgagaaaaaaaatggaggaggctgggaagtggagaaaatgaactgaccatgattctgaatctgagactggttgtagacatgtcagtcgttgggaattagaagccagtacatttatcccattgggcaagagcatcatttcccttctcctcctgttggacactgaagtgcttagggtttgagtttgaaggacgagattagttggagaaaagagtttggtgaggaggagggcctctttgtagaatgaattgatagcaatgtcttccctcttgcaggttagccactggtctggatggaatgaggattgaaaacaaaggccgcatgtccactctgactttcttcaatgtttcagaaaaggattatgggaactatacttgtgtggccacgaacaagcttgggaacaccaatgccagcatcacattgtatggtgagtgctggaagcctggatgcagtgggctcagccacatggggaagcttgagggactcaggagggaggaagttgcaatctgcttggcctgtgtccatccatcctactcaacccaccacctgtagataagacatacttctccctgccattcccctagcatgccatgcagagatagttacacagtaattgatatttcatggtcattaaaaggcaaagtttgcccttacaatagcagtaaaccaaactgtgaatcaggtagaatggtttttgtataaagaagatagaaccatgggtcaattcaactgtgtaattttaagatgccttctgtagttggagtctctgattctgggggtgatatttgttgctttaaaccaagtcacctgcttccatcatgattctcatgttgcttgcatttcgtattctcatccatggggaagaatggagtagtagtctgagaccttatcaggtggctgctctatccacaactggagcagcaaaccctctctgaagatctttccctcccatatgggtggagaaggcttgggagccaggactgacctcctttaaagcccctatgtctccctaactccattttcccacactgccgcatccatatccttctgcaacatttcacaccatgggccagggccagcttgttgtgatactgtatgtgcatatgtatttgtttatttgctgaggtttgattagagggaagcatccgatgagtaggatgagaggatgaaggatgaagagaggtatccacgtttccacgtgcacctcagacacaagctttcagcactgacattaagtaaactttgtccaccaaccatctgaaatgtgtgatctatgtcttttgttttctctctgcattgtgtgtgcattgtgctgtgtgtgtcttagaaataagcccctcatcagcagtggcaggtgggtacagcatgttccttcctacctctgcctgcctgaatgcctatgcctttgagttttagcctacttcaaagataggcttgcctgcttcacctctgtaatttatgtctctgaggtagatagacctcaaggggcttggtttacacagtttagataataagcatgtagaatatgatggctttcaaatgcactctgtggaatagctttatgtgtttcaggggaaggggtttttgcccccaaaacaagaaccttatatttggtcatctttgaaaagaatgctcattctgctatttctgtacacagcagcaccaagagcaacccagcccagagaccaactggattaatagataactgtctcagtggggacgtcaccctactatgaatgttttattcttttagcccaaggcaaacagggctaatggtttagttctaaaaactttattttaaaataaaagtacttgggatcattattataatcataatatctgctatttaccaaacgtgtactggtttctaggcatcatgtcagggctgtgcaaggcaggttattaaccccattttacaggtaagtgaaaggaggactaaagagcttgggtaacactgaagaccacttagctaatgaatagatactggatgagacctagagatggagccctgtattaggtattggagcatttgcccacagcgtcagcaaagagaaacaggcacacacatgcatgcactcacacacactcttacacagtcgctgaggcatttagaagaagcagtagctgctgctcagctctgcttccagaactggaagaccctcaaccctactgttctaagatgtcaatctcattcacatgcaaagagatgacatttgaattttctagacctgaaatcagctcctcaactatcactgctcacagctcttgatccaagacactcacagatgtatagtgctgcccgcatcccagtgaccaggaacacccatgccttagtcttaaaaacactgagaggatagggtgggattgagtcacttccctgccacaacctgccattatccccatggttggtgggattgctgttgcagggagtatgatgcagagaagggcacaggactgacaacccaatggcccttcttgtctctctctgcccttcactaagaaagaggtgtgtcatggcagataacaacaaccagtgtataccaaaactgtcttagttggcttgtgttgctgtaacaaaatactaccgatgggatagcttaaacaacagacatttattatctcaaagtcctggaggctagaaagtccaagatgcaggtttctgccaaggtggttcctgtgagggctcacctcatggcttgcagacagctgctatgtcctcacatggtttctcctctgaattctcatagaaaaagagagagagggagctttctggtgtctcttctgataaggacagtaactatattggatcagggtcccacccttatgacctcacttaaccttaattacttccctataggtgccacctccaaatacagacatactgggggttagagcatcaacatagacattcggtagtagagggatgcgattcagcccatagcacaggcagacatttacatcccaattcagccttcacatcccaattcacttaaacttgctgagtcttccttcccgcatatatgctattgggacattaacgcctgcttcaagagactggtgacaggattaaatcaggttgtgtccattcagaatcccataaatgctacatttagatgtgtggattcgaccacaaacaaaaaccacaggcctgagtccactcggctaagtagggtgatattttctgacctgtggacatgagagtgtcactgtgaattgtcaataagacaatgttcatcaaagcggcatgactcactgaatactgtcgtgtttctactggtacccgccaacacttattgtgacatggcccatgctatcgcctcttccccccatatgcctgccagagtcactgctcaactggacttcttttccttcctccaaagtcccctgtgcccttcctctccagcattcacggtccctataacccaccctatctcacttcaccctgttggcacacacttgcattcagcatcccttcctgaaggaagactttcctgacctctctgagcaggccagtccccaattctgcatccactcattccgcgcctttgactgctgcactcacacagagcattgtctagcattcatttagcaaacatgcatttaggacccgttacaagccaggcactgttctatgtgatcaggagacagcagtgactcaacagatagattccttgtttctatagactttatcttctagttgtaattttgtttttgtttaatatttcaaaagttgtttgtttaaagtatttcttcctctttatcctgtaagctccaggaacataggggctatacctggcttaatccctaggacctaatacaaggttctacacacagtagctcacaggaaaactttgtggaatgaatgaatgtgtgaatatatgtggggatggaaaggacgtattggtcacagccacaatttagctgtcaggaattgaaatgccatggcatagaggaaggggtatgtgtctcaccctatgctgctcgctggctgaatggctttgggaaggtcaatctcagtgggtcttttatatttttaatcagtgaaggcattttggataagatgtttggtttctgtggtccctacaaggcacaattctctgatcctatgactgtgtggcaatagtttcagcacaagatcagacagatagtgtctggttgacctgctctttctcctggccagggatgctcttcctagtcctcaatgcccccataattatgcctaattattaccaaccatttactgtgtacagggtactagactaagtgcttttccttttttatcacccttagtgactctatgaagtaagtactatatttatcctgattttacacttgaggaaattgagaggttaggcagataactcaaaacaccctggcttatcagtgcttgtgctgggatttgaggctatatactcccattcccatgctggagcactttgctcctattgcaatccagctcataagacctggcaacccatcatggacatggtgactttccaaatggagcctcatatcagcaattagtcttcttggacccatctcccacatcaaattctcctttcttctatctacttctgaagccattcttgtaaaggacaatttttagatttgcaacccgtatgctcctacttccccaacacacagtccccatctgcaggcatgcatttgtatttactctcacagacggtcagtctgttttctgagagccctctttgactctgccccgtgatcccttcacagcgtgcctctctcacactacatcttttatatatttcatacctacaagcaaagagcaaaggaaaatgggatataagcaattttgaaagaatgcagagggcaaaaactggagacaatgggttggtgagtggttggaaacctgaaatgactagaaacgtgtgagtgacaacatggtaggtgatcgtccaagatgaaacagctgttggcactgatatgaaatgcttcttctttatcacaccggttgccttccccacacagagccacaaggacagagtggtcagctaggcagagcgccaactcacagccatattttagaccacccactttccttagccccaggcaactgcaggtgctggaaaagtggcccgatgtggaaaggcggtcaacgccagcagcaaggaacacggggttccagtcctgactctgatacagacaaactgtgatgctgtctgttcctaagtcatgcgtaaaacagaaaagcagagcaagatgaactccaaggttactttcagctttctaagtgtctgggctgaatttgggaaacaatgggaacaaaaggcaaggaacaggtctccaaaagctatcaaccataaccatggacaatctttgcacagtagcttgctccaaccattgcaaatcagcttgctctaagcattcgttagctttactgagtgggtgcagccattggaaggtccacagggagccccttggcacctcgaagtcttgccaggcctaagtacagcaggggtggctgggtttcagcttgctgaccacagctctgtcccttgtggaggtgactcactttctctcagttcgccaaccccctttgtcccctctgggccttgagcaagaagccccatccccccatcctgtccttagtgtgcagagaaggaagattctggacttgattacatctggcactgcagagagtgcgacgtgcttaatgaggcatgtaaacgcctggatgactggaactggcaggggaaggggagagagaacgcaaacaaagccaagacggaggggggagactgcagagagaaaaacaaatttctcacattttatctgtgaaattgcagcgacacaaatcagttacattaagagttaagtgtagggcgcagggacaactcataggaatcctgtcatcgcaagtgaaaaaggaaaacgctccagttaagtcaacatctgtgcacagagtttcttcctcaggccaagcctgagccctcttggagcagctgtgactccagcctgcctcgcggctcctgggagccatgagggcgtaatctctattttcttttgctaatggccattcttctagaataaatatacatatcagactggctctctgagccggacttccttctgccagagcctgcaccaggcagcggctctcatctgccctttgctgacctccttctcatgggaaaccatcccacccatgggcagagccctcatcgccgctgccttatcccccacctccctcctcttccccctccatcttctcgttccatgtctgtattagggcgtcttcacaactacacctatccccaggtggctctagctgggacatggagagggggcacaaagactgagcttctcttcagtgcgacctccatgcctcacccgtgccttttcttccctccagccacaggcctctgggagggagaattcgcattgtatctgcctttctcaaacctacttatgcctcagctaccacgatctgtctccctctaacacccgacctcgtctcagtgccagagcccctctcaccccacaatgccccacttctggcttatgtgatataaccgggtggtgactgtctccttaccttcctcagtctgcttctagctcctccggcacctgccctatcagtcttcccgggggtcagcctatggtgagaggggaagggctcttctgtaccttcaggcacccagtggtgaggtatttgttggcctgcattagccttattccggatgctttaaaaatgcagatatgtgagccttgccccagaatcatttaatcgaaatctctagggaaggtcctgagaatgtactttttaagaagctctcccagggaatcctatgcacactgaagattgatggcctctgaacaacagcctgataattcctgaatttgtgtctttagttctctcctgaattctgagctacaagccactctctctccctgaatattccgcaggggtctcaaaggcagcccttctccgctgggaacgctcggggcatgcctcgctcttcccctgcacactctctagaatctctggtcatttttgacttcctcctctccctcactcctcacatctgttagccatcaagtcccaccaaatggcctttcctctgacttctccatctccattatcactcacattgtggcacacgtctcacatggacaattgtgatatcctctcactggttccctcatctttcttcggcaatccaactcctgtcggtttgccacagcagggccaagtgacatttccaaaactcagaatgaaccttgtcatttcgattgctgaaaacttctgcctcccagaacagcttggcattaaggctgttctcgctgtgagatcagcgtagccttatagcttcaagtgtccccagcactccacctgcaaccttccctgcatccaccaggctgggccccctgtgtcccagatcccgttacacatcatgctgttgccactctccatccatccatccatccatccatccatccatccatccatccatccctccatccattcatctagtcaacaaatatttgtttagtgcctactgtatgccaggaattatactaaggactaaagtaccaggagaaacagaatttctgatcttgcacaaacaagtaaatagacagttacaataaaatataggaagtgccatgcttgaggaatgaagaagctgccagctatcgagtgtcagccacacatggctttagacacataagaacactttgagattgatattgttatcatttttcattggacagaagaagagcctagagctcaaagaacaaatgatgttactgaattcccccaggtaggagggattccaccatggatggaaggggcaagggacagcagcaggttttgtacctaggtctgtctgatcttaatcccctgtttctttcaaacccatatactgtgtctcccagtgtgctggagggtctcagaggcaggcttgtgccctcttctctgcctgatgagtgcatactttctggactctgctcaatgatgccccatatgtaaagcatttgtgagctccgctgaagaatcaatccctcatcttttgggctctcatggtagattacccctatgcttatattttgtttgtgtcattttctgcacttagaagatgtaacactatatcttccagtgagcgttgcccagtaactgtttgttgaattaataaatatatcttccagccaatgagggcatcagttatagcctctatacagtttcatacctttcactaaccaaagaaaagccaaatacccaagaggacttgtagtcccctcccctcagggaagccaaatgactatttttctgactttcccttgcgttctggcctcctgtatgttccaaatctaatttaaaatttagggacccccatcccagatctcccttttgaaggaggctataccacatattccaattctctgtttaggaagacgttcatcacatgatatcttcttgcagagacatcaaaagctgcacatatttgtccatttcctgctgataacgtgtatgatttttatttttcaactccacaatttaaatccaggtgggaagggaatgagtcagagagaaacaccattgcttttggctgatgacagcagcgtaatcatttgtattttcccccaacctgcaaaatgtcaacatagtagaaaaaaactgcagacatttcccatttcattcttgatgaggttccttgtggtttgctcgtaccccgccctcctcgctctgaatcattgacatctggctattagcctgagcatttagaatttaacattgagcgttcagggtgtgctgatgtcagcacagacacagagcttatggttcaacaaagactcaagtcttgtctcttccaggtttgtgatgagctgacggatttgaattaacttctgatattaacttcttaagcttttgtttttgtagtaagcacaaaacagggtgtgttaaggagaacagaagaaagatggttgcctctttatcgactggtttcagttgtgctgcagagcctcgttggttgatcttacttgtgaaacaacacagcgccacgtttgccgctgtaattaaactcaatggaggaaaagttccctttgaagggaagtgatgtgccttcatcagccagcacctctaaaaatagctttatgtttcaccaacaagtgtaacacatacatcatctaattagatttctttgctcctcttttaatcaccaagaacatcattatcctcttggttcctcattaggaaggtcacacagttcataatcatacttacaaaacctatccagatttcagaacaaaaccgtatcttcttagacttcagatatttcattaatctcactgtgctgtcaacaagctcaacttgcctaggggctttttttttcttttcttttttagtgtggtcaccctaccatctgccattttagtagaatttcagctatatagtttatggttgctggagatcgatgtcatattttcattgtaatcatggaaaggaaaaccagtgacacattccaataccttcatggcttgttatatacactacatttttaagcctcaaaatctctcatgaggcaggatctcagcaggaagcttctatatttttttctgagagctctgtgctgagtttgggtactgtgattgtcaacacctgccactcaagagggtggtgagccacccctgaatgcagcagcaaaagcttagtgccaggatggccaggcttgaaattccccgttcttatgtggtaggtgtggctttattctgttttaagccttcaaccaaattttcttctaaaaaatctaatgtttaggccaggcgtggtggctcatgcctgtaattccagcattttgggaggccgaggcgagtgggtcacttgaggctagcagttcaagaccagccttggcaacatggtgaaaccccatctctacaaaaatacaaaaattagccagacatggtggtgcatgcccataatccctgctacttgggaggctgaggcaggagaatcacttgaacctgaaaggcagattcagccgagatcgtgccactgcgctccagcctgggtgacagagtgagactcggtctctaaaaaaaaagtaatggcaaaaaccatgatgacttttgcacaaacctagcaatttaccaagacacgtagcctctcaaaagtagaatttttatttgttcatttttgttgttgttgttgctatgtgtcttacccctgctgagcttcccttgtagctgcatggacctgctctggccataatgtccacacaaatggatccctttgtcatttctgaaacttgtctcttaaccatatctggtctctaactattctttctatattctaaaggaaatcttatttgtctgtatacctgtccccaaagtattttgttgttgtcactgtgttgtcactcagtttattttgtggctttgcatcttcatttcagcttatatttttaaagatgcttaacttcaggcatgaagaagccattaatttttaacattaaaaagggtgaaggaggaggtgctggaataatggtaaagggcataattacatgttctcactttccatttatccctgaaaatatttaattaagcctgatatttgtagcagccattctagttcaattgaattattgctaaccataaatagagaaagagtccttaaatgtggcatttgcccacagaaagtactgggctactgaatacgcttcctcagaatagctgccattcattaggaagattttacctgtggttagcagccacttcaggcctttccagaagggagaaggtcacccaattaccagccagagccaagcttgctttcagctggtgttggagagtaacctttgagaacctagtattctagaacacctctttctttaaaagcagaacccccacacaagatgctgttttatggattagcaattcttgccttagttccaactcacctaatatttcatcatcctttactctgtacttgatgattgcacacaccatcttaactcattctcagagcaatcctgcaagggtagatagaactactccttccacattttatacataaaataaactgtttcagagtagtcggcggtcttgtccaaagtcttcctgctattggatagcagagccagaattcaaattcagttctgactcttaaaatcaatgctcttaagactatccaacaggcaggatgttcctgagatgaaagggatttagggttatttgttccaaatggctttcttcccagaatctctgatggtttaaaaaaaatatttgtctgtttatttgtttatttatttaatcaaggacagaggataagctagctcctcctgaagtttgtgctttttgaaggtatggactgtttctgtctttctttgtgaaagcagagcctagtgcatggcagggatcaattcacatatgttgaatgaacgacttcaacatttcccaaggttggcttggggcccgtctccattgcaggatggacacattaccctttgacctagccaggaagcttggctgtggctggctcccagtgccctgctcaatgccccacatcctccagagccctcacagccagtggtctctctcagctgcaatcttaagctatctcacctctttactcactcccttaccaatacctcaccccaggttcaacatattttggaactatctaaacaagctagtattagtctccactaagaaagggacagggaggtgtgcaggtcctgttccaacagcagttgccatgatcacatgactactttgtaccaggcactctactgattacgttcatccttcaatcagtcctgcaaactcagcatcatcatgcctgttttcagtgagaaaacaggaagtatcttgcctaagatcacagagctggcaacccacagggtcagaatttaaatccaaatgggtccaactccaacattgccagattgcggtcagcgaccttaccccgggggagcgtagagagcatttcctgaggtccctagggatgttttctcagttatgcttccaggaagtctgctccttcgcctttcttccaaacccgtgggcttttatccgggtgcattttagcatcagttttctggaatagaatatgtcattaaaaatctgcctctcagccgggcatggtggcttacacctgtaatccccacactttgggaggctgaggtgggcagatcacgaggtcaggagttcgagaacatcctggctaacgtggtgaaaccccgtctctactaaaaatacaaaaaattagctgggcatggtggcaggcgtctgtagtcccagctacttgggaggatgaggcaggagaacggcgtgaacccaggaggtggagcttgcagtgagccgagatcacgccactgcactccagcctgggcgacagagcgagactccatctaaaaaaaaaaaaaactgcctctagtattctaggttttagagaagaatcacctttcttccaatttttaccaataaatgaataaatacaaacatctgggtttctgaccctatatattgaaattcaaaattgtatcatcttgggtaccaagtacctggagaagtccatgcagctgttaccagccgaggccatgctctaagaaaactgtactcaatctgactctgaagccatgtatgcaagcttcagtgctaccactgctgagctcagcctgaatagttccttcaaaaccatgtcctcccctgtcacacaggtggctctgtagctttgttgagctaacatttacaaaagcctcatggtaacccatgggaccaaacgtgagccccgaggccatgggaccacaccaaattacttaaattgcagcaacccatcacttttatattaaagcagaaaagcatttggccaagttaggtgagcaactgtagcatacagcagcctagtgggagagaactaacccagaaactttcttttcctcatttccagttacacagggctactgcaaagatgcaattaaagaatgagttcattgcccatggcttttgtctcacactcttcaagtctagagagtgtacatagatgtaccagctccaaacacagctggagagccctccggcagagccctcaccgcattggcatttggcccagctgacaagtctcaaatgtgcccaggatctgtatgaggaaagtgatgctagcttcactgtgtatcgtagtggattaaattcattctctggccacaatagcccagccatttctcatacaccaattgaccaaaggcactttggcagtaaattgctatggcatttgatacgacaaagcaggtgctcatcatagctgctgaagaataaaactccctgaagccacatagaaaatggggctgcaaaagggaaactttagggactagagtgttcggtgccctcttgctgtctcaggggagatggaattctgaagtgcaaaaggcacgtgttgacggttttctttcaactgaagaaggctgtctggctactcaccaactatctctcctaacacctggatgcagaatttccattcatgtaataactcagagagctaatagaagaaggacctcacaggtcatcaaaccccatctcttctcaatttgcaatgcgagaagcaaagcccggagagggaacgtcactcagctagggtgcagcacattcatacagagacactgcattcccagtccattgtttctctcacaccatgatactgtggtccctggaaaacctgcacaaatggtcattttctacagagaggaagtagacttgtaacaattaagggcatagattctgaggacagtgacttggttctaatccagctcaaggtgcataagttgcgtggccatagctaagatgtctaactgctctgttcccagttttcctgtttacaaagtgggaatgacagtagcacatagctcatagggttgatgtgatgattaaatgactgattatatgtttagcatttagaatcgtgcttgccacgtggagagcacggtgtgaacgtgtgttgtcatcattgccctaagcaggctgagcagcctacatacctgctaagtctccctttcatttccactcttgagaatgctcaacagaagctgaatatgactgtaaacctccacccagtaagcaccaagcatccgatggcaactgctgctcaccaccagaaacactcatttccttttactattctgcctccttctctctctgagccccactcttccatggtctgttttctgtgtatattgccccactcctctttgctttagctatattcaaccttgggccgatggcatggtatccacaggaatgtttcagttcactggtagaacttgggatagaatgactcctatactcaagagttctgtctagagtggagcatatcagggcttcaattgtttcttaagctcaaaataataattagacaaagacatatatatatacgtatatacatatacacatacaaaactagtctagtatatatgccatatatgtcatgaaaatactttttaagaaaaatatatacaaaaagataattttaaagaaacatatgggccttatgaatctgcccatatgtttctttaaaagtagctttatgtacatatttttatttaaaaatgtaaataaacttatttaaaaacctaaatcactcatctttcaaagacaatatgtagagaattaccttgagcttcaacctgagcatttctagctcagtgcattctgcaggccagtatgatttctcaggatgtgtgccaggactgctggaggccccacagtcaggctactttccatcaatatctatggagcctcctctgggacattaacatgtcgctacaacctggattccgcccttttttgtgaatattctctgacaaaaatgcaggctaatatgagtcagacttcaagctatcaagtaaatatgacttttagtccataaaagcatgtatattttaagtagaaagaaaaggtattcatgttaagattagtggagaggaacagttgtatactcattgctgaagtgagagacgtgactttcccaaagtaaaatgttcccatcagtccctcctgggcaaggcatgaatcctcaccataaggttgacaggcaagccaaatgaactagtcctgtctaaagaggttctgctgcacctcagcttatttccagtaggccaatttgcttctcaaagaagctgtgaagtcctggcttgagatggtagaagaggtgtactgtctcctttgaatctcctttgcttcttcactagttttatagaaatgcctcgtaatggcttttaatcccttggtaataatagattttgctttttctgggatacacttgctgctggctcctagtcttgcgtaccaccctatgtgcttgctgataaaggtgatggaggaacacctggtccaagttagatacacctgcccttgaagcaggctaggataataccaattcatgtgatttgtcttcttgagccatggaaggtgaggggaaaagaacagcactcatgatactgtggacttatttcccggtggaccttgaatgatttattggggatacaggaaggggccagagagagagagagagagaagctagaaaaaaatcaagggagagccccttgggtggaatcttcaggggcagtctgttttgggcatgttgatctgcttcaaggcctttagggaggcagcactgactgctgggacaagcctaattccagcctttaaaacccatggggatgattgttcctccttccttagctgctgcaggaggagcctccacaacacctaggttgcatgcattgaggttgacaagtctgctacatcaacacttggacttatgtctccatccgtctccccttcctaccccaccatctgctccttgcctctctggccttgtgccccccgactcatcattgtctgtactggacactctccaagtatagcacacagttagaggcactgattagaaaacagccagcaggtctgcctttccatgtgttgccttaacctttgggcccacgggcctcaatgactagcctgagcttcacctatttactttttaagcatagtctttcagagcaggctgcattggtcaaggcatcccaacagcttgcccctttgagttcctaaatactcccaatgggctttttcctttgtttagacttggaatggtcagcggaagggtggaaggtgggaagcatgtatgtgtatttgcttgtcagggaagaactatggtgtccttgggtgtatgctaatgggtctgtctctctctcccctacacagggcctggagcagtcattgatggtgtaaactcggcctccagagcactggcttgtctctggctatcagggaccctcttagcccacttcttcatcaagttttgataagaaatcctaggtcctctgagcaacgcctgcttctccatatcacagactttaatctacactgcggagagcaaaccagcttgggcttctttttgtttttttctgttattctagatttgttttctttttgtttttgtttatttgtttgtttgcttttatttccagcttgaatgagtggggttgggggcggggtgggcagggttctaccacgtgtaggataatcattcattggtgtgtccaaaaatggggtctgctcctgctaccttgacccttccctttcctctgcttctctcctcatcatcattcccaacaacatcctctgccacacacaacaaaacgtaagtttcatttgggcaaaaattgagcctcacaataaacaccctgaagacacaacttgacttataacatagtgcacagcaagagctacatccaagtgtcctattatctgtgattattttcttaatgacaatgtacatatgcccccatccatgttaattattatctaattccattagggttcacgtcttttctttctgggacactatcctactatatccatatctatagatttcaatatagatgattgtgccatcttctgtagcccctccgctctactcattccttccaccatctgcagagatttgaagtttggggctatgcatgaaacccaacactaaattttgcaagtcaagtaaccaaaaaagggggaggcattttgaagatagaacctctattttaaaaagagaagttcaactcataaacgtgattgataggtggctgatttatttaggttttgtcaagctatctatcaaagtaatggtacagttacccatctactcaaatatctgatttatctcaccatccaattatctacccacctgtcttcctctctagcaatctatttactgtttatcaatctatcaatgtaattgtctaacactcctttctattctctccctactactcactatcaattcatccccatatgaatctctaaccatattgtatctctcccactgtattcatttatacaccatcagcagacattggcatcttcaaaattatctttcaacttctgtgaaagccaacgatctcacaggttaacaaaatacaaaagcaataccctgtgttgtggactctttaaaatctggtatcctatccacccaagggagacactaacagataggccaaagtagcaagctaatgatcagtcactcactattcccagaagagcctgtgttttctaaaacactttcttgggaagcagatcagcctagaaaagttttgattagcactgtggttttccttttgcacttgaaggacaaaggtgccagcctttatgcttctctcaacccttcaagaaagtacatgtcaggaacctatggctggctttccttagcagcaagaacttgagagaaaaacacatctgtctctgcaatgcaaagtgaagagtccacccgcctgagtgggatgacttcagctagagtctcctttctgctccagttctggtttaatctgtttgaaaactatccagtaaaaagctgatggaggccaattacatggcgggtgtattgacaactctggtatttgtttcaggaagctcttctaagctgagggcacttgagcaactgacttaattttcaagcacttgattaacacaacactgcaaacagaagggagaaagtgtcagtgacacagtttcctctgatgcagctgcttctccaatggctttggggaagaacttcaccagctcttcaggttcaaagcagacccagcatacaaacaagagctgagccacctttgctgtcttgtctcctgggacgagaaggactcatccagcaaagttgcctgggattcaaaataaaggcattgcagaccgcacaggtgtgctgcagggactgatccacagagaggatgagaatgcagcatcaatcgcagacctgccctgcctcagttggaaaaccttttcaggccctcagtctaaaaaataaaaaatatgagcaccattgaattctgtgcccttaatgcttaactggtcttcttcctctggtatcagtgtcctctttgtttttgtccatcaaggcacatgagtgtgacctctgccatggggaaacacacacagagatatctatacatatatacatacatacaaacataggctatcttggcacactaaatgctaagcactgtcttaagaggtagagctggtgtgagtgaaattaatgttacattttccagctgtaaacagacatctgcatttcctagtgagctgccaggagccagattcgggaaccgtaactgatgtgccaggaatggtgcattgattcccagttccagggatgatcatgagcaggcgcaaaatcagaattaaaggtcgcacatagacgtttc

SEQ ID NO: 16330 - DNA, 52203 bp, Human
ttctgagctatccatagaggtgatcaagatagaaatgtgtgccatcttctattcattccactgtcatcaactacatgtactcatcaaaccatgccagttctacctccttaataactgtagcttaacacctgaataactgaacaaaaacttacaatttaactctcttaacacttatctacctcaattttatttttataatttatacataatctataattatttttatataattggcacagtgataattccagataaaactcactgaatttctatttccatccttgccaatgatacacacacacaatgtaatgctgagagggttgggaaggaagaatgggagaaaggcagaagttgacagttaaaaaaaaaaagtttccagatggttttcttagtgtcatctctgcaacctcatcaaataagggtccaaaatttatgttacaacatttgtttgatgccttatttaaattgctttactggacattttccatctgttaagctctctgaaagaaacaaaattgccttgtcatagctagacctcatgatcctatacacttacaacgggcagactttgcaggggcccacacctttcaaggtggtttgggaaaatgacacagaaaagttttacatcagctgaaaagaaaaatgcataactcattttggtaatttcagttttaattcttaataggataaaggaaacatgcacattataaatcaatgctctgtgttaacaaataatcaagtaagcagagttgcaagtattggctaaaatgaattttggatatttttagctaccaaatttctcgaggcaaggcagacatacatctggacctgaatatctgcattattagggaatttttgtttgtttgttttatattgttttgttatttttaaaagtaggtgccaaattaggtcacctgctgtctgggcaatgttattttttgccataaccacaaattgaagaaaattgactgctctttttccttagtcaacatgctgtgcttccagccccaaacatctttgagaagttgtttagattcatgagcaatgcctctgtccccaacaggctaagacattaggcaggtccctgcacctctggagtcctcagttccctgcaaagtgaggaagctagactaagtaatcgttaggctcccttccagaccgaccaatctgatggtattagatgcaattgctcctgaattagggcatgaaatgaattcagctttggtgcaccaatgtgatgactctgcttcatcaaagcctgagcacgcgataggcctagcaccatctcacacagagacaaagggcaaccctctgcttccaaaggaatgacacaacctgtttctgaagtgattcacatcatctttacttttgaacaacccaatgctcagaaaacaatctaagaatcttcgctgactttagggatgtaagatacggtttcttgacagtatttgggattgtggaaaaaagcaattgaggaaagggcatctccacaacgcaatattgaatttagtgcccaaggtccatcacaggaatccctaacgatccctacaatctctctctctctcttttttttctctctttaccctgaaaataaactgagaagttagtattgggataactattccccttgacccaaataaaaagtcctgggcaaacacaggtacaaattgccaaatggaaaaagttcttctccatcttcagctagagggaggctggggatcccagctctttagaagccggcccgtggacgcccagagaatcccttcggagaccaggtcagggtcactgagcttgcccagcagggcgccgcctcggacgccgccccgcctctcaccttgccagcgccgcgctcgggccgcgaaggtgcgtgcggcgctcggtgattggcggcggcccggagctgcccggctgccattggctgcccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaaggtaggggggcgctcgtggcgggcggcggctgcttcacctgcgcgggtcgcgcggcgcgcggcggccggaggtgccgaggtgggtggggctcgcgggccccccggtgtgagcccggctctgggtctgcggtgccccgggcccagggacctggccccctgggtagaggaggtgctcggcggccccgccagctccccacactcgggagcgacagaattggaagcgcgagcgagggcgggcgcgggactcttctctccagtctcacggaatcccagtggttgtaggtgttggaaactttacttaagatgtttcagctctgcctgtgcctcctcaaaaggaaaggacgagcttagggcgagtgcgggcgagaccgtgacacttcctggctcaggaagttgaatttcattaagcctttgtggtttggggctctgctgtgctttgacagctctgatctcctcccttccggctgggctgtctggggcgctctaaaatgagtgttgatttaatgcactgccttcgcacccgtgctggtgataacttctaatgtgatttttttttcggtcattcattacttgtctaccgaccgaggcagtgcctccctcttagggaattatctgtcaaagagcgcattctccttgtttggcaggtagtcccaaagggcggttgtcaccagcgtctcagcgcagggagacattttcagcttggctgctgcctcgcaggcactggaaccgacggccctacctgagccactcccgggttatgcggagcctggtgtcgcctgggagaaaagggtggggaccagactatgactcagaaggaatgctgatgtcacattcgagtgaattgccctgtgcgaaagttctcctcgttccaggggatttgctcatgttttactttgtggtaaatttaagctagctgtcccttatcaaatagagaagttttgcagagagaggaagggaaaaatacagaaaacagtttttgtttttctcatactcatggttcctaatattttatcttctaaacacaaagtttttgacttgagcattaattctattttatgcccagaactggatttttgaaaatggatacaaaatattgtgttaggactgcagagttttcggttaggaagctattgaccaataaaaactcgaaatgagaaaacagtttttttcattccttgcgactaaaattctcaggcactcaaaaaggtatccaagaacagaaaaacataaattgttaatggtagcgtgattgcattctattctcttcccatttggtttctttctttttttcttttaaataactgtaatatttttggttaatcttgcttgtcatgggggaaaagcggggaaagcattttgcccgcttagctttctgttgatgaatactactctcatttagttttcaagtaggtaagagctacttaatttagtacttgtctaaaacttggggggtcttgtccttgcttttaagtatttatttgaagacaactttgcaaaagtaaacatattttgggctgccgaggatgaacaggtgaagcacaggatttttagggtaatgacactattctgtatgatactataaaatggctgatacatgtaattatacattaatcaaaatccatagaatgtagaacaccaagagtaaaccctaatgtaaactatgtatgttggggataatgatgtgtcaatgtgtttcatcacttgtaacaaatgtactgcactgatacgggttgttggtagtccgggaggctgctggagacaggaaggcatgggggaggtacatgggaacttcgaattttctgctcaattttgctgtgaagctaaaaaatgctttaaaaataaagtctgtttaatagggggagaaaaatcaaagacatttttgaaactttttgagacaaggagtaattctgagggaagaagttcaaacttaaaaattgtatatgcttgcaaaggaaaaatccagacgttgtttataaacaatttccttagagtttgaaaatgtggattatgataaataatgcccttgacatatggtgtaattttcctcgtttatcccccactttacttttaaaagttatattttcaaccaagaatcttaactttctctaatcctcctcttctccgcctctaccaccccagaaagaattccataaattaaaggttttagagagaatcccatgatataacaaatccctgtttcactacgttgtcttcactgatgattcttagaatcctcaactggtaaattggaagctattaaaaaaccgcagagatgtcccgtatgactccaatttgtgagtcccttaataggcttgatagtctaacaaaaagtttcccagtacaaaatttggaaatctcaggaatgtatttcacaatcttagccatactctcaaaaagaaatttatgttccttttagcaattgttttctaacacgtccaaagaaggaaatattacaagactatctgatttaccagcagagtcctcaccctattttggtacctagttttcaagtctcctttctttttgactcagttattcaagaaaatttatagtttgaatgtaccttgagaaaaggaagattaaaagttggaacaaagatacaaccatttaaatacaactaatatgacttctgttttaagatgtatgacattttttccttctaaaacttttacattgttgatttcatgaggaatttcttccagacagatgaaaagcatcattgttccacattaacatttcatgtaaaaagaattaaggaggactgtctttattaaacagtgattgagatagatgatactattataaaattcttggtttgtaaaaggaaagctcgtccacatcagttgtacaaattgggattaattaccagttaaaacccaccatcacaaagacaaggggtttttataattagattttgctatattttgttttgtttgaagaaagcgagctgttgctaggatgtgggagctagtttggttatacaaagtttttgttttaataatactttagaacagaattgattctatgtccttgccctgtcttctgagttacacatctagacctctttcttattttttaagtctcatcttaattggctttgtgtcagtatggtccatgtctgcttgggaaaaacagtggactttgagaagcagaaacagtctcattttgcggtgaatggtaaatcatggccaacagccagctgttttcctctttcctttctgtgttactctcccatgagaaatattttttttcaattaagaacataccaacagagaaagagaactacaataatttcccttttactgcctggaattgctgcagggctttttcattttaccgtgttcattttttctctcctctaacccctttattttgattaatcctaatattttgcatacttttcttaagactcttatttctttaattttactttttaaaaatatgatgcattttaaagattacatgttactaaaaatcccctttctctgtatccaaacttgttttcaaaacctttgtcattagccaaaaaagcatagtgaaaccaaatgaatactattggaaaaaggactaaactacaaagattatttccattggaaattagaatgagttatttgccttaggtagcccctggttgaagtggaaaaggcaatatatggtgacctggatgctcaaatctacaattgcattccaggcttgaagccattcttgctgcaagaaccattggcaagactaagggtaaaggtagggcaaggcacatccagggctttgctttagaggtgttctgcctctctgaacaagtgcagaagaaaatgagtggtcctcggccaggcttttataaaactattctaacccatggtgtgattcattacattggtagaatatgaaaagtccctttctcttaattgtcctgaatattggttggagaaaaaaactatagtaggttttctattgattctgttcctttatgctgtcctatgaagtagaaataggaatttatattgctactggctattacctatgtcccatcaactcaccctatgactttgcttgtgcatgcccatactccatctacagttctaaattttttccatccttcaaggaccaacccttcacactgcacactcctctaggaaatctttctccatgctgccacctagatgaaaaatattttctccttttctcctgaattcccaaaacatgttattggtaacacttaggacactaatcactctccacctctggattatacttatctgttgtatgtttcaccttcttaccttgcttacaaacttcttgagagatgaatccatatcctgttacacttacgtggttattttgtttgctgttcaaagcaaccttaggaagtaggccttagccccattttcaggatgaagaaactaaaagtttagatagcgtaatctgaaaccttactatagagaactttactatgaacttgaaccataatttgaagaatccatgctgcttccatcatgccaactaggccgagtcttatattcttcatcttgctcactaaatatatgtggaatgataactgttataaaaagagaaataaaataaggtacatttcaacactttcactcattttttaaaggaattatatttgaggaagtggtttatattccaataaaatcaccatcctgctagttttctatattttgtttctactttgtccatgttgtatgtattccctttagtgtaagttgccattgacattctttgggcagaggcaaagtatacgaaaagtaaaagtattgtgaaaaggagtttctgggaaacttctacagtcaaagaaatagcataaactccaataatattctgtaccttatcttctaagattctcccaacttcctgacttttggtgtgagccaatggtaatgctgtctcctaactatgtaaaatggccctaggtaacagtgaccctgtatttggctctttgttttgttaagtttaaccaatggcatctggaactataaagggatgctcgtggtcttttctcgtgttgagctctgcagttgagagaaagccttacacatagcatgagtaggctaaacctcttttcccttgtagcaaagtgttcagagtgcctctggagtggcagaccagacagctaagaatggagcagctaaaaagaaacaaaaaacaaacaaaaaacctcttaatattgggagaactatttttttgttttaatttcccattcttcatgcaaaaacatttcttatgaagctgagaagctgtgggaaacaccaaaatgatcagatatttcatgaggctctcatggagctccagagtgacatccagcattgttagcatgcgatcaacatcatagaccatcagtgtgcaacacgagttaccaagaggggctttcttagtggaaagagagtgataaattggtaacatggaagctacttcctgtgttctttttctgagaactagaagaaggaatacaagttggccccatgctaatgtgtatataccttttttacataccaatcactagtgtgtttagaaattaggaaaggtcagtaagtctccagtatatataaacatctatagtgtatggaaaggtcttccatagtgtatccgttttctcacttccatttatcagtataatatatttaaaattgccctaagctgagagttggtagatccgagtccactattttttgtgatattaaccactttggctatcaatttctatttatataaaaatcagtaggggaaccagatgatttctgaggtttctccaagtcctgtgactctttgatcgtgggaaataatatcagtagtctaccatgtgtaatgttccacagtgctttaaaatcacacaaatgaagaacatatatgtataaatatatacataaaggagatggcatagtttaaatgttagtgaattccatgaagaacctatagattgaaccaaataatttttttccacaaatcttagctattttcaacttgtttgtacttaattttcataatatttgtggaggtatttgaagatattaggttaagtttaattaatttaaatctgtagtataaggctctgaaggctgtaatagtgtgggtcccataagtctaggagtgatgtattacttaccttggtatttaattatgggaaaatgaaaaataatggaacatttattttctttaaaagttatctctctcaaaataaggctgttaaaataattttaaaagattaaaaaaaaactatatgagtgcttttttacgtaccatgcactgttctagactctggggttatagttgtgaacaagaatgacactgaacttaagcttgtatcatagaattatgctattgcaagtgttgatagagcaatgtaaatattgaaagtaagcacaactggaattatacccgtcagtgaactcttgataggttagcagtacgctatgtttctaacacagacagtgagcaattttgatggtgatccctgggcttgattcttggttttgcaaactttgtaattagggattcttatttcatttgtcttaagtaatagcaaatgtaaaagatgggaaaatgagaaagcagcttttatgtattagaatgtgaaaaagattatgaatgcataaagctatacaaatagacttacacctataatatacacaaactataagtcttctccctgcctacaaatgccttacaaaagagtcattcttggatttcctgtttgcagtcatagctaatttttgtttggtaactactgccatggtaaccaaaattatgattttaaaagaattgtttattaaatcattaatatacaggaaattattttactttttacaaggtggtggtatccagagaaattatattattaattatgaaatcaactttttctaggagaggaagataaggaaacaaaagactaatcaaaaacattgcaaaactgcagattttcaggattttaaagaaaaataatttggtaattgataacttcactactgttctttgagtaaatatccatgtttaaaatttgcctcaagcactattagaggattaaatttagaggttatgcttttcaactgcccaactacaatctttgactctcctacaaaagagctgccatttagcatggttttgtcaattttcagttctaagtgccctgtctacctaacattctagttagataatggggaattagagcgataaggatatgcatgactataattttctaagtatcactgtatttattttggtcaaattcaaaaaagtaaaaaagcatagtttagaattgccaatttctctgttccttagtctgttagaatggtggggagtcggctcagatttgagcatggcttaaagtgggagagcgttattagaagccagcctagtggggattgctgagatctcatctgctgaatgacagcaaagttactactctgtaaatatacttaatctgaaatgctgaattatcctcaaaccatgagtgattcagcttgtgtttatcattgtgacattctggccactgtgaaaagctgtaaacaggagtttcagggtgttcattgcatagcttatctgagcagcgagcccagcagaaaagatgggcattcagcccagcagaaatgccttgataaggagtccattaatgcatctctagccacaatgaacttttcccttgctttgtttgatgataaagtgatatcatgtttcattgaaaaatgaccatgtagatgttaggtggatttttgtttttatatgaccacaacgtgacagtcttaacagaatgagtcacaaagtaaggatcaaggatctgatttttcctttatgagatactggcctacaataaaaataactgggggttaaaaaaattaccctttgtttttcgtagagaatattaaaagtgcagtttagatttaaaactacagactctaaactccatatctatcagtatcacctcttgagcaaaataccgatgtcacctttgatagatttttttttaaaaaaggaaggaagatgagtgagcaaaacagatgtgtaagttaactacagtgctggatagaatgacataagtgctataatacaatttcttatctgggatgaggaacctttttataaacaaaaattaatcattggttgatatttttaaaaacacaataaaaatttattacttaaaagacaaatacagggccaattaaaaaaattattaaatgcaagagacacaaaattactttaagtatatagtagttcctaattgcctactgtcagtttctctgcctatctcatcacagactagtgacttacactttgtgaactgccactttgagtagcacagcaataatagaaatacaaacaactgttatgaagtcttagaagcagaagtaactaactttaattgtgtgggttgcgattattttatcaaggaaacacctcctatagaataaagaagctttcattaggcaaagaaagcattccataaagaggaaatagcatgaaccaaaggtacctggctgtgaaaagtcagtaaaaccacccttgacattttcagttttgtctcttctaaaataaagctaaagtagatgagctgcagtaatttgtaatttttccacagtacaggtttgaattaaagaggtatgtcactgagctagtataagaccctagcccacagctgaagagtttctgatctcccttaactgtgatgattatttaatacattgtgtcatctattgagagagaggaggaaatttcacagtagagtctagctcatttaggctggtctggactctgagctgtggactgggaccacaatgttgccaggttttcatccttcttagatcagtgaagccaacagtaaaggtcatgcccaactgcaggagcaccttttaagcctcttcttatgccaaagcagtcacatgtccagttctgaagtcaaggagagaagtccagtctagcaactatgaggctagggcagggatatgatgttgaatactattacgtgggaatgaaggattgggaccattacttcagtctaccacgtgtgctatagagggacagttgaatgtaggggcttgaggatacttttctgaagatctttcatgtatcaagagtattctgagatgatattctgtatggtatcagactacacgtttcaaagcagagtagtttttggtcattctgaaaaactgtagaggaaagttaactttgcagtatcccttacttgatatttagggtttcctttttttaatctggtcactcttctgttagctttgaaacataggcctctccaaattcattccagccgggtcatgtgacttccgtgttaaacgaagacatgtaaaactcatttctttgggaaatggcaagttgcctaaggttttgaaggggaattacaaaatattaccttttatatactgcaacaaatggaaaatatattctgtgaacattccaataatatgtgttagactctatctttggtaatggaatagaaggttatcccaagataattggcagaatttaaaggtaaaaagaggcaagacagatttcagtggcctaactccacagctcttttaagatgtcccaggtaaaccagtagtgatgttattcattgttactttctcatggaccagataaaattaagccagagggtaggatcatcctgtggaccactgttgcccacttttctctaacagttagggaatttaaaggaagcagcgcagactttgacttttccagacatagatttggatcccacctttgatatttactcagtaatttggcaacagttgctccttggtttcagagatctaatctgcaaaacatggatagtacttctttattggattattgtgaaattaaataaagtagtacatgtaaatgtttagaacagtgcctgacatatagcaagtacctggtcagtgttattaatgttctctgatcagttttgtttagttagttagaccttagtaccaataagtaaacattttgagaaccagaactgcattaaagttgggtatcagctttagaaccctgggttcagtttttggccctggcgtttattagctgtgtgaatttgggaaagctacttagccctgtaaaccttagtatcctcatctgaaaatgggtttcaactgtctacctcacagggttgtaaggataatcgagatgaatatcttaaagcacaaagtatggtgcctacacatagacaataaacaaatgtgtggtaatcctcttcaagaaattcaatctagagggaagaaaatcctgcatagatcttcatgctatttaacagacacctgaatatattgtcaagaattttatgatggcatgctctcagtaaattattgccacttggtactttgttggacacaaatatccatttaaagttcgataactgggggatatattaaattactggatttaatatatccttttgctaatttaaaaatttaatatatttaatgtatccttttgctaatttaaaaattattctgatttatatttttataatgaaattaaaatttataaatatttctggaacttgagtacctaccatgtgccaatcgctatgcaaaggattcaaagctgggtatattaggttccctgagaaagcacttgattgaacactgcaacgtattgtggtcccgtatagggaattggtatgtttccctgattggaatcttcctcagagtttctgaggtaaattacagaaatggttactattctttgcagcacctcccattaaaaagtggagtctgttttccttccctttgaatctggactgctttctgacttacttggatcagtagaatgtggtagaagtggtgtgtgaatcctaagcttggacctcaagagaccttgcttgcttctattgctctgttgctgggatttaagtcttcacagcttcccacagtgaaagctgtggaaggagtcttacagaagactgtccccactctgaattactctcatattcctctgtacatctgaaagaatcaagaatcaatgtactgaaactgctctaatttcattggtggcttaagattgagcccactttctgctctagacgaatctgattttgatttttgtgcttgttgttccattaaagtgaaggaaaattaaattaacatgcaactgcaattttatcttagttgtaaataggtggtatatgcatattttgaaaattgtctgatttccttgaatcactagacaaattttaaatgatgtctgtgcaccttctttagtggtatagtctaaatatagagcaaaaagtatggtaatccaaaccacttctctgatacatcaaaagttaaaacatgggtcaaaaattagttaaggctctttgatttatgcagcacaacatatcaataaacagaattcttttttttccagaataagggatggtgtgaaaagggtatgcaataaataaataagcaagcatgaggacctggcagtagggttcttacatctctcccttcctttcctggtttccaagacccctctccttgctataagactttgtttttgttctaaatgcctgtgaatgctaatttggggcaaaagagaaaaacgagaagactgtctttttgcacccccttttctgttttctttgctgtctctgttgggcattactctctaggtttccttggatcctcctgctcctctgggcagcctccttcagtgaagccctcagccaatgccatgagccttttctttcattctccagtctgtgaaaacacatctgtactgccgtctttttctgcatgtgctccagttagatagttaaagaattagtggcaataaatcacttaattgtacagtcaatctactcatcccctcacccatgtattatgatgggttacccctgaagaaataataccatagcctttaggcatcgcaagaatgatcgcagtattcaagtttggggataaagagccttaattaagacctctcaaagcagctctctgtgggatccaccctttagaagcagctgtggagatagtgacacaagaccaaattaggaatggttgccatgatccagattcttttatggaactcctacagatgcgttttggaatcaggtttttaaagtcccttttatagcaaataaataggaggttttgagggctgtttatgagcgcattccattacagtgtctttcagcggagccagagctcagccaatcctaattaagaagcaatttcagctgcagtcattgcttattataataattgtgacatttttatagccctacattgtctttctcaaagtaacggattcaggaggagtccttttctgagtagagtccacagaagaggtattctattggtaagcatttcaaatgacttccttcatacagtagtataaaaataatttgatagcagtccgtttgaaaaatgtttataaggaaccagcttaaactgatcagatggaatatattttcatcagtcgcttacctgaaataagtacaaaccttttttattttttaaaaggggggcctaaatttcgctcctaataatattgtaaggttacatattaagtttcaaatagataagtagtactgtgagggaaggaactgctaactgtaaatactacctaatttgaatcaagtaattttggctcctgatgtcacatggaggtactgaaatttattttcttttacttaattccatctccaggtggatttatataatggaatttaaaagtttatgtaaatcttttccaatttttattctgtgttctttaaggatgactgtggcataatataaacattgcgaaaattttctcccaagtatatttggtattttaataatctggtttgcagctgtcttctgtaacacaagtgtgtgtgtatgtgtgtgtacccaagtgtgtgtaactatatattgagaaagaaaatgagacttagaggctaaaaatcatattctaccctgtcttctgaaagatcatttcctggttcttactgagtgaacaactaacaaattgaagggaataagtattaatgaggaaggaacaaagttctgctttagatgcccattgggtgaagagaatttaaatatttgaaatgggcaaaataaagagaagtggtagataagtaccccatatacccctgttcccctttataatatgtctgtctcgtcacaaatcacttagtctttggatttaaaatcaaaacagaaaagaggatatagtaggcagcatctaagatggttcccaattactcccacctactagtagtcacacccttacatattgccctgccattgaatgcaggctagcctgatcagttgccaaaaaatgaaatgtggcagaagcaatggcatcacttccgagattagggattacagcttctatcttgtggttctcttgctctctctgggatcacttgccctggggagaaccagctaccatgtcctgaggtacccatgtgggcaggcccatgtgagaaatcttagaagtgggtctctccctagtcgatccttgcagcccagctgaccccgattgcaaacttgtaagagaccgtaaacctgcccatctacctaagccacttccaaattcctgacacacacaaactatgacatgataaatcgtattttcaaaccctaagttttggggtagtttgcagcgaatacagaggtgttccattatgaatctagaaattcagtgatttgaaaaatttgaaaagaatgatattttgcttcattgccctgagtactgcataatgtatgtaatcttacatataatatagcagataatttttagtactagtcgtgtctacatgttttgagtaaacacctttcaattttgaaatataatttgttcatttgtatttcttgctcattcttttaattttttttttctcttgctgtaacattgaaagagacctattttgcgtcaggaccctggagatttttgttgactcacacctcattcttctgaggatccccttgtgtgtgaatttatcacctcggggacttccatgttagtgtagctgatgtgcagacattcagcttcctcataataagtcccaggttttgcctaggatggaggaattcctgcctagcaaacaatgagcagtctttaagatcaaaattgattactctagagaagttacagaagaggaatattaccctttacattactatttacctttttagtttcagtttggagggaaaaaaaaacagtgactttgtagtgagtgcatagagtttgagtgagaaatgccaagatgcaaatctcacttctgccacttgctagttgggtagtcttaggcaagttaatttctccaagtctcaatttcctttttatgaaatagggatgataatacttttccaataggttgttggggattaaatgtgatggttatatgtattttagctggcaggtagtaacattttaacaaacggtggttgaggtgtttttactaacacttccaccatcacaaccctcagtgctcattttttaaagtatagttaaaaacacttcaacatatcctgccaaaactaaaatttattattgtttcctagaatgtagcaggatctatttctgctcttcttcaaatatgttactgtatgtattgaggtatagatgttttgagtaatcagctacaacttgattacatctcaaactcaagtagagaaattgtcttgatgacaatacctttgtcattaacttaatactgttactgccttaagaaatgtagggatagattgagtaggaatcatccactttaatttgttaaagtcccagaaaacttgacgtactacctccagaatatattttattacaaaatatttaggcagaaagaacacttgtttccttttcattcctaacataatagtctatgtgattatttactgctgtctgtgaacaaaaaagatttctgaccatttggcttacagtggattttgtgatagagatgcatacagggcttctggctttatacatctaagctgaaaaggtgaggggatgtggaaatgaatcctagaatctgcagtaaatagttttattcctgtttccttatggatgagccatgttgacaactaaagacccttaactgattattctattcttgagctataatatttggtcttcagttaaaaattccattacattctatttttaaaactgatttaggaaatagggcttctttatcagggcgttccattttatgacctatcttgaggcactatttattggttaggagcagtcacagctctgtcccagtttcttcatgtggataaaaatgtgggtagtaatagtatctcagactctcataagattgttatgaggttaaaatgagataatccatgtaaaatacttagaaccctgcatggcagtgtaagtgctcaataaaaatcagctgctgcttttattatcaccaccccttccagtgtctttttgtgtgtgtgtaaaaaggcagtggaagttccttgggataaagatatgttatgataaagattgtttgataattaaaacaattaaataaataaaactttctagcactattgtaaatctcagacactggcaggtactaggagttcaaatatgaacaagaagctcacaatctaatgggggtaaattgatgtgcacacaatcataatatagtaaggaaggacttaataacacaatttgtgccaaggggatagttaaagaaaggtatcacagagttactgacattagaattgagtctgtgggcccagtagagacaacgactttggcagatggagaagaagaggagcagaggttcaagcaaagtgaaaagctccgcttaaaacagagagcggctggaggggagtggtgtgaggaaggcaggtggcgccaggctttaaaggatcttctttgcatgctaagaaaagtgaaattcattgaacttattaaaaccatctagcaaggggagtgttatgattatctttaggtttattaaaataattttgagaatagcaatacaacgtcatacaaaatgatcagttaggagagtgtggtctcaggatgatatgatgtgagtttgaacatgaacactcgagtgcagatgagggagcagactgtgtggtttttagaaaagagacactagaatttggagcatcgtaagcatggctagacaaggacaaggaggcctctgggccccaggttgggtgaccaagtgggtggtgacaactttgtcttcagtcttcttctcatgtatttcagccttgagtaagtgagagatgggaagtttttgtttttattagcaaagaaagagaaatgtagcagatttattaagaatgactaattgtagctcttaatcacactagttctttgtattcttacctaagaaagttggcaaactaataaaatgtgcaactatttttatatttaagtttggttttctgtgtaacctacactttttattttatttatttatttatttatttatttatttatttatttattggagatggagtctcactctgtcacccaggctggagtgcatggcgtgatctcagctcactgcaacctctgtcccctgagttcaagcgattctcctgcctcagcctcccgagtagctgggattacaggcatctatcaccgcgcccggctattttttgtattttttttttttagtagaaacggggtttcaccatcttggccaggctggtcttgaactcttgacctcatgatccacccgcctcagcctcccaaattgctgggattacaggcatgagccaccgtgtctggccaacctacacttttttggtaatgcaaatcttgttagagatttggaaacaggcaatgaactaaaacgttcaaattttaaatcttgtgtcagatcttaataaaaatatattgattgggtgggggacttcacagatcacactggatttctaagagagccatttgctaagaggaattatttagatatgtagttcctttgtccagaatatttatctggatgaacaaaatctaaaatgcttctttaggagtgtaatatgaatatatgtgtgtgtatatatacatgcatatgtgtgtgtatatatgataggtggataaacatgcatgcacacacacactgagaaagcgggagtgggagagagagatgtatatttcatatgatctaccttcattccaatattattaaagaagtcttagtaatgcttgtttagtaaccacataggattctttactccagagggaaatttggttatgaaaacagcatgaatcagatgatctcaccctgaatactgcataatatcttccagacccaaattgtctccagatcaactcagaccatgtttgaaataccagatgttccatagtcttttttttgtttttttttttttgtttttttttaagtatctgacatgcagtacctttttctgggtcagaagggtcacctgaaatgttgccaacctattcgactgctgaaaattatgaatatggatacattgattccattcccatttcttattctaaaataagcaggggataaaagggtgtttggaggcacagatcatgggaatgtaaattcagtttatggagcctgcagttaaagatacttaagacctatttgtctatgattcgtgtttcacagtaaaattatgtagtcacttttatttttttcttaggaccttgatagatagtcccaaagcctgactgtaatttctcccaatatagtcaatccaaaggacctgttttcttggacgctgaagaagaaaaattattctgtcatatccttttattgatgctggccagaatgtgttactaaaattatatgaagtagacagctttgagacttgtgcgcttatgaaaaacatgtgtttttaggcactaagtgttgagtctgcagggaataccgtatcacatttactgttgaaattatgttaaaataattacgtgcaacaggactgagttttatcattcacagcttaagtcttttgtttcctatgcatactttataaaactactccaccagagttacaagtgattctgacttctgagagtcattaatatattagctttttcaaataattattttctatttagtgattaaactttgagcagatgaccatgctgaataataaccaaactaagacacagttaatctgacacatgatttgcaataaaattaaaaggtatcttggagccaatctagtttaatttcctcattatctagatgaagcctaaagaagaaagatcactttcaaaatccctgaacacgccagtgacactctgtgaccagaacacaggtttcctgactctcctccagggatctttctacattttcaaagttccccgttagctctctagtatctataactatatatatatatatatatatatatatatatatataatcatttccttaatatttggtaattctcacaacatagatatgacatacaggtacacctatcttggttatatttgtccaagggtctagatttcactttctaaacagctagttcgccttagctgaggagctaagcctctctgggctcaccttcctccctgccactctctctcgcaccctgggcatcattaaataacaccttccctatttatatccctcaccaagagttctccagcccagacatctgtagacatcttgtaggcagaaactaacctacaagatttggatgtccaagaatagtcatagccttggctcttcaggaaaggagaagaacactaaggagaaggtgtggtctatgctgagggtaaagagaagagatgagaagaattctgggtcctggacttcagggaatcctgaatacaaagtgaataatggagagaaattagagaagcccttagagtagatggggttccaaatccttgaactgaaaccaagaggagttgaggaacctcagttcttgtgacactctgcccaaaataggccctaagaaactgtacttggggcagttctggctgtgaaactccttttaccacagattagagtccatatgcttcccttcatctgatatgcatttgacttatgaaggggagaatagcagatgattagatgcctcagttggaagaaatttgcctcacactggtagaggtatgtctgctactgtgtaattttataatataaattggatttaacaactgcattctaaattataattcaatctgaaactaggcacatcctaaacaaggaaaatgctagagtgtgaatcacgtatcttctttcttggaaaggcattgtttttgtttcctaacagagggttgataaagaggataaaaatatggaaaaagttctcacccaataatgtggcataagtcagagatcttcagtgctggtatcaatgagatttaagttttgtagctatatacttatagctataaaataaatttcttactgaaatgttctcaggaaaacaagtttattgccagtctgaaactctaatttctctagctgctaaaagtgattttgaaaacttggtgtcatttttgtttgtgtttggtgtgtgtgtttgtttttaattaggactgcttccattgggttatagtaggagaaagtgtatcatattgccgtgacccattccactctctttcacttacttgctctctgtctgtgatgtttaaaagttccctcacacttaggtctgagcatgtggggaaaatgaaagtgtttgtgtttggaaaggtagaggggcactttttccaggcagtcacaaatctaactggaaagagtccataaagagattaagttggccttccaggcaggtcccaagggcaaaagaaccctggaacaatactttctgggttttccagagcggcctacagagccaatttctcaagttactgcttttcccaaggcctggtctcctggtccctgtgagggcttcctgagcttctgctagcagagcttgagaggtgctcttgctcctcaccctcccctgttgccctgtggctttcctctttaccagtctctcctgtctctgaggatgtcatcctctgttaagctggtagcctaagacatggcattgaatgcttcaagaggtttagtttcttccttgggaaaatgaaaaggaaaacaaaacaaagtactccgcctgctacaaggccagccctgtcactctgaaagtgctttacaattttttggctcttcctttgccctcttctgccacaggccttgtgtatggtgtttcctctgccctgaatgcacttctctgagccaaattagatactgctcagcctttccattgtaattcatgcacctctccttcagcgaagcttccccagccttccttatttatcttgtcttcctttttaaagctctcagaaagtcatctacacttagagatggtgcaagagtgtttctggaaaagaaagttcttttctttggggcagaaattagctagtgactctttggaagacaagagctcccatttgacacgctagtcctctgccccaaaagaacagtagagcaggagccagatgctgagttttaggtctggtttgctattgagtagctgtgcaaccaggagcaaattatccctcctctctggattctattttcctgatctcttacatgagggagatgcctagtcctgtccagaataagaatatgtgggagactttaaaagagcagcagttcatgaaataccaccagctctagtaattctaataaataaaatgatagctattttaagaatatattgatgaaaagtgtcaaactctgtaaaagtatttgaagatcttattctgagccaaatatgagtgatcaatggcctatgacacagccctgaggagactctgagaacatgtgcccaaggtggtcaggctacaacttggttttatacatattacagacatccgtcaatacatgaaagatgtacattgcttcagtctggaaagacaggaccactggaggtggggggcggtccttccaggtcatgggcagattcacagattttctgattggtgattagttgaaagccttattatctaaagacctgaaatccaaaaaaaggaatgtctgggttatgataagggggcttgtaaggaccaaggttttatcatgtagatgaagcctcctggtagcaggtgtcagagagaatagattgtcaatgtttcttatcagagtctgttctgtcagtcttaggtctctgtgtttctgctaatgctggtcagctgtgaagcagcgcccacccacccccagctccccatttcctatcatggcctgaactagtttttcaggctcactttggaatgaccttggccaagaggtggggtccattcagatgcttcatgggtttataattttatttttgatttacaaagataaaaagttggtaggagaaaacaacttgcccctttgcaaagttgactttgtaagtcagtagcgagctactccaaagccttagtgtaaaaactgctgactcatggaggttctagttacatttgctgaactttcaagttggattcagaaatagtgaatgagatggtattgttccaggatgtttgcagtcttttataagcccagtgttgttcagaccaggcaattccaatctgaaggcatgcaagaatttaagtggccatttaatttagaggcagaagcatatttctagatattatctgtccacaaatatcaggattttatacacacatgtaagtttgtatgtgtatgtgcaagttctttgtcatgaggtaaaatttattccatgttgtgaattatataaaagagagtttaaaagcctctgatttaagctaagctatgtgattaagccttaataatgtaatcaaaattttcatttgggattagagtttatttagcaggagatgcatgaacatagtatgaatcatatccatactccaggcacattcagaactaactcttctgtaatggaaaattagaaagggcctgaaaaagaaaacttttttggatttgcttttcattttactatggatattgtaatggagaaaacatgtaactatgcttattacacaagaccagaaaagtttccctctgtcttttgtttaacctacattatttccatactgtgtgaactgtgatcatcagtgacaaggaaacaatttaattgctttaaaaaaaagcttagtgttgacactaaatatacaatttaaagactttcatttcttttgaaaattggtaatatggacatggcaaagatgataaagcttagctaatgctggacagttgtttattctttagagagtatactttatatggtctaacttaaaagtattgtgggttttcctaagcaactgtgtggaccagttgggtttgaatatggccttaattatggaaaaaggatgtggtcattttctttaggacaaaaggaaaggcttcacttaaacttcaggacatgtcagactgatctttcaaggaaccagttacaatgtggttttgattgcatagtgacaaacacagcttggtaaagttacaaaagagggccattgaaaaatacctattacttgtccagcttgaactgctactctaggcactaaccagtaactaattcctcatggtcactgatgtgatatttaaaacacagagtaatctgattactggtggtttgccactgtactgatgtaaggctggctactcttttttttccaatatcagtcgttgggtaaaagagcttaattacaaccttgtgtccttctgccatctgcaccccactccttccacttattaggccatgtctcagcaagttctcaaagactattgtttaatatggtaaagaagaaaagggtttgctatagcaagggtgataatacagctctccactccttgcctccctacaacttcaggcagaagagcacaggccttggagtcagaaagacttgaactcaaatctctaccatttattaacattttgatcttaagcaagtttcatagtctctgagtttcagcaaaaacatttcaaaaatggcaaatcatattgcctactttgtaagcattttatatagttctgtaagattttaatgagatataagtaaagtacttacctctattccttgtgtcttagtctattcctgctgccataacaaaataccttagactgggtaatttataaataatagaaatttatttgtcaagttctggaggctgggaagttcaaaatcaaggcactggcagactcagtgtctagtgtgggcttgctttctgcttccaagatggcaccttgttgctgcatcttcacatggaggaaggttcagaagagatggaagagaggaactcactccctcaggggctaatcccatcaatgagggtggagccctcattgctaactgcctaatcatttcataaaggcccagcttcttaatattggtacattggggattaagttgcaacatgaattttggaggagcacggacattaaagccatagcactggcattcaataagtgtatattgtagctattataataatatttatcataataaaaataatatttcagttgtaattcctaaaatctttaattccttgtttgatgtaaaatatgttattcaggatgagacttgctttttaaggtatagttttctgagtgttgtacctattgtgctatggggctgtactatggggcaagtagtggccaaagacataaattcatgagtttttgttatttgcaatatttgtagttttctatacagttatattctgatgcttttcttttcatgataaaaagcaatcagaatataaaatatgttatgtatgtacttggaactgccatgtacatacctgggtatcatcattgactaaatataagatttgtttgaaagttatctcaacacaagtggtaagtggaattaaaagtgcaatttattgaatttttagatttgtaaagaatctaataacagattcatgatgttttctttttaacagatgggcttaggtcacgagcaaggatttggagccccttgtttaaaatgcaaagaaaaatgtgaaggattcgaactgcacttctggaggtattgttttgaaaactgcaaccacattagtaatttatactttttgcaatacttcctcagacagtggagatatcttcgagttctccagcatggttgctaagttgcagacctgttactgtcttttctgagaaatgaatacaacataaaaagtgttctgtcttactgtcattaagtttgacttagtgaattggaccataataactatttagagttgttggatttgcttgctgtctttaagatttccttcgagcctgaaatactgaatatatcatctttctggtggtaaataagtttgtggtaatcctccaggactgtttaataatttatttgttactttttttttgagacgaagtctcattctgtcacctagactggagtgcagtggtgtgatctcagctcactgcaacctccgcttcctggttcaagcgattctcttgccttagcctcctgaatagctgagattacaggcttgtgccacgacacctggctaatttttcttttttgtattcttagtagagatggggtttcgccatgttggcaaggctggtctcaaactcctgacctcaagtgatcagcccacctcaacctcccaaagtgctgggattacaggcgtgagccaccatgcctggccctgtttaataatttaattattctcttcttaaaaattggtaactttacatctcatgtctacattttccgtaaacaaatatgaatactgaatcaagcatgtatatgttagttatcaggaaatgaagttgaatttagatctctttaaaatttttagctgtaaagttactagtgaaaaaccattgaaacacttgaatttttttaagaaaaaaattaattgtagtgtcttggtttgaatgaagtgcatatatacacaagacaatgttagtgagtcaaaaatgtgaattttctatagatcttatctttaggttgttttgaaagtactactgcatatcatataaatctaaaatcagtatttgaaacctgtgcttatgaatgactgtcaagtccatagtggtaattcacaagtctgctcaaagttagaattagcaggaaaaaaaaataaagataactatacagttttaggatggcagctaccttgttaggatgactctcatttgagaaacacttctgtactacagatttccacaggaaaccgtttagaatactttcatcagctcttggagatgtgtacagtgtaaattaaaggagaatataaacaaataaaattttagacattaatctcttttaaaaactagtttattgaatcagttttcagaaacaaagataattgtttaaaataggaaagtcagtagaaacctgctagaactgatacagttcttcagttttgatacaattcttcagttttagggagctaaagttttccagaatttttttttacaagacttaagcagctctcccttgtgctgtctcttcaagggacatagaagtggcagtatgtctctcatgttttaaaaaggtaaagtgacttaacacaaaatagttttcatgaattagaacatctctgctcttaatgctcacactattttctattgggcctattagttaactttacagaaggctgcactgccctctcctgggcatagtttttaccttacaatcttataatacataaaatccaaaatccaaaatgctccaaaaccaaaacttcttgagtgtcaacacgatgccacaagtggaaaatttcacatacctgaccgtgtgacaggttgcattcaaaaatgcattcaaacctttgtgtcttgtacaaaattatttaaaatatgtataaaattaccatcagcttatgtacataagctgtatatgaaacagaaattaattttatgtttaaacttgggccctatccccaagatatctcattgtttatgcagatattccaaaatttaaaaaaaatttgaaatctgatacacttctgttttattttacttgtgaaacattttgggtaagagatacttaacctgcattctttttagttctgctatgcagttgccaaaaaccgctcgtgagattttaaagctcattcctaagagatatcatcttttctctaaagcaagttagtcatttttgttatgtctatattaatcattttaatcgatattttcagatgaaaatatatccgacaagagcagatctccatggcatgaaaataaccttttacatttcaatttatcacacagactcatttaatcaactgggtgtagtctgaaaatctaagagccataatagtctaggactttgcatatggcctgtcattcagctggggttgataacagtccaccccattggtatttcttagtagttctgacatcttcctggcatgggtccagtcacatttctctcagaattcttgataattccctgactttttcaccatagctaaaagagctgaagcaggtgcctttgacctccctatgtagcctctttcagtacagtctttgaagtaaaatattctagactagttgtcctgagtgtaacaaagattccaggtctagtctagggccacagaacttatgtgggtgaagtagacatgggatcccatgaccctgcccacttagcctcctcctccagcttcatggtgatccttgacttaggaccctgagggctccatcgggcacatttcaaaaatcagagttaaattattctctacctctttattagtctggcctctcacacaatcacaagaatggtcttttgaacatggatactattacatacttcagatgacttaagaaccctcagtagtttcccactggacttcttttaggcaaatttcttggcctttgacattaaaccctaacatctggcctctgcttgcttttccagcctcttccacttcccttccaagcactctatgatccaagtgcttgatacatactattccctgaaattttgtgccttattgcatggtgttctctgcctggaaaaccctacctcccaccactaggaaacaaaaagtctcagctcaagaaatacctctgagaagtcttccctgcccatgtatgtcttttcaggctgccataacaaaatatcacatacctggtagtttaaacagaaatgtactttcttccagttctagaggctggaaagttcgagatcaggtgccaacatggttgagttctggtgaggtctctcttcctggcttacagacggctgccttctcaccacgtgctcacatggcctttccttggtgtgtgtgggtgtgtgtgtgtgtgtctggagaggaagagatctctctcccttttcttataaggtcacctattccaatggattgtgacgttcaccttgtgacatcttttaactttacttcttaaaagcccctgctccaaatacagtcacattaggagtttgagcttcagcatatgactttgaggaaacacagttcagcccacagcacccccttcccctgcttccacatacccccaagttgttaggaatcattttcctttttatcaccttgtatacttacagaaagccaggagataaatacccagacctcattcttcatcactctgattttctgctggcacctcccattgtcccattgccagtgacaagggatcccacaggtgtagtccttaaggatcagccttctgggaaatagcacagagtactgaggcatggagaatgaatctggagaggtgaatggaagatgccggatcaaggtgtatcaccatagttgcaggagactaaaaattaattattaggaatttagagtgaacttgtaacttaactagtctaacctcattttacagatcaaagacctaaaccaaaggaagttaaaatgacttgtttgagcccatgagttattaataatataatttgtgaatgatttctatgtgtcacacaccagtaagcacttgtaataattttctactgctgcataacaaattactacaaactttgcaagttaaagcaacaactgttaactcaacatccatcattattattattattattattattattatttttgagatggggtttcacccttgttgcccaggctggagtgcaatggtgcgatctcggctcactgcaacctctgcctcctaggttcaagtgattctcctgcctgcctcccgagtatctgggattacaggcgcccgccaccacgcccagctaattttttctatttttagtagagacggggtttcaccatgttggccaggctggtctcaaacccctgacctcagcagatccaccagcctcagcctcccaaagtgctgggattacagacatgagccactgtgcccagccaacatccattatttttcaggttagaagtctgggataggggagctggcttagctgtctatgcttagcacctcaaaaagctgaaatgaaggtgttggccaggctaaaagtactcacctttaagtgcgagggaagaatctgctttcaagctcattcttgttggtagaatctattttctgtggttggagaaccaaggtccctgtttccttgttggctgtcagctgggggctggctactctcagcttctagaaaccagtcacattcattgaggtacaatgccttccatcttcaaagccagcaccactgcttagaatccttcctgcacctcacatgcctccaacttcctcttctgctgcgagccagagaaaattcattgctttttaagggctcacatgattagagtaggcacgcctggaaaatctcccatttgccatataaaagtaacataatcatgaaagtaacaccaggggacagaagtcataggggccatgttaacattctgcttaccacagcactgtatgtacctgattgtacctaatcctcctaatatttattttattatgtatgagaaatcaaagacgtaggaaagttaaataacttactaaagttatggcttatagatggcagagctgaatttgaactcagagttttccaaaacctttctccatggcagagtagatattagaatgcacatttttcactctcagggccagtgaactttgaactgcaccaggctgtcgcctctgaagtgtgattgttgtgacacagacatccttgtggacaaaggtgtacttttactgtgagctctctcctttttcagtgtgcccatgattacaacagtagaggaaaataaaaggttcaggaagcctaataatgacccaataagaaacactatctgctgggaatgctttcaagtaatatatagagataaagagtgtttattgaaatgtatgacacagacccaaggtttccaggagtttatagccagttatttcacattgaaggtataattaatataattgcaaccatgtcatttatcatattaagtaacagaattattgttttgctttacctttgttaaagtctcctaataaaacagttgcattttattaaaaatgcgttacttgattataacatacatctgttcagaatttctgattgatttagagctgggtgaaaactaaaaattccctaccataaatggattaatacttgtgttgaattctgtcacagaggcccacacttaaatccatatatgtatatccctgttacaaaagggcagcttccaacccttttaaattatggtttgtagcaatgccatggccgtgcttttaaatcactgtgaatgctggcagcatgtcaaagcactctagtttctactgcttgccttggaaaaatagtaagttttacaaatagtgatacaaaaaaatttcttttgggagaataaaggatagtttcttgatttttttcagcttgaaaatgtaaatatgtttatttgtctgaggcaatacttttggtagttttgttcttgcattcgctctcccaggctcgctctttctctctctctcactccttccctccccctcgctcctccctttcctccatacatattaatgtttgcatatatatgtgttaatggtgctaaattctttttgtacaaacaactttttatacaaataaccctcctccatccccacaccttagagcttcccaatctgccaatccacctttgcacctttttaaaagaatcatgaaaaagacttttaaactaacttaattctgaatccccttccctttttttccccatagaacttttcttaacatcctatggagaatctggagagagaactgctcaataggacagtttagaaaatttagaggtttgaaaactgtgttaaatatgggaactgatttatatactctcttaaaactatcaactcagtatagcacaaataaataaacaagctgtttaaatctatatatatcatcagaagttacttatggatcatctgatgaaagataatccacacaccgtgcaaacagccccttgcacatgggtattgtgctcacccatactctgtttgtgtttttgttttaggtttgtataaaaccacgtttttaaagttcttcattttcttaagggtagaatctgggttagtttaggctgaaattgaatatgtgataaacgtcccacttattctcaggccgctcttggataacaagatcacagtggcatccttttcttctccaattccacaacaaggtttttcttttaataaatgtattggattgcttccaaatgactttgaaagtttttataggtatttctaaaagtaaaatgttttagtttaaatgtgggagactcaaatataaaacactgtagattagaactctaagaaaaatatttttaaaacctaaaactaggtaagtggtaatagcacagatttccacaatagatagctcctggcacctggtgctgattttatagtatgttttcttgcagagtagtttgtagctggctcttctccttgtagaaatggagctccagtgtaaggcttctggaagggatgtggtcatcccaactgttttaatgatgacagctctagttgaagagccatcccacccttcttgggtcacattcttaccaaggactctgtcaccacaattcaccacattggaggatgcagatgaggcttttaatatagtcatgatttttaaaattataacaaatcaatcataggttttctctacttaggaaactgaaaattatatggcatagtatgacttcttaggtatttcttttttcttaccactagcgttattggtatgttgttttaacctgattttactcacttattaacaaaggtatgttgggtggttaaaggcattgatagaaaagcagaggcttcctgagattgtgaattcttctaattgtcaagacaaataataatttaaaaaaatacagagctggttcttctataattagtaaatttaactctttatatttaacactttcacagtaaatataacttttttaaccaagccacagctcaccatagtttattcatgcttcagaaatcatcaggctttatttcacttgtatcttttattatttatctttcagattctaaaatctgacccttattttgtggtattcatgttgtactggtgtagaacatagattgtaaaaatttccaaagtccagtgtttattatacggcctcgatcctttaagataccactttgctaattattgggatgcatgctgtagctcacagccatataaggatctatttagctatattaagaactaaattcccactccaccttcttcccccctcaggaaggtataattttaaacttgaaccaaaagcagtgtgatagttttataaataattacattgtttttgttaaccaaagagtaaaagtaaagaacatgctgtagtaggataacttgctgctttccactagatgggagtatgagataaccagatgttagaaagattattttatagctgaactagcatatgcaaattcttcaacaaattcttaccaaataaagatttctgactagtgtgcacaaggaaagcaatttgcctcttcaccacctatctctctctctctctctctctctctctctctgtctctgtctcggaatatacaagtcaaatctaatattttcagtttgcatactgaaaagtattttaagaaaattcagaatacaacaaactaaaatctataattaataatgtattatttggcaatgagatacatttgggtttttagttgttttttctgtttctgatgtagataaattccatgatttatattaattttaaatttagaaaacttagtaaattcttcttaatgctaattaatacattgcatttctctgtggtcatagcatctgtgaatagcaacagtttagtttttttctttctgatgaattcttgtaacttttcacactgctctgattagtaccttcagaaccatatgattagaattggtgatagcaaggttgctttcttgcttcacatcttaaaactaatgcagtaagtatgatctatgctgagtgtctgggtttgttccccccatgcctcatcctctaggaactctttctagaatagtttctatttccttttactagtttctgctattctctttattttccttccttttacttcaggcttattatgcctttttcctaacttcctgagttgaacacttagtactttattttttccttttttctaatttgagtgttttaaactataaattatttagttatctagttacttcaacatgcattcttagcctaattgtatctaatgttaatccatgtttatatagactgaacaatgtaagtatctttagaatgtgttttacaacactcagatcgccactcttattgttatgttgtcgttgccatgtatattgcttccagcttaaatttttaacaccactccctactcctctgtttttctctgtcaccttttccagcttcttttcctctactagactctttcttgagtccttactttttccctctacatttttgccaacaggcacagatgatctctttaactcatattcattatatattgttccctgaccaccaaatttatatttcctaccaggctacagtttttaacatgagagttatagatcctacactctgtgatatctttaccttgtctcacaggcatatcaaatttatcagtggtttcattttggagacttccatcaaccttccccactccatactgcaaaactgttcatcttttgaatatactatcttaataaattatattcattctactaatttactcatcccagaaacttggttttatttttcaagagactgagtgtattagtctgctctcagttagtcaagacatacccaagactgggtaatttataaaggaaagagctttaattgactcacagttcagcatggctgggaagtcctcaggaaacttacaattgtggcaaaagaggaagcaaacacatccttcttcacatggtggcagcaagaagtgcctagcaaaagggagaaaagccccttataaaaccattagctctcatgagaactcactcaccatcacgagaacagcatgagggtaacaggccccatgattcagttacctcccaccatgtccctcccacaacacgtggggattatgggaaatacaattcaagatgagatttgggtggggacacagccaaaccatatcattctgccccagcccctcccaaatctcatgtcctcacatttcaaaacacaattatgcccttccaacagtcccccaaagtcttaactcactccagcattaactcaaaagtccaagtccaaagtctcatctgagaccaggcaagtcccttctgcctgtgagccagtaaaattaaaagcaagttagttacttcctagatacaatgagggtacaggcattgggtaaatacagccattccaaatgggagaaattggccaaaagaaaggggctacaggccctatgggagatcaaaatccaatagggcagtcattaaacgttaaaattccaaaatgtcctttgacttcatgtctcacatccagggtgtgctaatgcaaaaaaggtgggttcccatggccttgggcaactccgcccctgtggctttgcaaggtacagtcccactcccagctgctttcattggctggcattgagtgcctgcagctgtccttggatctcccattctggggtctggaggatggtggccctcttctcacagctccactaggcagtgcccttgtggggactctgtgtgggggctccaaccccacatttcccttccacactaccctagcagtggttctccatgagggctctgcccctgcaataaacttctgcttggacattcaggcattttcatacatcctctgaaatctaggcagaggttcccaaacatcagttgttgtcttctgcatacctgcaggaccaacaccgtatggaagctgccaaggcttggggcttgcaccctctgaagcaatgggccaagctataccttggccccttttagccaccactggagctgaagaagctgggatgcagggcagcatgtcccaaggctgcacagagcaagggatccctgggcgtggtccacgacagcatttttccctcctaggcctccaggcctgtgatgggaggggctgctgtgaagctctctgacatgccctggagacattttctccattgtcttggtgattaacatccgggcaccttgttacttatgcaaatttctgcagcgggcttgaatccctccccagaaaataactttttcttttgtatcgcattgtcaggctgcaaatttttcaaacttttatcctccgtcacctcttgaatgctttgctgcttaaaaatttcttccaccagacaacctaaatcatctctctcaagttcaaagttttgcccctgcctacagattctagggcaggggcaaaatgccaccagtctctttgaatagccagagtggcctttacatcagctcccaacaagttcctcatctctatctgagaccacctcagcctggacttcattgtccatatcactatcagcattttggtaaaactcattcaacaagtctctaggaagttcgaaactttcccacatcttcctgtcttctgagccctccaagtctctaggaatttccaaactttctcacatcaacctgtcttcttagccctccagactgttctaacctctagctattacccagttccaaaatcacttccacattttcaggtatccttatggcagcaccacaccctttaaagtaccagtttactgtatttattagtctattctcatggtgctaataaagacatacctgagactgagtaatttatttataaaggaaagagatttaattgacttacagttcagcatggctgaggaggcctcaggaaacttacaaacatggtggaacgcaaagcaaacatgttctttacattgtggcagcaaggagaagtgccgagcaaaaggggaaaaagtcccttataaaaccatcagctctcaagagaactcaatcactatcatgagaatagcatgagggtaacagccctcatgattcaattacctcctaccacatctctcccacaacacatggggattatgggaactacgattcaagatgaaatttgggtggggtcacagccaaaccatatcactgagccttccctttgccatcactatgtccaaataaaccactaagtttagtcagttttttgttcaaggagacctcaaatttcttcctttcttttcatctccactgttgaatactctaatccaagccatagcatattttacctggaccacaacaataaccctccaagatgtaaattccatttgtgaagtagtggcagcatcctgttatttagaaccatgccattgcaaactggatgcataattaacatgttagcttgtctccctattgccagttatgtttcacccctaatccatttaccacatggcagatattgtgatatttaaaattacagatctgatcattttattccattaccaaaaagcctttgctgcttcctgattgctcttatgatgaagcccaaattccttaatgtgttctatgagcccctgcatgacttcatgcctacctctccagtcttatcaccctcctattgactcatcttcctacagtcataccaacctcccctggttatgacacctaaggggacaatttctttcctaattcaggaccactgaaggtattcctctttatacccaatactagagacttttctttccttttctcctccccagatacacacccacatacacagtttacacctatgtttcatacatcgtccagatctcaacctaaatatcatcttcttatggggtcccttcttcacgagtttgaagtccaaattacaccctctcaagggaccctatactttctttcctatcacaaatgaaattttctctgtgtatgtgtgtgtgtgtgattatttaatgtctatctcccaccagagagtaagttctagaaatcagagactaggccccttttttttttttttttttttaagcactatgtcctagtgtcaagtacattgcttggcacatgggcactcgtgtatgttgcatgaatgaatgaatgtctgtgtgccagaccagagtgaagaagagaacattgtccttgaactataagaaacaccatgatggcagagagcacatggtaggtggcaataagtgtttgaagaaataaaataagggaaggaaagagaaaggaaaaacaaagggaaggaaatggagggcaaaagaaattgagaaaaaaatgagaaaggctgtaaacctaaatctaggattatagtctttgatgggaaaagtttccctgtctctcactaaaaaaacaaacaaacaagaaaccttggataatagctataaaatgttaacatgcaataaagtacaaagcctcttgcttaaataaggaaacatataatttttgtggttttatttaattcatttctttttattatttattttattcactattgggtgacagcataaggaatatcagatggggttacactcagacatgtccctttaagtgtgcactttttaatcagtctttttttttaatggtacaattgaagatgtctattattggggccatcaccacttctttcagtgaattcattgaaaaaatcttggttggttttgataaaaatcaaatgaataattgcttctcgttatcatatcagaaatgcagatgcacgtttggttgacaaaacacactgaatttgttaaaatacttacttagaaaattcagttgaaacgttatggtaccatctaaatcacaaaacttaattcagtaatttccaaaaatacattattagtgactgataattctgctgctttcctctttttttcaccttccattttaggttcagaatgtacctgtgcagtgcaggtgttttacatgggtaaattgcatgttactgaggcttgggttataaatgatcccatcacccaggtagtgaccatagtacctgagagttagcttttcaaacgtttctccctctcaccctccccactctaatattccctagtgtctgttagttccatctttgtgtccatgtgtactcaatatttagctcccacttataagtgagaatatgtggtatttggttttcctttcctgtattaattcacttaagataatgacttccagctgcattcattttgcttcaaaggacatgatttcattctttttttatggctgcatagtattctatggtgaatatgttccacattttctttatccagtctaccattgatgggcgtctaggttgattccaccatgtcttttctattgtgaatactactgtgataaacatacgggtgcattgtccttttggtggaacaatgcattttcctttgggattgctgggttgaatgatagttctaagttctttgagaaatctccaaactgctttccacagtggctgaactaatttacattctcaccaacagtgtataagcattcccttttctccgcaacatctgttattttttgactttttagtaatagctattccgactgatggaagatggcatctcatcatcgttttgatttgcattccttaatgattagtgatattgagcatgttttcatatattttttggccatatgtatatcttcttttgagaaatatctgttcatgtcctttgcccattttttaatggggttgtcttttgcttgttgaattgttccttatagattctgaatattagacctttgtcagttgcaggatttgcaaatattttcttccattctataggttgtctgtttgtcctgttgccagtttcttttgctttgtagaagctcttcagtttaattgggtccctctttcaatttttacaacctagcttttaaaagccttatcaagcaaagtcgtgttttgtttccttcttgcttaaatatatggatacttattctccctcctaaaaaaggacttgcctttgcataccatgatatagaataggcctaaaagtattttatgaactataaatgtatgaacataaatatcaattaggtacaattaatcattttctacttattttcaaaattatagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggtaaatgatatggaacagagagtttctttattgaagttcctggagtatttatttggggcagtttctttgatgacctaatcaacttcacacatcccagatctgttattcttccggggttctcattactttgacttctgattcctgttctagtcttttgaatgtaagactagatacttcataaaatttttccaactccctagatatgtttacctttttgagggaatggtctaacgttcttaataattagatggaaatcagatgttttatatcaatctagtaactcttctagcttagtcttgagaggatttatcttaagatggtaaagaagagaatttttgtcatagtttagaactgaaaaaaatattcaacattatctttgtgtttttttcatttcctttattaatactatataagaccaaaaagatcacagttttatatcaagctccttccactattataacaaccaaatgaaacatttggaagtcttttaaggttagttaaatcattaaagtgaattttgcgatatcattttttatgtaataaaaatgttcctggtcctacagaccattccaaacatgtctgcctaaaagtttatgttttctttcaattgtacatttgtttatttagcttaagtaaacagtagtaactcagatcttacaaactgaaaaaatatataatttcatggagagaaagtgttactttttacccaactaaatctatttagtgtaccgtttttgagttttaacttcttaatatactgtgagggtgagttgctgctattggatagaacccacttctttcttaagtaacttgcttctgatgtgtgttatgaaacatcacactgcctaatggccaatcccagttaacattggcctccttgtggttcaggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatatgtaagtagagtggtcacactgttagcctgatttgtatactttacagaatttttttcccttactttgaacttttttggggactattcctctgagtttccaaaagggaataagtatggggaataaataggatttagattcagtttagacttcccacagagggtcatcgtgtttgaaacttctgtctaaagccaaattttctatgtatttattatcaaggataattgtggatagtgagttttatgtacagacagtagttggtattggcatgctgatcaaagacagcattattattctatagtctgtttctaatcataatgttggtattaattgcttatctctgctgcccataaataggaatatatgcttaggttaattcagttttgcttgtgagaacgtgcctaaaattcaaacttaaatttaatttttgtggatatatagtgaagcttttttttaagtctcttctaaagggagaaattgaagtattttgctaatgacttgatggtaggaggcaattatgacacagatgaacagacataagaactaaacctgctgtaatatattcctcatagctccagttagcacaccaaccaataaggcttagtcctgaaaaaagagcactaataagccctgaggtgatagttttagagaatctacttaaaattgacctgaaaattactattttcctttttccataagtgaccttaattcaggaaataatgcctgttacacacagggtgaatgaagtagatttgaatagccgggagaaagctgagattccatttcacagaattattaatacgttattatctacatcgacaaatttgtaatttcagtagaaattatgtctcttcaaagttgtttctctgaatttctactgaagtcaatgataagaaatggcagtcttagctgggcacagtggctcacgcctgtaatcccagcactttgggaggctgaggcgggtgaatcacgaggtcaggagattgagaccatcctggctaacacggtgaaaccccgtctctactaaaaatacaaaaaaattagccgggcgtggtggcaggcgcctgtagtcccagctactcgggaggctgaggcaggagaacggcgtgaacccaggaggcggagcttgcaatgagccgagatagcaccactggactccagcctgggcgacagagtgagactcagtctcaaaaaaaaaaaaagaaagaaagaaaagaaatggcagtcttctaatgactaggttgttctggatggcttccctttcagtcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgaggtatgttctatgggaccaccggcatgctggtgccctcttagaccctcatatggtccctttacctagaaggcaacaagacttgaccaaacagcagttgctctgtttacatccaaagaagttttaaaaaataaacttctgatatcattcattctgtctgtgttaattgggttgacaaatgaaagactagaaatataaaagattgatttagactaaactaagtgatagcataagttcaagctttaggttatcattttcaaactttagaccctgagaaagtatgttgttacagatataaatctcttattatataaaaatccatctttatttttatcttcttcctagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgagaagtgttctaaggatatggttgcctcagcctgctttaggacttgagtttatgcttttcttaaagcctcttacaaatgggaaacagaaagcagtcctcctaagtagaaagcaaattattcctaccacagggtgttaaaatcaaggcaattcaaaaacaatacatgcattgactatgagccacctcaagatttctacttgtgaaatttacaatatcaattataggtactgcttaataataaaatcctcacttaaaaaaattcttaatgggaatgagattgttttattttcatggttagcaatcagattccatttcaataaaggtgtctaggggctattgatattctttagctctatttgaatatgatgctttctgtttgtgttattggaccacccactggaattttgtttttgctacctggagattgtaagatacctatttcttaaaccctcattgaattgatttagcataacaaaacttggcctgcgtatttagatttttgtgtgggccaaacattccaatgtgaaagtatattttttcttgcatttactctgcttacacagagctgctgttgtataatggccaagtgatggtaatgtagataaagggtaaaaagttgaccatagatggtaaagtgtataatccaggagtatccaaatagacatttacttctttatatgcagcaaaacacatatgtgttaatggtcccctgagctatcaagtaaaagggactcctggctaaggaatgaaattacatatggtttatatagttatatatagttataagagtgtggtactgtgaagataaggtaacaagtttttatgtcaatgccaattttcagcgttcacccattgccccagatacagttattcattctctatcaactgtgcctcaccaatatatttcacattcttataattacaaccattctactttagacctttttttttgttgttattttgactattgcagtggcctcaaatttcgttcctccactttcattcatcttgctcaaaagctacccaccataatgatggaaaattatcttcctaaaatgcaaattattaaacttttgatagatctggccccttcttgcctctcctgtcccttctactagttatccaacgcaaatcatacatttccacacgttcaccatcattttctagtttacacactgttgtcttttgcttactcctaatagtttttctaatacaccgtacttttccctgttttacctgactgtacctacacatttattcctttagattcagtttaggtttaactttttttcggaacacctttcctgattcactatgcccaaactccaccatttcctccagactctccatgttcccaatggtgtgtgtgtgggtgggtgtgtgggggtgtgtgtgtgtgtgaatatcattcatctgtctccttcactagactgtaagcagctggagggtagagcttgccttatatcttgctttctatatcttcagtgtcagcacttagaaaatgtttgagtgactgactcgtgttcttaatatttctcgctttggggttaccatggtcattcctttacctagggaacaagacgtcaaatcaccatgtaacctgatacattatttagctaaaaactgcttcaatgaatattgttgcaacagtttttctacagactaaaggtattataatgtatacctttttttttgctgctgtctgacctttagtctcaaggactagaatgtaactccatcagggcagggatttttttatctgccttttctattctgttcccaacactaggacaacataggtgctcaataaaaatttattgaaacagatgaaactgcttttttttctttttttagctgttacaagcttctctgtattacattgtttctaatcaatggcagggtataaccacagatatgatttgtttaaataaaagaattttcaaattatttagttttatagcatagcatcattttggccaggcatggtggctcacgcctgtaatcccagcactttgggaggccaaggtgggcgaatcatgaggtcaggagttcgagaccagcctggccaacatggtgaaaccccgtctctattaaaaatacaaaaaaattagctgggcgtggtggcaggtgcctgtaattccagctacttgggaggctgaggcaggagaattgcttgaacctgggaggtggaggttgcaatgagccgagatcctgccactgcaccccaagcccaggtgattgatagtgcgacactccgtctcaaaaaaaatatatatatatgtgtgtgtgtgtgtgtgtgtgtgtgtgtgtgtgtgtgtagcatcatttcttttatgtttactttctcagtgggatataccattggcctttgcctaatattaaaatgagcatacatatccattgccagaacagattccagctaacagcaaagagagctacccacacagcatgctacattatataaaatttggagaaggttatctagttcagggcattgatctgcttagatcttttcatcttaaagagagaaaatacaaattatttttagacctgaaatcaagtgctcaactccaaacaacatttctgagaaaaaaaaaaaaaagtacctggaaggaaaaaacatggcagatgcacctactttgtctctgtgtagtcactagaactccatagttacccccagaattcacatccgtcagattcataggacactcctgcagagagctcattacaacaggtgtcattagctcttttacatcctgtgtacaaataagaagagggattgaaggaaataagaattctttgaaatattaaaggtttaggaacatgggaagatcaaatggcaggcaggaagtggtgaagcacatcatctccctgaagggttctgcagtccccaggcccttggcgcagcctgggccaattttagatttttgaggaattagggaacagtagattcgacctgtgattacatgtcagattttgaatgaatggtaatcaaattattagtaaaatgaaattttatgaaaccccagactttaattctctataccatttatgtgtactaattatctttttgcttaattttcttaatttcatgtgtaattgaacattagttatctcttttttgtaaattgcaactgaaaatgtgtgttttgggtaattttaaaaaatcacaggtctgagaaaaagaagatagatcatggtctgaaagcaagggaataaaacacacggtgtattttacaagaacacattcaaaatacataaacaagaaatattgaaagactgttcttatcacaaggaaatcataaatgtttaaggagagggatatcctaattaccctgatttgatcactacactatgtatacatgtattgaaacatcacatagtacacccataaatatgtacaattatgtgttgatcataaattttaaaatggaaagattaatatgaaatgcagaaaataagacattctaaatgcataataaagctataaaaatatatacaaaaagcagttgcttgcatggtgcagctgcacattagaaatgtgcttgtaattgaaacgttcatttttatagtattcaggaatagtgtgttgatcaaagaattttcattgtatctcagggaagactgggttgacctaacttatagattacagagctataatctctgtaatcagaagcaatgtaacaaaaatatgcaggtctgaaatggacatatataaccaggcctcacttcactgcctaaaccaattacccagtgagtagcagccacattttgaagtcttttcaagtaaggaggctcaagctgaatgacctccactcacctgttcccaccccttatccctcagtaattcctgacaatcacattacgagaccaagggtgcttaagattagtcactgtgataccagacagtcttgctggcttcttcacttgttatgaaatatttaaaacaaaaactttaagacagccatattcattcagaacatgtataaactataaggcatggactatccagtgtttcagaggtccgaactggttttctgttttctgctataacataggttatttattcattttcctcatgtgcatgtttgaataagaagaaaattttgtggtgtaaatgtatgtatgtttgtgtatgtatatacatgtttgtatgtcatgtatatatacataacacatactgaatggtacagggattgtaagtattaatgttctacaatattagattacacataaattatgactgatcttatgacagaatagaagccaattaactacaagttatatttttagtgcaaattcatttttctcaaacactgtcagtatttttaattgagtccttaattactttgaacatgattttaatttactactgtctagaaattagtggtgttaataatctcatgtgtcataggtaagacaggtaaaattaccacttcaaagctttaatgaacaaggaaaaatcataaacttctgtgtaattacaaatgtgcaatctaataaaatacatcagaactaagcacactgctttggaacttcccatcaagactttctgccttgaatgccatgaagttatcttacatgcatcaaatcacctgtttggccttcactcgttatttctcaggctgctcagaatattgacctccattaacagttggccaaaaaggttagctagaaggccaccctccattgtgtatttctgaggttgtcattatgagttttaatttatcatctaaagaaatatgtcctaagatgaaaatgttaccattacagcttgatctctcaccctcttctcttgtattatttcttaataggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaataatcattgtatctttttattcatatccttttttgagtgaaaaatgcttctgcaactaagcatgtgttacagcagggggcgatgtctccaaggataaaaattacccaaacgaaaataaaagtctgcctctgacaggacagcacagaatctagatgtttcattatggagaaaagataaggtttatgaaactttcaaatcaggacttttaagtttggtcatgcaagagtttttttctttttcaaagaaagggaaagtaattttaattaaaatttgggagagcttattttctattcagttggatctaacaagccttttatacttgggtttcaactctggtttctttatatgtaaaaaatattaaaagaagaattttttcatggaaacttatcgtgagacagaaagcaaatggggaatagtggtagactcatgcttcctaatgttagcaggccataatactttctccctcagtctacaattatttctgtcatagtgggagttgcagttttctctgatacatacccagaataacttgacttttttttttttccagctcctgtttggccaatagtacttctctttacattccacctctccactccccaccaccacacacacatgcacatgtgcataccaagcatacaaatttactccttctgcactatgccttcaaccatgcaaaagtaacttttggagcttggatacgtgtcaccttatctaaagtaatctaattctgcatataattttagaagctaatatcacaagtatcattactgtctataaagatcgctttatggttgctcatatctttatcttaaatggcaacaaatatattttccacagcatattgtccacaaagttgtacaacttaacttttcccagacatggctaagtgagaataaactgaaacagaacccatctgctactaacacggccaatcccttaggaaatctgggttgctcttgagacatactagccttcatatttgttgcatggtacctacatatctccctttcctccttcctttttttttttttttttttttttgaggtggggggggcggcaaatgagttagggattattctttcttttcattgactagctgaaacttctattactgaagtcttcaagcatagatttccaaatttgactttgaagtatttcagcccaatttcaccaaaggcaagggattcatcactgattcattctcaaggaatttccaacacatagcgtttaagcttatacaacttcaccgtagttaccaaagagacaccaacacccaagatcagtattcagcctttgtcttgagatgccttggcatatctgaacttgtcttctgggtattcacttaattctttggaaaacttgggtttccgtcaatgtctctataaaaaggcactttgccacaatttctcactcatctgccccttcttgacctctgctgatttaaatgcttgccgacaactttgatgactgtaatgaatgcccacatgtatgcaaaggacccactgtgctggtttatgtgtatgtgctttgaccacacaaaacacattctggctcgattaatagattaataggatcttttttcatatatttagttgatgcttaaatagctttggctaattattttgttctttcacagagaacttgtcattgtagcttttatttgatctgataatacaacttgaagcactcaaaataagatgccattaactttttatacttgttttgaatggcatcttatgatgacatttacgaaggctgctatcaattttttttcagtgatactcctcaccagggtatcttgcccctcagccaataataaaaccaacttgtatcctgttatctttacgagagtcagacattagtgaatacagagactaatattacagttgatttctccataaatattgatggactgtgaagacatcatggtatatagttccagggagagctggatttaggaatctagacaagacactttttgccacatcccattgattct

SEQ ID NO: 16331 - DNA, 40408 bp, Human
cacgcctgtaatcccaacacattaggagactagggcaagaggattgcttgaggccaggagtttgagaccagacagggtaacagagtgagacccccgtctctacaaacactttttaaaaatattagcagggtgtggtggtgcacacctatagtttcagcattctatcaggaaactgaagtggatcacttgggcccaagaggtccaggctgcagtgacctatgaatgcaccactgcattccagcttgggtgacagaggacaccctgtcagaaagaaaagaaaaaaagaaaaggaaggaaggaaggaaagaaggaaggaaggaaggaaggaaggaaggaaggaaggaaggaaggaaggaaggaaggaaggaaggaaagaaagaaagaaagaaagaaagaaagaaagaaagaaagaaagaaagaaaagaaaggaaggaaggaaggaaggaaggaaggaagaaagaccctaattatttgtttattcataaataagcttattttaaagcattccaaattttttaacttttattttaggttcaagagtacatgtgcaggtttgttaaattttgtgtcacagggattcgttgtacagattatttcatcacccagctacaaagcctactccccaatagttatttttctgctcctctccctccccgacgctccacccctcaagtgggccccagtgcctgttttttccctatttgtttccatgagttctcatcatttagctcccactaatgtggtatttgggaaaatccaacttttgaaagatctttagtctgctaatcatgaatggccaacataattacaggcatgccaacatttgtaacattgtgacactttccctgccattcttagttaaaactgatcttttgttccaaaaatttttgctaccaacaatagcctgtcctttatagttcttttatacttttgtgtcttctctctaactaaataatcaactctttcagcattccatccatttccctttctcctccctcttactcccaacccacattcccctctccattttaattttaacctgtgccccttcaagtgtactccagcttttttttttttaaataatttcaagtgatactttgacttttgactgcatatggaagcgtaagtaacatgtcctttcatttttggataatgagtttcctgattaattacagctcaagagtaaaatgactgattactatttaattcattttgtgcttctttacaataaagtaaagacagaagccccagattcaggaacagacaaaatactttaatcgctatcacattttttttaagtctagtcaattagaaaagtcaaatctttcctcacagccaagcacattaaaaaaaaatcttctctggtaataaacttgaagctttaaataattctacaattataaacattttgtgtattttgcaaatatggcataacctgttggcataaaattccattgttccagaaaatatcggtaataaaattatagaaaagttaaagatcttcatttcttatttcgaagcgtttgggagacatttcagaaacggatgggaaatgttaaattctgcatgcctgcttaagtttccatccacaccgactagatgtaaacgagtgtcaccaaaagtacaccacaggcacccacacagattccttccataagggatccacaaagtttagatgtgaaatgtacctaaaggttcctagccgtctttcatccctccctctgtgaaacagggagacacatgtgttttaaggcagagatggaacttgggcgatgggcggggggtgggggaggtgggaagggacggcttaggacagggcaggattgtggattgtttctgccgccttggttgcccatactgggcatctctgcaggcgcgtcggctccctccacccctgctgagatgatgcactgcgaaaacattcgctctccccgggacgcctctcggtggttcagagcagggaaaatgttgcctcaggtttaaaataatctgcccaagcaccccagcgcgggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctcgggagcccctgagctaggaggacacggaaaaggggattggggtcctgagattgggtctgttgggcccaggacgcgttttctggatgggtctaggatgctcccctgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcaggtgagactgagttctaggacatttagggggtctggtgcctggctccgccaaaaatggggactttcgggattgtgatcatcacggcggattgagcagggagagccgtggagggacaagagagggccgaggcagggtggggggcgcgggcaggtgcgagggggatgcggccaagaagcagcgataaagggaacattccacgggtcgggcggctgctgttggatcttagataaagctggaagggattaccggggcaggggtaatagggaccggggacgggaacgcgaaacaggtgaagcgctcagggcgagagcgactcggcttagggagtccgggagaagcctgcggctgccccctcgccgccgaggtcctgcgggtcctgcgggtcctgcgtgctgagccggggcgtgcgcgggcgggggccttcggaccgcgcggcggggcctgccctgacccctggcggcgggcgggggaggcaggcgcgccctgcagagtacagaggggtgtggtgtcctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaaggtaagccaaggcgaccaacagggaagggctgggacagctctcctctggcagttagcccgtgcatccttctttagcattgccgtgtacgcacaccccaccccgccccctacacgcgcacacacacacacacacagagttttgtgggtttgatgtgtgggagctcccgcagtcggcagaaacgttacatctcccttcccccatctccccccaatagttagttcagctgaaattcagctaaagtgagttttgtagaagttcctataactacacttttatcctagcaaatgagcctattgacctcagcaacagacggcccatactccttgggacggtgagatggttcctatccattcccaggttgaaagtctagtgacaggtccccactgcacgtggcattaagacagtcagataattgtgtcaggtcttgtgctgaggatgagtcagaatacaagatgggcatgttcccccaactaaaacgatgggaagtgattttcttaaaaatactacagtggatggaaatgcctaggactaaagacaaagaaaatacgtacttattcatatacatatgaaagttactttaactagactaacaagtcacttgtgcacaactaagcaaatttacaaaaccaaaaacaatgtatgcctcttggtttcttctatctatggacacctgcacttagatgtggaaagctgcttcttttgtagctacctgggtcagcctgccctgagctaatggcacattcaggttggagttccttttcatactttcaggatgtgcttggtgagattaaaaataattggactgggttattggccagacttagatctgactcagtggtcagttttaaattatcattgttattagattttgacccttttagccaatctagtgggaggaatttattgcctaaacacatctggattgggatatcatgggctagagccatccttggcaaagggttttctctgagaaatggagggctaaggaaaaatcctggctcagggactgcagtgtgaagatctactcctatacaacccccagcaatcaatgaggcggatgagcaatttccacccaccacgcctgctatctatggatgggaggagctatagttcacaaaccgtttacattcatgaataatatatttcaaaaggggaaacagtttaatctgtaactggaagggaaaaaaaaactgtcagaattgactcccttggcttcctggagtaggaaaaaggaaaattggagcatttgcagctttttttgactagctggattatggaatatttaaaagcaacagcaacaaaagtaccttataaactagaaaatagaattgctaaaaaaactatttactaaaaacattaccttaaagggagaggatatttgtgttttcccccacccccacccttctcatgtggctttgaacaagaaggagagttgccaggaaaagaggcagatttcagagagggctggcttcactggatcctccctgttgttccactgcactgtgagtgagattccctggagcaagcgaatctcccgggatgagtcagagaggccaacagtgtggatgtgggtctccacacatagcatgactaagttgagaaagaaaggccccactgggaaaagagacttcaacacagatggaaaaaaaacataacaggcttggaggaaatagcagtttacaaaacagcatttcaaagagcaagtgtggggatcctcaaattaaagaaattaaaagaaaaagctagagcaagctcctgctagcctaaagaaaccaaaccctgactacttgctcatagaactgtgagcaaaacaagacagtcaaaccaaaaaatccacctagaaaagaatttggcagtctcactcagatgcctggcctagaggggacttcagagaatgccctacagagagacaccaagactacaaatgcaaattctgcccaaagagtgcctggccgatgaacagggtcctatctacatcttatggagactcctattttataaatatgtatcctcaagtccaagcacaaacaaaataacagaaacagggatgattctctcccagtttccatgacagtaaataataaatttccctaaattttactttcaacaacatagactttttttatttttatttttatttatttatttatttattttttgagacggagtctcactctgtcacccaggctggagtgcagtggcatgatctgggatcactgcaacctccacctcccaggttcaagcaattcttctgtctcagcctcctgagtagctgggactacaagtgcacgccaccatgccgggttaatatttgtatttttagtggagacggggtttcaccatgttggccaggctggtcttgaactcctgacctcaagtgatccactggtcttggcctcccaaagtgttgggattacagatgtgagccactacacctggccaacaacacagacttcttaaaaaaatcatgacaataattttgggtgcttcttaaaagcacccaaagctttactgctaatgcatggtagcttaaaacttcacataataagaaagaaccagtggccaatggaatctactgttaaaggtacccaatcaagtaaggaaaagttggtcctaaaagcaagcagccctgtaaaagctgctctgtccaatatggtaatcactagccatttgtgtttccatttaaatttcaagtaattaatatcaagtaaaatttaaaattcagttccttagtcacactagccacgttgtgagtgtgcaacaggtaaagctagtggcacagacatagaacatttccatcagcacagaaatctctattggacagtgccagattagggtgttctctgcattgtaaaagcatccccttgccaagttaaagaaaacaacaacaaaactctagagaagaaatgaaaccccagtttcatttctggagaggaaagaaaactcatgtgtggcatgagtttatattcaagaaggtgcagcattattacctattttactagtaataatgacacacattatagtatacaatccagttccaataaaattaatttctcatcttactaaaagcttgctgctccacattatgagacaatttacccaaatatagacatttacccaaaaatattaagtagcttgtgaatactttttaaaatttcctttaattaaagtggtcacaaactcaaacccttcattctccctctgagatttctgtgtcatcttttgttcacattgttattcacatgtttattatgtacttattttgattttctagataaataaaatggcttcaaatctataattctgataaaattagccatcaattaatttatttattaaacccatgcaatatgctagattagatgctttgctatgtaattcctacaataaatcctagcaatcacaaagattacagttagtgagacgacatgcacacaggtaaaaagtgttttaaaaaaatacatacatacaaccaaaacagtaagtcactgctacatggaaactgattggtcctttttccttttttttttttttttgccttgactgccaggaagcagtttcaaatctatagctggattttaagtttcattaattcatgttcccacatatggttctgtattttcacttcccccttttaactgacatactgtcttatgtgatctctactgtaagccttctcatcattttggaaacagaccaaatataatatatatgataaggaatcaaaagtaaatacagtagtgttgaatattgcataacaaaaaggtttttaaatagggaatggtatcaatatgaagtgttagggagacccagccatgaaaaggatagcagggtcagagaaggaggatgtattgcagctggtttaatggagaatggtatgaaggaggtgcagtttgaattgggtcatggaggacagatggattgcaaatagctggggcaaaagcacaggaaggcattctaaacgagccaggcatggagacaagaatgtctcccacaagggagttgtagtagctcaatcagactgggatttgagatttcatgtggcagagtggtaggtgataaaggtgaaaagactgatcatagtaaaatgcggagtctgtaaatccagcactcatgataagtttggacatcatgtcaacagtggacagccataaatgactgcaagcatcggtgtggtataatgaaggtgacgtttttgtaaaatgactctggtgaaggtacagaaggtaatgaaaagtagccagtctagttgagcagaaaagagttcagatgtaattgcatcatggtccagatgtgaaatgaagacaatgcgaagtggcattgtggatcgaaacatacatgcacaaaatgacagaattttagaatttgaagggatcatcatggttaccaggctggcctccaattcctcttttgtaatattaatagaaattaagggctaacaagtttaaaatgttatccatctttttacatagttactgcccaaagtgaatattttgaaatgtatcattaaagaagaatagataagattatgtgattcaccatggactattgtcatgagaggaaaaatgtgtttagatgattctgttagcactgagacaaatcaggatatctgaaaggaggtctttgttgaaaaacagaaatatgcattcataacttgcttttctaaaattggaatgtaatgattcttaaatatgcacagacacaaatttttctttaacagtcaagaaaatgcacgcaggtgataatcagatcagttttggttatagtacaatggtttaatgcctccgtgatccctttcaacttgaaagcattctagagcaattggtgattaatatcagtataacagtcatttataaaattattatttatttgatatacatctaatcaaagcataagatttatttttattattattattatactttaagttttagggtacatgtgcacaatgtgcaggttagttacatatgtatacatgtgccatgctggtgcgctgcacccactaactcgttgtctagcattaggtttaaaagatcagattgtctcggcaccatgttaatatctttttctgttggcattagtattagttttgcttgtgtatttgtttaggagatagcttcacaagttggtgattgatattctaccatgtatgaagtcatgcgtggaattcagaatccccagcttgtaaaattgcattatgatcatctttagtgggaaattgttctcagaatactgagcaaaggatgataccaaaatggcagctattattcattcttaagcatatgaaatgctttcaggttcaacccaaaattacatacattttaaatgcttactaaaagagtcttttccctcctccatctattaactgcaatcaaaaaacttcggttttaactgaacatgatttcatattatttattaaaatttaaggcaaggtgcaccaagtacccttgaattatgaaaagcttcatgatgtgggatattctttcagttaacggcagggttggctacacttttaaggggttcaaagtaggaacagctgcaatagtgagctgcatctggaaagtccagtaatttgaaaaaccacctgtttatgtatcctgcccactcaagtccataaaataacagacactttcatattccaaatgaaactgctttttagtttgccctacttttaaacataactctttgtgatggaatgaccagaaacagctggtctctaagaggacagggctatgtgcgctcacctgcggggttggaccttccataatccccctggctgtggggaaagttgagggctgctgtctttatacaaagatggtttattccaagatacacacactcttcttccacaccctggagaccttgcatatttagtatcttctttaccataatctgaggccctagagaaaaagatttgcaaactatacttgttttaaaacaactttctaaaaaagacactctcagcccctagaaattatgcctaacacatagatgctcagaggcaacctgttgtagtgcaagaggattgtgccaagattagaaaacaaatatttgcaacttttgtaactgtcttctctaaaacttgaatgtggtgattctaaagtaaagaccgacacaaaattctttttctttagcagtcaggaaaaggcatgcatgaagtaatcagatcaggtgtggtttcagcataatggcctaatgctttcatgatctctttcaactggaaagcgttctagtcccactggacaccaaggaggaagaagggacggaaaatattaggcccataggtttatcttcctcagtagtccacgagatttgagcttatatgtagggagcaaaattgtttgtctaaaagcagttaataaatgccccaaaaaggctgggcgcagtgactcactcctgtaatcccagcactttgggagctcaagattggtggatcatgaggttaggagagcaagatcatcctggccaaacggtgaaaccccatctctatgaaaaatacaaaaattagctgggtgtggtagcgcgtgtttaatcccagctactggggaagctgaggcaggagaatggcttgaacccaggaggccaagattgcagtgagccaagattgcgccactgcactccagcctggtgacacagcgagactccgtctcaaaaaataaaataaataaaataaaataaaataaaataaaataaaataaaataaaataaaataaaataaaataaaaataaaatgaacgccccaaaaatattttgggcaaactattttgtgtttcttttctttatttatttatttcttttgagacaaaatcttgctctgttgccccggctggagtgcaatggcacaatcttggctcactgtatcctcaacctcctgggctcaagcaactcctgagtaactgggaccacagggatgtgccacaattcccggctaattgttttagccaggatataaatgctgcctacatagagtttgtagctatctccttgactttctttatgcagattccttcacaaacttttgatggattcctttaccaaattctactgtctgttaaaatcttctatctttatatctttagtccaaacaacacgtcatttataaaccttaaaattgtttctgggcaaataaacaaggcaaaataggaatatatatttttaggcaatttacttctgttttggtctcataaaaaattgtaattaaattgtagaaaatatttcaattcctctctaatatcctctcctcacatactggctctcaacttctaatcctcctattgaaacattgattgggaggccaaggcaggtggatcaactgaggtcaggagtttgagaccagcctggccaacatggtgaaaccctgtctctactaaaaatacaaaagattagctgggcatggtggcatgcacctgtagtcccagctactttggtggctgaggcacgagaatcgctttaacccgggaggcagaagttacagtgtgccaagatcaagccactgaactccagcctgggcgacagagtgagactccatcacaaaaaaataaaaataaaaattgaaatttgcagcctttttaaaaccccatagcctctttataaacccaaaagcactatcaaatttggcgaggtgtcaaaagaatcagaggaatgtttacaaatacagatgcctgggcccacctcagatatatatatatatatatatatatatatatatattttttttttttttttttttttgagacgatgtcttgctctgtcacccaggctggagtgcagtggcatgatctcagctcactgcaagctccgtctcccgggttcacgccattctcctgcctcagcctcccaagtagctggaactacaggcgcccgccaccacggctggctaattttttctattttttagtagagacagggtgtcaccgtgttagccaggatggtctcaatctcctgaccttgtgatccgctcgcctcggcctctcaaagtgctgggattacaggcgtgagccactgcacccggcccagatatattaaattagaatatctagaggtggagcctgagtatctgtatttttcagagtttcaaatgatcgttcttcaaatgattacactgtgaagtcagatttagaaatgactgtacccaaggttggctaaaagatacacaccctggttgattctacctgaagagagcaaataagatacacagcaaagttgtagatgttttccctgccagtagaatacttgcgggttaggccatttaaaaccctgccagagagttttgaaacactgtggagggctcccaaatcaacttgctcaatggttctccatcccttcaggctacttgggcttaaagccaactgcaagcttagagcctcagagtgacctaggaatggggtgaccatatattctaggttgtctcatacagactagccagcactactcagccgcaagtaatagcatccaggcatgctcagaagtgtcccatttggaggaaaaaaacaatattgtcacaaatgaattggcaatggcctgtctctgattcttatacctggaatatactggaagtccctactcatgctattttctagcagaataggcaaaatttctacattccaggcatgtcaggcctttccctgattcctttctctaatgtcactcgtctgctgtcttttatcacagccattaaactgcaccctaacttaaagaggatcccttatgttccaatctactcatccctcagatctttctttctctgaaacacagggttaatgagactgacatccttccatcacatattttctcagctactcagtaaaagatgtaaatgtttaaaatagtttaaactatttttcagttagtccaggaaacataaaatggcatgcttgcacataaaccattgtttagggtgggggaagtgtttttaattttgccttaaaggaaatctgcatgatccacaggctatgcaactaccaagggaattagttggtagaacagaattacacctgcacagaatacaaatttcctgcctttcatgggaactatgttgatgtttcagatatgaaatacatcttgttttctttattgaacctcgagaagatgtctcttgttggtcattatttcatggcaggggaagtacatattcctaaagacacaaccgagtttccctttaaccatcattagttgggctggccattaagaaccagacgcttttattttcaaagagacttaagttttgatgttgtacatatgtgcctaatattctatctcatagcaatttaaaggtgacgttttaaaaagctgcattcagtgtataaacttctcctgatcccagcaaggatgttgtgatgattttatttaaaaaggtaagttgtgtctagatatggcagtgggtcatctcatgcatggtgcagatgtcaaacacaattacattttcttatttgcaatgactaaaaaaagaagctgagcccaagcagtgagaaagtaggagattgggaggacaagaagcaaaggaaaaaagtaacatgagcaccgttctccctgtcctgccacttgctccattatggactgggctgcgatatctcatatcccagctccacaactcccaacaaccatttatgtgcatggtgcttccatgtgtgatgacccaatcaggctcaggtgtggactgagtagttaaattataacccttgtctctgaagagtttagggcttagtggggaaacagacatgtaaacaaacctgagtgaggtcatgtaatcaaaggacaggccacagtcaaccacaaagaagagagttctcagcagtctccaaagccgaacatatgtttaccaggaacagggtcccagcagagggagcaacaggagcaaccagagccttgaggggtcgtggcctgttctgggcaccagcagtggatcaatgtggccagagccagggatactagcagaagccagagcagcagggccttccttgtccagcaaaggcatttgtctctttgtaggccacagcgacccacagagggctttttaggccagaaaaaagccattaaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagccattaaaaagggagtcatgtctcttgttggtcattatttcatggcaggggaactacatattcttaaagacacaaccatttcctcttaatcctcattagctgtgctggcaattaaaaaaccaaaagtttttactttcaagaagatttaaataacttctgagggtgtacatatgtgcttaatattctgtctcacagtaatttaaaagtgaagttttgaaaagctgcatcctgcgcttgtcagaaccatgtctgatgagatatcccctttaaagggctctcggtgcaatggggcaaatcaagggggtttgtgcaagtgggagtgagacaggagatggggtgcttcttccagcactccctataggctgactgggtgacaaagatcattttactgacacctccaatggccctatgagatgggtactattattattatcaccatcatattccttttgcagataaggaaactcaggcttagcagattgccagaacaacacaggcaggaagtggtagagtcagggtttgaacccaggtagtgaaactccaaagcccggattcttaaccactgtcctccagtgcctctctgtaataagtcatgatcccagaagccattggtgtggccacaatatggaaagagatgacagtgtcctcacactgggtgagcagcttatggtgattccagacatgatctctgttgggagtgacaggtctgagcttctaggatcagaccctagatcttggcaagtggtttgaggaaagagaaggaccaatgtaaaaccccaggcttcaaggaatgtggatgctgggcagggaggattaagccccaaagaccagaaatggggtacacagggcaggtgtggccagagtagaactagagtagaacttccagtgactagaaatagaaccagacacgttgcagtggtggataaggtagaatcgcttaagtctttaaagtgcccctgatcacccaagttggccagagaccctggggtggggctgattctgtctggatatacggggaggggtaagcatgaggaaaggaagcaggtcctgacaggtactttgcactaaacagctccttataaggttctcaatttgcctgctcaatttctacagacatttgtgggaccacaccagtacattgtaaaagcaggaaacaattgagaaaaacctgagttttatgttggtaggagaaatgcctatggaatatggcaaatcgtttctctgagacttcctccctagtaattacatatttgttctcaaaaacaaatgccagaaggaagaagcagatttaatagtgcattttacaaggcaccattaatctctaagaagaacaattaaaatgtctcagcaatcatggttcactgtatatcttttctatcttcttagaagtaatatatggctggaaatgggcataccaaaatatgtcaaggaagtggaattgcgttcattagatttcaccagtaattattttagttagcttcacagatctctcttccttgcttgttcttgagagcgaggctttttagtaggaagagaaattgtctaaaacgattaataaccacaaattcaccaaactattttgggtaagtccctctatttctctaggtctaaagctaggaataagagtcattctcatataatgtactgtcccagaaagggcattatattagtctgttttcacgctgctgataaagacatatccgggattgggtgatgtatttaaaaaaagaggtttaatggactcacagttccacatgcctggggaggcttcacaatcatggaggaaggtgaaaggcacatcttacatggtggcagacaagacagaattgagagccaatcaaaaggggaaaccccttataaaagcatcagatttcgtgggacttatcactaccacaagaacagtatgggggaaccgccaccatgattcaattatctcccacaaaatgggaaaattatgggaactacaattcaagatgagatttgggtggggacacagccaaaccatatcaggcattcaaccaatatttgggaagcaccagccctgcaccaggcacggagcacgtcatgagtcctgccgtaccacagcctgcctgacagacctcagtcatcctctggagcttgcctctgacatctggacctcctcagaatcagcatctcttctccttgcccccgccatcctttgtttttatctctgctgtggcattcatcaaagccttccaactatcctgcgtcactgtccttcagtgtcctctctcctctcccttccttctcaccccactttgtgcctgtatccttcaagcagagcaatggcaccctcacttctgtggctgcccagtgccccatgcagagtcagacatcagaaaatagatgctgaattcagttgacactctgaaattctttttaaagtaagttaatgtgtgctttgaatgaaaagacactgggattacattattgagtgtctttcttcctttgccacttttgtccctattggccatatttgaaaatcttgttggaaaaaaaaattcaagaacttaataaataaattcaaaaacatttagtctatttacttaggtgaagagaaaactcattctaatatgtgtgtatatttaaaatatttgttatttagactttttttttaagtctccaggttgaggaggacacaaatatatcctcctaaaccttccagtaagcaagctgtggcatccagatgatctcctgggtcatgggggataaggctaatctcctaggtgtctggcagacaggacaggcaaattcccagaatgccaaaatataccatctgctgctgtttggcattgcccttaagtccagagtgtggaggctgggggtgggtctctggctacaggagaactcccctggcaagggaggggtgaaaggactgcctgttgaaccccccatctatccccgcactatggcaagattgagaggaatgactagatcagggaatggcccgaaagaaaaatccaaaacctcccaaccctggacaaggccacagctttgagaaaccgaagcctctgcttccttctctttggctttactgcttctagatgcaaatacacagagctctgagattttgtgtgctgggaggtgataactgttaaccctctattccaatagcacagaaatttctctttgcctcagaagtggtttctcatagatctcagatctcttttcaggaaaaagaaaaacaacaacaataacaacacattaatgactctgaaagagtcagacaccattaattccattattggtgtctgtgccaagtgaaatgaacgtcagctcttttcccagatatgtttccttcttttgcctcctataataagagatgattttactgtaataatataagactcatcaatttgactccaaatagctttcctatcaacaggctaagtgtaaaataccaggatcattattcagttgagaatagatagaactaggaagtagccatcaaaaaagaatgatgaggtgcattgtggatttggggtgtaacttggtatctaacatacagccagaatcacagtcatagcacacttaatattttatcagaaacttgcgtgaacaagttaagaggactctcaacttaaaaatgacaccaattgcaatgatcttgttaacatttgtgatgaaaataatagcaaagtgacttagacaaattacaatagcccataaaaataagataaagtttaatacaaagtaagatgatgttaaaagacttgaaataaaacagatatgttaagtaggcaacacataggtaagcatataaaaacaagaagataccaggatagagctgtcatttttgtgggagcctgtgatgtggaaaaccaagatgcctggtgagtataatggatatggaaaccccccttgtaataattccacagttccaaggggccaaggtctccaggttgagtcactattgtaaacacacccatagatgaatccacatgccatacctccttgagtaagtggggactcaaactaggtctgtcaattgttccagaaaattaagcatctaaataatttaatgataatttaaaagaagcacaatgaaatatttcaaggaatgtcacatacaagattctgtacctcttctgctttggttagactcattcagaataggttcctgctttgatcttaagagggaggtagagattctggagaagccctagggaagagcaaaaggaaaggaataaggagccaagaggaaacccagggtaaggctgaggagggactgtttcgtgtaggtgatttattggaagggttggaaggaaacatggaatgacaattacctttggttattgtcaggttagtatgagacttacaagaaaagcactgctcagacgcaattaccattcaagataagaaataagaggaaaggctagcacacttagctttttatttaaaaaagtgttaggtaggctgagcacggtggctcactcctgtaatcccagcactttgggaggccaaggtggatagatgacttgagcccagaagcttgagaccagcctggacaacatggtgaaacctcatgtctacaaaaaaatacaaaaattagccaggcatgatggcatgcacctgtagtctcagctacttggggggccaagaggtgggaagattgcttgagcccaggaagtcgaggctgcagtgagccatgattgtgccactgcatgacagcctgggcaaccgagtgagagcctgcctcaaaaaaaaaaaaaaaaaagtgttaggtgacatgagagaagatcttccaagtaataagagtggctaatcccaggaatgtgtcaccagaggttattttgtaatagtcgtgtgttaaattccttatttgtctatataacttctcaaatccttctgcctctacagttatagtttaactggcgcataacagccttcacacacagcctcataattaaacatagacatacatatgaacactttcccctatgccagcaggatacttggtttgtttaggggcaaagaggaattgatgtggcgttgtttcaatcagtggttgaaaatgcaagtggtaaacattgaaaaatagaacactgcaaaaggcatgcattgtatataccaaaaggtcagcatgaagcattatctgtatggcaagcctgcccatccactccctcctacacgttgcatattcacacagttttgcagcttgtataaacccctattgtgatagaaactcatgaaagagtgtggtctctgcgaaagctggctgttctgtgaatttagaccagtggttcttcaccctggctgcaaatcatctggggaacatttaaaaacactgttttaaacaccccaaccctagaaattctgatttaattggtctgtggtggggcccagaactctgtattctttttttaaggctctcaggtgctgctaatgtatagctaaaattgggtctggtttagactctcagaatttcttaataattaaacactttatcatgacaagactttcaggaccttaaaggccacagtggggtagttatcatttcactaggtcctcatctggggaggtccttggcatttttactggaatatatttgtcactcaaatttctattacaaaaaattctttcttgcacactgctttagcaactacatgagatatactttgtacatagcacaaatctcatatcacttatgtaatccagctctgtggttccttcctttcctttgcctgtttatttttaattcttcccaagaggaagcttagccagttagaacaccagagtatcatccccctcccccttttcccacctgagttcatggcttagacatactaggaatgaagctgacaacatgcactagtttttttcgaaattatgcagcaaaattcccaaagtgcgagtggccacagagatcttcacagggcccagggacaggcagacatcattctttctccagttcctggcacagaaaagagaccttaggttactgagaagataccagtccctcctcagagcagacaaggaaactgagcctcagaatgaaagactgaatttcagtcctttcttgaacatggacctccagggttatattgggccttggaaaaggcacttacactctggactgtagtttcttcatctataaaatcaagaggcagaaacagacaatctctaagttgcctttatttataaaattccgagattctagttgaccagtattcatacaagagttgaagcctgtaagagtgcagaaagcccacacaaagagacagtggaagacctctcatcagtagtatttttattaccctcttcctaggttttaccagtcaacatcctcactgttaatatacagaccgtggtatttaattaaatcatctttgaaatactgagctatcaacagatggcatgctgaatgcaaaaggaccacaaataaatatttggtactgaagaagatcaagagttggagttcatttcccattctgatctgggctcagaactctgtggtcttccctctaatcatccttgccaccaaattggctgtatctgttctaagatggatcagaaaatcagttccaaagttggctacaaactttcaggtttgggttttgttttgtttttttgttttgttttgttttgtttttgcaaccagccaattcatcttagttcacatgacagagaagtgcataattacttgcaactttagttagagcagtggccttaagaaggtctagctaaataaaaagtgctcagactttctgagtgctgacagttgtcaaattcacctagttcacatggccccatttctatcgtttgttttgttttgtttttgttttttaacagcccatctgtgagcaataggatcagatgactaagagctacagggcagaaacactgttacttagagtcaaattttcccattacctagctgtaaagagtttgtttctctctgactcatataaagtttaccatttaggcccctgcatgattttaattccatcacttaacaccccagccatatgattctgaaggtaaacatgaaggcgtttgaattccagaccacctaaacattcttaaggaaatcatcatctccacgggcagagctatgccaaaatctgtaggttttaactcaaatttcatgataagcaaaaattgaattaatttgtcttccattttgttcacctttttgccaaaattatgcctggattagaataaataaattcaatcaatgaatgcaatcactaattcttacgccagataataacacattcagaattctcctttccctgggagattttatcaggttagtgttcttgtaaacaggagaaagagaaaaatataacttagtaaatagcagtattcactaattcattcatttattcaacaaatattaatttactacctactacattccagggagcttagagtctagtatcagaaataataaccacacacacacatacacacacactccattaaataaggatgtgataggctagatgaaataaataaataaataaaaggtccaggtgagaaaagaaggtgggggctagaaagaagtcattgaagaaaaaacatttaggttaaaacattatgaataacttagagtgagccaagtgcagagtgctgaaggagtgctccaggcaaaatcaacagcaaatggggagtccttgatgtagaaaagggtttgaggaattgtcctgggagaaatactcaagattccagtctgaattctagaggttagtgatttagagaggcaagtacgaaaatgacttcctctcttaccttaaaagtaagtgcaccatagaaggaaatcacccttccttggtaataattcctgagtgagcctgagaagccagaggccatctctattttataggcactgtccccttttcagttacccatggctagctcattgaccttgtcctggtcgtttcctcatttcacttactccatcctcaaaacgtagacgcttcataaatattgtataaatgaatgaactcacaaagtcacagtacagcaaggcaaaagtgcctgcaataaacaagcattctaggctagaaatatttctcaacttcaaattgtgtcttattacattgtattccgattttctagagtggtagttctcagtcaagggaaagtttttcttcccttccaggggatatttggcattgtctggagatagttttagttgtcacgatttgggggatgcttctggctcaacttgggtagagaagcggggatgcttataatcatcctacagtgcacaggacagtacccccacccacactccagtaatgaagaatcattagacctaaaatgttaatggtgtccaggtagaaaaaccctgttgtagaggttggggactgcgtcttgacagccacattatacagtgtatcaaacaattctgtataatgggctgtaattatccttgcctagattttgcaagaaccctagtgtgtatctttttcctcacttgccaagcaatgttcaaacctgcagagatttatttcattcattttctgtgtgtttagtaaacagactagaagcactggaggaaaaaatattccagcaatgaggtaagacgaaagctattagtaaccctagtttaacttagctgaatagtaggaaacaacctctaccgtgaggaagtgtattgtagaaactgaaaagacgctaatgatgtttaaaaagctgtagttcaaacaaatgtgcatgcagaccaatgggtagactgaaaatgatgaagacatttccgtttcttgtgtctttgatagaaaagaaagagcttttattttctttagtgtggcaatcattcagatttgtcccatgacatgcccagaaggttgaagaataacaaactcccaagtgtaaacacagaatttagcgaagaatccaggcctctggatgaatccctgtaattgcatgtttggataaaataagattttcatacattaaacaaggtaggatttttctatctgggacggaactttcaacacttggaggggttgtagttatttctcctcaaagatggcaaacatgagtgccccgagttatccctcctctctgttcaagttcgctaactaatcacccagtatccatgctatcgctggcccttctgtggcctatttttatactgttcactgttcagtgtcacttgtttggtaacactcaacatcaacatgtgctaccaaattgacaccagaggacaaaaaagaatcaagatatgtacagcctgctttgtactgagccagctgccactagatgttttttgtgataatgaacacgtgaggccatgtggacgcgagagatggctccgggttccctcagacggctcacagccagctggtctgcagtgcggttttagattccgatgtgggaaccccataaaaaagaatatgcaggccaggcgtggtggctcatgcctgtaatcccagcaatttgggagcctgaggcgggtggatcacctgaggtcaggagttcgagaccagcctcgccaacatggtgaaatcctgcctctactaaaaataaaaaaaaaaaaaattagtcaggtgtggtggcggatgcctgtaatcccagctacttgggaggctgaggcaggagaatcgcttgaacctgggaggcagaggttgcagtgagcaaagatcgcaccattgcacttcagactgggcaacaagaatgagactctgtcacaaaaaaaaaaaaaaaaagtctgcaggctgcataaagaggtatgaaaatgttccagaaatcccaaatcctatccctgaggttcattttggtgagggaatgtgtgtgcattttctagggcttccctaaaaaagtatcacaagctggatggcctaaagctacagaaatttcttggggacaaatttcatgattctggaagctagaggtccaaaatcaaggtgtcagcaaggctatgctttttctgaagcctatagggaaggccttccttgtctctcctagtttctggtggtttgctggcaatgtttggcattctgtggattgcagctacataactccactctgcctccatcattaatggccttctgcctgagtgttttcatatgaccatcttcatataaggacaccagtcatatttgatgagggttccaccctactccagtatgacctcatcttcactaactacatctgcaatgaccctatatccaaataaagtcacattctgagtgtctggggattagaacttcaacagagcttgttgaagggggcacaattcaatgcataacaggatggaaactagaaacgggtatgtttttatcagtgtagaaagatttagcttaatttttcaaagtgtaataaaaaccccaggaaaactcatactccctcctaagaagagcaaaagatggagaaacccgatggttaccttcaaacaaaaggaaaggaggaataagatgaaaaggaattaatccaaagcaaagagagtggcttatatggaatgttggtgcaactttctctgacacatctgtgcactcatcagctggggcatcatctccctggggtacatttggtcactgtgtgcctcatggtaataaactccagaagcctcattgacttgctagagatgagctcatccttcttgcttgcttaatggcaaaatacaaaataagcagtcactgacatggaacgatttcaggaatgccaaaaggttctccttttccaaaatatctcttccatcttcccaatactgttactgacatcactaacacctctccacttccggttgagacacctgggccagagctcctgatgtggcaggcagtgccctaaacgttttgcataaattaactgatgcccagagcaacaaccctaagatataggtactatcataccgcatcttacagataagaaacttaggcacaaagaggtttagtagtttagatgagataaccctgatgagcagagattcgaacccagcctccatgctattaaccaggacatcatattgcctttcatacatgctcttcaaaggcaacacagtaatcgattatcacactcactcacatctgattgtcacatttttcagatctgctctcctagcagagaatgaagcctaaggtatccttgtttctcaaagtgtcctccccagaccagctgcatcaaaatgaggggatgaggtgcaaatgcctggaccctgcccttggagcactgattcataatctcaagtcccaagaatctgcattttaacaagcatccccagaaatttcttaagtatactaatgtatgggaaccactgacactaaagaaatggaataaggggaacgtacaatgttacagtaaaccaggaaaagccagaaagacatgacaacacagtgaggactctggtagccaatggtcagtcaaatgcccaggggccctggccagaagagagttaggttgctgaggagtaagagtgatgctgaatgtggaggcttgagagcagaaggaagccagccagctatatcctcttgcttggatcacacaccctttccttggtggaaatggttatttgcagagttagagaaggcatgttttacagtttggatggcaggtatggatgtagacaataaagagcaaccagagtccatgggttcagaaatccccatgtgtttctgtttgaatgagacgcttgcataaacagcacaaggagtttggggtggggttaaagagaatggtgtggtatagggagagctgaatgaggaactgagagagcaaaatcctgtgtttggttcaatcactgattacaacctccctgaggctcggtctcctaatctgtaaaatggggggaaataatacctgccttgcaggtcctcacacacagggcatgatgtgaatccactgaggcatatagcactgtgtaacatgagttattgctattccaaggcccgtaaaaggctcttgccttggaatatatctgccacaccaatgcctgcagtccattaatgacacataaaggacactggagataacgatgtcccttgttctatgcatccctcccacccatgccagaaaagaaaacacagtcacctgaagtcattctaaagagtatgcctgcctcttttcctgcacagacacatatacacagacacgcacatacacagaccatgcacatacacacacacgggaaaacatgaggaaaagtggagacaagaggcaccaaaggacaaagtcacttttgtcgcctgtcccttccccagcagggctgggcctgggctgcttctcctgcctcctccctgaagccccctcctcatcatattccagtgcgtgtccaccactttggggccaggtctacacaactgcagtgattcaggtcacgggagaaaacccaaacaagcacaaaacatgcttcaacctatattttctaaattgtttttctttaaaggtgaagacttctgagcttgaattatccccttgtcagtgggctttccatgctgtccaagtgacctaagtgataatcaacctccatttcattttgagaatggttgtggtattttagagctatggtgaataagaaaatcatttaaaataaaatgatttttatttatttattgtttttatttattttatcttaaatgaattttaaatcatttaaaataaaataatgggataaaagaggatgctaaaaataataaatatatatgtatcaaagtgtgcttgtaataccaggcaaagaattaataagagataatattatggttggtgaaatgttatgtatggctacatcctttcaatgagcatttatagttcctttaaaatatgcctactgaagaaatatttacatgctaattaacatgtgcatagtaccactaggtattatagaggataccagatgtttgtagtagacacagaccttgccctaagtcctggtcttgatgtagtcactttttagtcactacaggtgactacatttagtcactacaagtgaccttccttcaatggggaaataaaggactttacaaaagacgtagaagacaattcttaatataaaagtgatttagatcttcacaagtttgtgaagagaagcagatgagtgaaatagaacactatcaatgtaaaatattattctgaggcctctgtaatgactgggaagcaacaagagggaggtcatttcagagagagaggctctaggttccaagctggatgctcaggtcagtgactgcaggtcccctccacacccatcaccccacaccctaaccctcttcagttgctcacaaaggtagataaatacccacatttttgccctcttccatcttgaaaccctggaaacccttgcttccgccaggggaggttacttagtatctgtcaccccaagggaaccaacgtcgaagcccaagaataagagtcaatactcctaccagaggtttacatttttcccaggggtctaggtggatattcctgggaacccccgtcaacacaggcatctacagtacaatccaggcctcctgttttcagcaggggctgcaagagcactgcagccttttccccagaggtgtcagtttggcccagtaaagattgcccctgagaaaacacatgggcaattagagcaaagttcctatgttctggtaacatttaattgtgctatttctcaacctcctctgcacccacacactcacacacaacatttattccactgacttcaaaggaagctcaacgtgttaaaaatatgtgtgggaacaaagaagggagtttgaaattggtctaaactctgtataactgggtttgacacgtacattaggattttacaagtatgtatttaatctttttttaaaaaaagcgtttacatagggttcagaataatgacaataaatcaacatttctattgtccatttgtgtgttttcatagtaaataatgctcatttatccttaaccagtaatacatacttatgggcttaaattagcaaaagcctctcaaaaagtagctccactcatttatccaccagtgtccagatgccatccagcacatgaggagctcccagaaaggagcagggaacaaactagggctgtcaggagtggaggagaaagaatggcatatgcaaaaaggagctgtaattaaatccaagggaacatggcacactctagtcttttgcacgagacaaagggcaatcctggtaaaaatacagatccccaggccccaccccaaagagtctgatctgattctgaaatggggccggagaatctgcattttaacaagcaccttcaccaggtgatccttttgctgagaacccctgagaaatgagaaccctgtgctagtgctgaatggagcattatattccagagttgaagtttggtgatcagttttccagatggagctggtccttggtgcatacctgggtataaatccaagccaattcaggtatatgagctgatatttcaaccgaaacactatctatagcctaaattttttctaatattctgtttggtatgaattctagaaagttgtaaatgctatatttccttctcatctatttctggactttgtcccaagaccaaatcccagggcatctgatagacattcattgcatacatttttctgtaaacatgaaaactgaattgtctaatagaaaagggcaaggaagtagaaaataagaaatcatcatcagaagtggtttgttttggaattatattgtccagctgcataacaaatcacccccaaaattgagtcgcttagaacaacaaacattgatcctccacagtttctgtgtgttaggaatcaaagtgatttaatttaatggttctgctcagggtctctcgggggctgcaatccaggtctcaggctgggatcctttcaaggctgagctggggaaagatccatgtctaagctcactcacatggccgatggcgggattcagttcctcttaggctgtcagactgagggcctccgtgtctcagtggttttagccagagccctctctcagttcctttccacatgggcctctccacagggcaactcacaacatggcagctggtttccagtagagcaagcgagtgagagaacaagaaaggcaagcaaggtgaatgtcccagtcttttgtaacctcatctcagaagtgttaacccatcacttttgccatgttttattatttagaagcaaatcactaagtccagcccacaattagagggatggcattacacaagggaatgaacaccagcagacagggtcattgaaagccatcttagatgctgtctatcgcatctaagtgtgatttttccagatgaaaagaatatattaatttgtttcagtcttagtcgatgtgccatcccatttgtgctttgctaaaacttgtatcaatgtaaagcaaacattttctgatacaatttaggtagtgtattgtggtaatagagaccagtagtgttgaaaagatatgttgaggtcagaaattaagctcatgtttctaaaagaggagatatgtacaactactatgcaagccaacaggaaagagtgttttaagaatgctttctgctacaggtaactaaaaacctaaacagctgtggctttaaaataaaggtatatctaagtcacataagcaaaagtctaggggtgggcagctgctggcattgcttcagtagcttgataatggcaaaagcagcatctcttctatttccttggccttctaatcatgcatgtcacctcacaatcacaacataggcaacacctcatattctaagcaagatgaaaagggcaaagagtcatgccatatgcctctgtctcttttcataaggaagacaaagcttccctggaagtcccctctagcagatttcacttagatctcattggccagaactgagtcacatgcctgccttaaaccaatcactcaccaagaagactaacattatcatggcaagtctaaaccaactgtgactcatctctgaaatcaaaggattattaccattacccgaatccatcaggatcctgttggcagagaagtgggactgtaaattttgagcaggcaacaaacaagtcttctgtaaacttcttatgtgttgttttttatgtgttctatatatccagtagaatcacaatttccaataacagtctaaaaagatattttccaatagaaacagaatgtgtaagatcattacttatgaaatcccaaatgtacttaaggtttccttcttgaaaattccttattcaaaataaaatgtccagattttgaaacccagaaaagattctatattttaaaaatcctgtgcacatgtaaactgtttttcaaatattgccttcagatacattgaacagaatgaaatcttctgagatttactacatcagccaagtattatcaaaacaaacaggacagattgcttttcttgacgtctgctgcttgatttgtgttaactcatgtttctgaaattgtagtatcataagccaatgctgcacaaaggtatttcatgtcatttataaaaatctagtaatgtaaactgttaactccttataaagcatctgttgacacacaaaaatatcactgaagtgcatttatgcctttcttctttaggtctgcataatacttccctccagaaggccaagttgttccataaattacagaacagaaagttggttgtgggaggaatagctcaacctcatctgaggcatcccactctaagaaactaatggcacctacacctcttgggcattgagtttttaagcccatttttaattcttgttctgctcatattctaagtgagcacataaagtgctgctccaagcaagaccagcccttgtagaagggcaagtgcagtcagtcccctaggaaacgggactggggagtgatcgtttcaatgagagataaatcaaactgatgctaaacatgaacaatgagcccattagagattgtgagaaagaggcatcatcatccactcaacaataggcctgtgggacctcttgatagcctgaggatgtttaatttcaggtgcaggtatccagaatgtagcagctagactgatcaaggatgtgtgatgacagcaagcagtagtggaagagcccaggagagttcctaagcctgaattgcaatcctgtgctgccataaaatgggaagatatacttggtccagtcatctgacagctttggtcatcaatttctctatctcatatgtgactctattgctttaagaatccctttagctttaaatatctatgaatctgctgaagcagctgtgctttgattgatgtggatctctgaactcccttaaatacaaagaccaattatttagccgagctttgttggattcagtgcattctgaatacatgtcaaaatatacttggatttgtaaaaaatattccttcctgtttttttcaccatagatagatgtacaaaaatgtccgtgttcacaccgtggaaaggacatttctcataaactcacacagagatacctttcaagtcaatgccttagaaagcaatgagagatttaaaggagacctagagatatgaatggagtaggcagagaaggtatgtgaggagaatgatgtaacttcctagggaaaaagtatgaagcacaaggctggacatagacctgggaatcaggaaattagagttctaattgcagcttttccattgattcacttgggatcttgagaatatctgtctcattttaatcattctgggccacagtttccatatctgtcaattagagtaagagtccctggctgggtgcccaggattgtgagaacataccattcagagccataaaaatgcaatcagtaccaataatgtactagtaccagtacctaggatgcaaaacatcctagatactaggtgtcctaacttaaagtggaaacattaacaagagtaattctttgaatcatcaaactgggaatattttaggaagcatatctatctgggtgaaaactaagcaaataagacaattgtaaaggcttgtgatctcaggaatacaaaggcaaaaatgcgcagacttgaaatatgacaagttctagttttgtcacttagcatctctgtgaccttggataatttcttaacccccggcagtattctcatctgtaaaatgggaataatgacatgcacttcagtggtttgtggtgaagattattacaaatagaaattagctcttttgagccactggtggggtttaaattcccagcccttatgtgctttgcagctgttagttcctcttattacaattgtctatttaaaaacctagtcacagcccggtgcagtagctcacgtctgtaatcccaacactttgggaggccaaggcaggagaactgcttgagctcaggcgttcaacatcagcctaggcaacatagtgagaccctctcatctctacaaaaagcaaaaaattagccagtgatgcatggctgtagtcccagctattctgagggctgaagttggaggattgcttgagcccaggaggtcaaggctgcagtgggcagtgatcatgccgctgcactctagcctggatgacagagcaagaacctgtctccaaaaaaagaaaggaaggaaggaaggaaggaaggaaggaggaaagaaaagaaagaaagaaagaaagaaagaaagaaagaaagagagagagagagagagagagagagaaagaaagaaagaaagaaagaaagaaagaaagaaagaaagaaagaaagaaagaaagaaagagaaagaaagaaagaagggagggagggagggagaggagagaaagaaaaaggaaggaaggaaggaagagagagagagagagagaaagacctagtcaccaaaagcaagagattttttaaatgctactattttttgggcatttactaatcatattgctatgctctgcacccaagctaagtaatttaaataaattatctcatgtactcctctaaaactaattactgctgtgtaaatggaggtagaaagaaactaagctttatttctgcctctattgtttctttaacctgccttgcttcctttttcagttgcacctaattggctgtacttttagttttctttaaaactgccttaaatttcaaagactaaagcagcaataactaactgaatatatttatataacatgttatttttgtcatgttgctttccacccctggagacctgctctaaattcacttggacgtttgaggataaatcatgctcactagcagtttctgaaaatgcagtttcactgaaaatgcaggcatccagaaatttagtaagcaacttaaaagaaagtgtaagaatctcctatgtattcattgaaaaataatttgaatttatgcttagaaaaatagaattattattaagaaatcttacacactcatgtttttaaatatcttcactaaggaccaattgtgtatatggtgtaacactgtcctcaaagaacatgccgggagaattgttgcagttaccagagggttaaatttggcaaactcttttttattaacgtgccttttaattatgaaatagcatactcaccttagataaaatttgaaaaccatttttgtaaagtggtacaatattgaagaaagttgataactttcagaccagatttaagcctcaaatctacctctcttttacctggacaactcattagcatttctgaacctcacattttttctataaagtgagaatactatattatagagttgttgtcagttaaatgagaacagtgtctgatcacaactagtcaacaaatgttcacaactcttcccctcctaggaaaagaatctcaaggcagacctgcttcgggtctgctctgtaaagaggtaggaatcctctgctcctggtaaattgcttcctaaccttctttggtaatagactattttttaataaaggtgatggatcatttcccattatacactcaaaatgtgtgtacccatttcagggcagtcatggatgaccattgcccatcttttgaccccagattaagaacacctgctgtagtattttaattctgccttcaaatcctcttacaaaacaaagacatctttaaaaaataaaattctttaggtgtcttgcagttgaatgcaggaaaaccagagccccttatttttgatagttttgggaagaatgcagtgtcagaacacaaacccataatagacaaataatttgcacagaaacttcataaaagtattgacctgatttgccatgtatttgccaccttttaaaacacacaactaaatgtttaccctgtgtctagatccaaatgggtgaagaaaaatgagtgacaatacatctacttaagctcacttacataattgtggccatgccgtttttttcacattacattattagaacattggacaataagtcaagaaacagaatgttctacaaaataaactttaaaaattggtaagcatcatgtgctttttccagaagacattttattttgttgaatcaaaggtggctctttggcactgagtagctccgtggagtcatggcagtcctcattccctaatcctgagcctgcctgagtcgctgctgtcagtcatccacttgttgggatttcaaactgcattaaatcccctcctatagctgtcactgccaagcagttgcactggctctgtcctacctttctgttggtaattctgtttttaatcctgtgcttcagtgtagtttatataaatctttacagagggataaaacttcctgtaattaattgtttgggtgaacatgtacctgggagagctattgggaaaggggccaaatttgcattccagctcctttcatccccacccttgagctaaccaagtcctgtggattcttcccttagcatctctggaaccttcttttcttttcttttttttatgaccacctttccagtcctggcccttcaaacttgagtgacagcaacagtctccctgccttgagtctctttcctccttctcccagtgtgcatacggttgtcaaactcatcttgataaactactgcatcgattgtggctacactcccctgctcccacatcttccatagaccccactgtctgtaaaataatattcagtctggcctcaacctgtctttccagcctcggtgacacaggtctattctgcctgagacacttactatgacacccttgcttgttcctggggctttgacacatttccaacgtcccattgttcttcctctccaaatcagccaattgcccaagccctgctcaaatctcccacctcatgaagccttcttgatgcctcccagcacaccatgatctaatttcctgaagtaattatgctaattgggcatttgaagaattgttaaccgattatcaactaactgccccttaacattgcatgtgtagttgtcttcaaaggcagttaaattatgtcatgttccttacattgtactgagtgcctcgtatccttatccatgtttgggggttttactttaagtcaagaaatttaatcacatccatttggttttctctagagctgtagttctcaaccttttgtgtggtagagaaacacctagagaacatgtttaaaaatatcctgggttccacccttgagagataataaggtccaaggggaacccaaatatctgtgtttcaggtcagcttattggctcatcctattataccaactcctcagaaggccaaggtgggtggattccttgatctcaggcgttcaagaccagcctgggcaatatcgtgagactccatctcttaaaaaaaaaaaaaaaaaggattagccaagtgtggtggcatgaacctgtggtcccagctacttaagaggctgaggcagacagattgcttgagcctgggaagtcgaagctgcagtgagccatgatcatgccactgcactccagcctgggtgacagagcaagaccctgtctcaaaaaaataaaaatgaaaaaaatctgtgttcccaagttccaagtgatgctgatgctgctggttgcctttaagcatctcacaaagaacgaactcataaatgctaatacagtatatgtctatggatactgaatagtgggttttttttctcttttcttctattctgtgctcatgttgtgtcacttcttccttttagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaacagtcagctttattattttttcccaaaacaggtgtttatgtgtcagagtctgtgtatgtctatgtatttgtatgtaatgagcatgtgcatagtgtgtgtatgtgtttgtatgtgtttgtggggggtaatggtctcccactttaaaattattacaaagtcacttaggatatttctgctaaggtcatcaccatttatgagttgcttcagataaaagttataattaataacaaagtttttttagcaatttgcccaatgttttatatgtcatctaatttgagcccccagcaagcttgtgtgatggatattaatactcttaacttagcgaaagacacaatttgcattcggggccaatgccttcaactttgccatgccttaactgggttttaaagaggtatattgcagtctcaatttatgtttgttgcttggctaagtttaccttcaggactcctatattagggttctccagagaaacaaaaccaataggagatagttggagatagacagatagatagatgatagatgatagatagatagatgatagatagatagatagatagacagatgatagatagatgatagatagatgatagatacatagatagatagaatagagatgataaagatagagagatgaagatagagatagagatggacatggagatggagatagatgaaaatatatatagagagagagagatggagatagagatatatagggacagatagacacagagatagaaatagagatagagatagatggagatagagatagagatatatagagacagatagaaatagagatatatagagatggagctacagatagagatagatggagatgatgagaaagaggtagatggagggataaagatatagatggagatgacaggggtagagatagagatagatggagatgatagagatacagagcaagagctttattacaaggaactggcttacacgattatggaggctgacaagttcccaaatctgcagggtgagtcagcaagctgggaacccaggagagctgatgatgtagttccagtccaacatcagcaggctcaagagccaggaaaagctgctattttagaccaagtccaaaggcaggaaaaaaattcaatgttccagtttgaaggcagtcaagcagaaggaattctctcttagttggtggtcagggtcagggtcagcttattctatgcaagccttcaactgattagatgaggcccacccagattagggagggcaatctgccttactccgtctatcagtttaaatgttaatcttatccaaaagcaccctcaaagaaacgttcagaataatatgtgaccaaacatatggacaccccatgacccagtcaagttgacacaaaaagtcaatcatcacagcttccagttccatctacaaaaataactatatggctttggacaacttttattccatattggtaataaatagcttcatacatcacacatttagcctgtagtcctagcagtttggaagcccaaggctgagactgggggatcaattgaggccaggagttcagaccagccttgacaacgtagtgagaccatcagaaaaaagaaaagaaaggaaaggaaagaaaggaaaggaagaaagaaagaaagaaaaagaaagaaagaaaagaaagaaagaaaggaagaaagaaagagagaaagaaagaaagaaaaagaaagaaaagagagaaagaaagaggaaggaagagaaagaggaaggaaggaagaggaaggaagagaaagaaagaggaaggaaggaaggaaggaaggaaggaaggaaggaaggaaggaaggaaggtaggtctcataccttccctgatgtgggtgctaatggtcaagcattctatgttttaatttataatccatatttttaacattgggtggaggggagaagtaaagagagacactcttaacacagaaggctgaaatcataaaataaaaaggtcatggcaataaacacacaaaatatcaaacttctatatgtca

SEQ ID NO: 16332 - DNA, 26867 bp, Human
ttcactgaataaaatcattcaatgtattcaagtatatgaagtagtacatgaacatagtaggtctatgcttgagtagaaaatcctgggacacaaataaagatgatgaaatgggttcaaggaggtcaggacacctactcaacgtaaaaagtggctgagttacttgtccaaggttaaagcacaccagaattgccaactccagatccctgagcttaaccactgaaggagttcaggaaatgccagcccaaaacaagatgctttggcgggctgattaccttgaactgagggcacctggagaacagcaggcgggaagaggctttccctgtgctttccttacctgcctaaagtctgaccctccaaaaatacctcaattgtcacgaatccttataaaccagggaagattaactcggatcacatgagagattagaggctgacaccacccagaagatcacctattctgtctgcataacaaacttgattcaccatacatttcctccgttcaccgtcccataacttgtgttagagctgcttcccgccccccgcccccaattctctattcattcctttcagtagctcaggatgccatgtaggctttaatcatctgacttcaacttttagtctcgtattttgtgggactcctgtacgtaattaaatatcgtttttctcccatggacaatgttcagttacccgaaaaaaatgggagattcttaagtaccaataaagaatgaaaatcacaagtgggtagtctggcaaagaaaagttgatgagagattctactgttaacgttgggttaatatgactcgaataatttccgtatgctagctcaatgctttacatgcacatcctgtttaccctgcagtaatctgttaattcgtcttatgtgaatttaactcttagtcctaataaggtacctggaaggatggagggaagccatttttggttcccctacaccactgttctatccggtctcttcacttctgctgagcacatcccgggtgtacatacacacacacacacacacacatatgtgtgtgtatatatatgtatatgtgtgtgtgtgtgtatatatatatatatattttaagtggcccactcctaacttctcaactcccacagaacgttcactcgccaggtaaacagaagcctaattatccccaatttgcaggtgagcacacgaggacaagaacccgatccaggaccggatacatcgcagttggaaaggctagaacacagatgccccctcactatatgcgccgcgaccatctggatgcagaggcgaactaaggactgggtgggaatggaagcgaggcccttcgagaagaggaaggggtgcaggccaagccgggcaacttaggaaacacaaagtagaggcgcatgccaccttgctaactctcgactcttccagtctcgccccagtcgtttctgtggttttctctaaatgccccagccgaccgcaccagctactctccccgtgtcccagtaccagctggtccggttctcttggtatcccgctctctcctggaaaaatggaggcgcgaatcctgcccaatctaccgctccgagcgcacgttcactgcgcacgctgaaagggcgccaagccgaccgctgcgctatcgatcggtcccactctctcttgcttttctcgccatcttacttactggcacgttcaaaggttagttcacctcctcggactttatctccaatgcgtcaagcttgacgtcaaggggctgttgcttcaccgataaatggccgaccgcggagagcaccctggggctgggactgccacaggtctggctggccgttggctccaccacttccgggttcttagggagcaagtgcgcctgcgcgcggtgtgcgcccttaaacgcgactcaaggcgtcgggtttgttgtcaaccaatcacaaggcagcctcgctcgagcgcaggccaatcggctttctagctagagggtttaactcctatttaaaaagaagaacctttgaattctaacggctgagctcttggaagacttgggtccttgggtcgcaggtgggagccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagaggtacaaggggtttgttgagtggtgttgacatgcgcgggaggggtgggtgggcttcagattggattttgtcctccgagatcacctgggtaagaaaagcacagaaggtctctgctgtgttggagttcacgttctagtgggtggggagacagacggtaagcgtacggagaacttgcagctggggtgggtgttacagaggaaaagcaggagtgcggtttaacgggggccgctttagatagaatagcctaagaaggcccttgtcctggctggatgagtgggtgaattgatgaatgagaacctccttgcagaggccttcccggtccgtacttctcagaccgtagaccttggagcagttgtaccgggataacttgcagtgcttgttaaacatatagctccaccgagagcccggtaaatcagaatctctgaggggtaggacccaggtgtctagttattaacaaactctccagatgattcttaggtttcattgagaactagggatgcagaccggtgcatacaaatcgtctggggacgttaaaatgcagaatctgttttcttagacctggggttaggcctcagagtctccatttctaagaaccatccggctgaggtagacgtagccactgtccttaactctcgtaatgtctcttcctcttccgtaaccttccttgtcccttgaattaaacgtttttcagcaacctactcagttcgtccttcccttcatctctgcagacatgcacaggtctgagggaggaaggaataaaccgtataaacctcctgcgctattagcctaacagcttttctattcaaaatagtaggacttctggtttgaactgaatggatcctgtgaaagtcatctggttcttcaatctggttgcagattagagtcacctgaagggcagtctccttggcgttgtctccagaattctggattagaatcttattccattctgcttgttattcaatttccctagaaagaaaggtagaataaattggagcaaatgcctgtagcttctctcagaagaatgttgaataaatgttgttaggcctatgtgatctcattagactgctacttagaattgtaagggaagtaaagcattagagcatgtgtgaaattaaatatttgattaacacaagtgtgcatttccttgttgctgtttatcaacttttacttacccactgtttttttataagggctccagcctgtagtctgggcctggcttcatcatggaattatttgcttaattgtaaaatggtaatcttaatttttttttttgagacagggtctcactccattgcccaggccagagtgcggggatatttgataagaaacttcagtgaaggccgggcgcggtggctcatgcccgtaatcccagcattttcggaggccgaggtgggtggatcacctgaggtcgggagttccagaccagccctaccaacatagagaaaccctgtctctactaaaaatacaaaatcagctgggcgtggtggtgcatgtctgtaatcccagctactctggaggctgaggcaggagaattgcttgaacccaggaggtggaggttgcgggtgagccgagattgcgccattgcactccagcctgggcaacaagagcaaactctatctcaaaaaaaaaaaaaaagaaacctcagtgaaatgaaagactgaactacacacctgggggaaaagcgtaataaagggagcaagaagtgcaaatgcttatggcaggggacttatttgcagaaagaaagccttgtgtggctggtacacggttgacaagaagaggagatgaagtcagagaggtagttagggtccatgttctgtgagacttcaataggcctgtctatgcaggttaggagtttgcattgttttgattgagttgggagccatgggggtcttctgaactgaggatcaacacatctgatttgttaatgagattgccggcctcagtgttaagaatggaccatgacagggtaagggtggaagtggggaggccattgggaggctgttggaaaaaactcaagggagagagaataatggtttgaccaggtggtagtagtagaggtggtgagcagtgatcttgaaggcagagcctacagaatatgctggtggattaaatgaagggtttgcgagagagaacctcgtaaagggttattatgccaaggcttttggcctgagcaactgacaggatgggtttgccatgcactgagatgaggatgtctagagactagatttggggaggtgagagtggggagagattaggacttctgtttgggacatgttagaatggagatgccgctcagataatcaggtgcagatgttgcatagaaagtagaaaatgtagatcaagagttcaggggagaggtctgggctgaagaatgaatatttgggagtcctcagcctgtagatggtactgaaagcaaagagactggatgtactcggctagggagtaattggagatggagaagtcattctaggcctgagctcagggcacacccatgaacagggaggtgagaagtggagaagggaagaggttcagttttggatatgttaggattgaggtgcctggcagacatttttgggagatcctgggcaaatccttggatatccaagtctgacagtccaaggagagactagggcagaagacgcactttgagtggtcctcatgaaggcatttagagctgaggcactgggtgatatggatccctggtgaaggtgtagatggagaagtggagggtccagggactcgttcttgagtcaccccagacccttgatctggcaaaaatgagactgacccagcaaggagggaaagacaggacgactaggtggtagataaacctggaagtgaagtgaagaaaaaagtgtaagatgtgatcaaccttgtcagattctgctgaggatgcaagtacggggaaggtggaattgacccttgggtttggcagcagtaggtgtcagccatgagcctgacaatgtggtggagacaaaaaagccaggtggggatgggctcaggggaggggagaggagcagtagaggtggcaagtgtggacggttcttctggagctttgctgttggagaggagggggtcattgttagcaacgataatagaataaagaggacttttattttattttattgttttgagacgaagtctcgctcttttcccataggctggagtgcaatggtgtgatctcagctcactgcaacctctgcttcctgggtttaagtgattctcctgcctcagcctcccgagtagctgggattacaggtgactgccaccacgctcagctaagttttgtatttttagtagagacggggtttcaccatgttggccaggctggtctcgaactcttgacctcaggtgatccgcccacctcggcctcccaaaatgctgggattacaggtgtaagccaccatgcccggcctaaagaggacttttttaaggtagcaggtatgccagtaggctgcacagggatggaagtgatccattagaggagagatgatggagcagcaagaccatcaggagtgaagactccgtgacagaggatgggacgcagtgcccaaggggaggttggccttgcagggaaagcacatgcctgtccctccctcattagcttcatttggacaaaacatgtaaaatccggtgtgttgtggaggccttttgattggggaactgtaacgctgcctatcgagcaacagcactttaagcaggtggctttgttcaaattaaaggttcttctttttcttttcaggcatcatggaccgatctaaagaaaactgcatttcaggacctgttaaggtaaattgaataatctgtaatctcattcacatttataaacccacatggaggttggtcttgtctaaattgaataatctgtaatctcattcacatttataaacccacatggaggttggtcttgtcgggaattctttccgcctttactttggatttaaatttagatcccttactgtgatcctggatatgaattagtcacttttctcgtgttcagtaacattttgctgcttcttagagtagcttttttgttctgctttgtcttataatcggctgcttaagtttctatatccctccactgtatgcaggataatagtaataatgcatctggcaggagttcaaaacttttaaaattggccataaatataaaataattagaaaaaggctaccttgaattactgtatttgattctaagttcctatgataacggccatttaaaaaattgctctatatttaaaatgtttctttttatttgtctttgtctgaatgcctgctgcgttgtggaccgtgtgctaatttcaggagtaactgactttgtatttggaagtcttaacaccctctctttgtagagcactcataccgttgagctggggatggactttgaggctttcatttctagcacttgtccctcacttacaatgagctgttgaagctgaaggaaatctcatccctcctaccccttttagtttgattagctgagggtgttagagttaacttaacaatttaaggttgtaatacagtacttacaggcgtataaataatacatttcaaggctgggcgcggtggctcacgcctgtaatcccagcactttgggagaccaaggagagtggatcacaaggtcaggagttcaagaccggcctggccaagatggtgaaaccctgtttctactaaaaatacaaaaaattagccaggcgtggtggcaggcgcctgtcgtcccagctgcttgggaggctgaggcagagaattgcttgaacctgggaggcagaggttgcagtgagccgagatcatgccactgcactccagtctgggtgacagagcaagactccatctcaaaaataataataataatacattttagtagtaactttgtgaagtgtctacatttgtttcctctttgtcagttttttgctcaattccattttgtcaatacttggaaaatgaaacattggttaatcaatagtacagtaataagcttattgtggaaaatcttcgatatatgaaaacttagactcttctaaaacttcatgaagataataccactgttgaacgttttgacgtatttttttttggtctttttcttaaacgtatattatcaaagaaatttcaatggaactgagattttggcataaagtttttgtatcatagctttttgccaaatagcaatgtagtgtctatttccaaattattgagaaattttagaaagtgtctccttcattaatggatatttgttaataaagcatgatttttaggggtgaggaattggaggggatagaaggtatcattcaggtattcttagccacatactaactatcctctggaggtactgattaaaataccttttcaccttccatctcttatcagtgacattcattattttgctatactagagaacaaactttgtgaaattctcaatatattcatcttttgctttcatgaatgccagaaagtttattttctcttccattctaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctggtaaactagcttttgagactcattggatagtccttctttgtcgtcgttgctaaaaaagccagtgtatatacttgcacttattgtttggagccttagcttttatatctgttgaggatggggagaaaatatggtgtctgggttgaagtaacagtgtctgcccatgggccagacctatgctaaaaatacagacctgattctcaccctcttggaagagttgggcacccagggaggacacagcacaaattggtgtccttttgattgcttgttactgagtctggatgtagggtgcttgcagtaagtgacttgaagggactgagatctaaagtgtgggggaaatccagagaagtgggtgaactgaggcaggctgcggtgaggtcaccatgggcattgctggccatgttaaggaatggggcctcatctctagggcatttggaagctactgaagcttttttgaactcagaagggaactctgccttttagaaagtttactgtggaaggccaggcgcagtggctcacgcctgtaatcccagcgctttgggagaccgaggcaggtggatcacctgaggtcaggagttggagaccagtctgaccaacatggagaaaccctgtctctactaaaaatacaaaattagccaggcgtggtggtgcacgcctgtaatcccagctactcaggaggctgaggcaggagaatggcttgaacccaggaggtggaggttgtggtgagccgagattgtgccattgcattctagcctgggcaacaagagcaaaattctatctcaaaaaaaaaaaaaaaatttactgtggaagtactgaataaattggagtagaacgctggatttaggagtaccagacaggaaggaggttgaggtcagagatggcaataacctgctctgtgtggagcagagtggatgcaattatttaccaactgttgagtgctcattccctgcaggctctgagataagtgcgtgcttcatccacgtcatctctttcaatcttcgtaaccacttcatgaaggtagccagttattaactcagttttacagaggaggaagctaagactcagaagcagttaacttatccaaagacaagccaggatggagaggtgcacacaaatttgagagctcatttacgatgcagactcattagaactgggcaataaattgtacctgaaagatgaataaagaggagttagggatggtgattagattgatattaattgagtgagtgtcctgggggttgaggggtgcacatgtgacaggggcatctggaggaagagtttggaccagcatccagatatctgagcagagcattgtgtgctgttcgagtttgctatgttggagacagaccagtggaaatgtttcatatgtccttgtggctgatgaaatagttaccccagtcctctgctgcacaactgttcattgtgcattttgctgaattggtggcttttatttttatatttccccttggcagctaatataaatggagggtggctggcttatgttttgctacatgttggtgataattcgtatgtagggtatggactgttggctggcccacctagtaaggggaaaaaggtgacgagttggcagctcgtcatgcatgggaagattggtacttctgccacaaaagctcttctttggaaactgaggcttcagaagagcctgcatagtctgcctttaatttatcagagaagggcctgtctatatatacgtctgctcatctttagaaattctataaaggcttcacatgatggaagtcagggtgtagtagtcctttttttctataaggaaaactttaaaaaaaaaaaacagatttatcattcttgacataccattaatattttggtgaccaattctttgattcacctctattcacagcttagcttatcctatatagttattctaaaaacaggtttttaacttattccatatagaaaataatcctgaggaggaactggcatcaaaacagaaaaatgaagaatcaaaaaagtaagctttcttatttacaaagttctgtactgttctactagaatatattatttcgttgcaaatttcgttgtgggaactctggggaaaaaaatgaggcctttatttgcatttagaggatataaatgtttccagatttccaatcttaaaaaaaatggaattttgtgtaatgaggtattttactaggaactcaagtgctttaaaaaatggctttcaaatttagaaaaagcttgtatgaatcttttatagaaatgtgtggaagttcctctctgtccttagaaataaccactacatatggtttatgcgtctgtacttttttattgtacaaaagtgcaagtttttaaaaaatagaatatgttgcagaactatatactcatatatgactgagggttttgacagtattatagttttagttctttattgtaaaggttggctgtaatgtcttccccagggcttttctaaaagcctcctctcagtctctgaactatctggactctagaatgtaccgggaggagcgaggaatgaacccacagactcttttgcttttagcggtctaacagaggctaagagtctaaatccactggttctcatgccccagctagcctgtgggctccatcccgcttccattagtaacagtggctctgtctccaccaccagagtggttctccacccagagagaattagcacctctgggactggagggagcagctggggttagtttgaaacatgcccccagatggtctggaagcattcctccctctctggtcacttatcctttttgtggtcttcagcgttgtcatggccctgttcctctgagcatagtacgggcttgggacatttcccatagagtgcttcaggtctaaaacccgagactgctccttgtcactgactctcacacctgacggcagctagggacgtcagggtttcatgtcgtggcagctctttgatagtggttattgccttggttcttgctgaggatgcatattgagtgaagttggaatacgaaattatttgtagaatgtgtctgctactcattgaaaatttgttagaaaagctttgttttcttcacattctaaagtgttcaaattcctcctaggaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggtgagttttcaggttcatgttcaaaagaatgttcaccaatgctgcacccctccccctcctgtaatgtcagcctcccactgcccaggtcccttcactccctcttacgaggcactgccttcaaatgcatggccccgttcctcacctccccctcccctatgaaaaagattagataagcttctgtactgcactgggttataagcattctcctgtgattctcccatgctctgcatgttaaaataaaattgtattcctttttttttttttaagtataaatttattttttagagggcctgcttttcatagtaccacaaaaaatgattaaatttgtcatctttcaaagagcacttaagtgctctgatcctggaaaaatcacttgaggatttaatgttttgttaatagaatagtttatatgggcaagtctttctggtggacagtgaaggggaatggcaccccttattctgaggtatgcaggaattgcgagcagctacctgcaggttgactacggctggtgggtttttgtttttcctttttttctttcagtgtttttcaaatttgaatcagatgctaatacttcaagtctggccacatcaggcctggtgtgtctctgcctggcaacacctggctggggctgggaggggcaggcatctcacatgggctgtgcttcccattgcctgcttcccgctggccacagtctgcacctgcccagtctgctcagcacccatctactgccattactgatcactgcttttatctgtcacagtgtctgggtgtcaaactactgtggcaatgccatgtcctttttttttttcctttttttttttgagatggagtctcgctctgttgcccagactggagtgcagtggcgcaatctcagctcactgcaacctctgcctcccaggttaaagcgattctcctgcctcagcctcctgagtagctaggattgcaggcatgcaccaacaagcctagctaatttttgtatttttagtagagacgaggtttcaccatgttggccaggctggtcttgaactcctgacctcgcgatcctcccgcctcggcctcccaaagtgctgggattacaggcgtgagccactgtgcccggccatgtcctttttttaatatgtagataattaatattcagctgaattttcctcctaagaataaaggtgcctaaaggaaggaaatagtcttaactaaaccagaggtccattaatactgtgaagtgcttttaaaatgatatgtgggtgtatgtatttttcttggagtgggtttatagtttcagattctaaagtggggtttggagtgtggtttcatgtgaaacaccactggttttacatgaagagtttgtttgacattttgtacatagtcttctgtgagctccaaaccaagtgttagaatgtttatcctttgttgcaggcatcctaatattcttagactgtatggttatttccatgatgctaccagagtctacctaattctggaatatgcaccacttggaacagtttatagagaacttcagaaactttcaaagtttgatgagcagagaactgctactgtaagtgttcatttattgtccaggctaattgtgtttcctttatacctgtcctccatagcaatgtacctttcatcatagtagagtgggttttgtcttgacgtaaggatagcttaatatcaaatatttgaagtggaaaaatcaaaatagcttagttgtaccatatgtacagataaagtctagaaccaggtagaatgttgtatctgcttttgtgcctagtttgcacagctgttttctatggaaatgtatataatgtatatagatagtcaccctcattttctttaatagatgttttattttagaataatttttattttattttattttttttaaagggacagggtcttgttatgttgcccaggctggactcaagtgattctccacctcagcctcccgagtagctgggactacaggtgcacaccattgtgcctggctaggatagttttagatttacagaaattgtgaaggcagtacagagagttcccatataccccacactgaatttcctactaattctcctactaacatcttgcattaatatggcacatttgtcacattcaatgaaccaatattgatatataactattaactcaagtccacattttattcagattttcttagtttttctcatgattaaattgggcttatgggtttttgagagggagatcagaggtaaagtgcattcttatcacataccagggatgtaaactcttatgacttttaactgtggatgtcagcttgatcttctgactcagagagtgtttgtctggtttctccactgtaaagttactattttttcccctttccgtgctgtatttcttcaaaggaagttactatgaatagcccacacttaaggagtagagagtggatggagtattgccataaattatctggaattctgtgccagagataaggctgttctcccttatttatttaatcatttatttatttaaagatgtagactcctgggtatttattttatctcttgagctataatgcaatactttattttgtggttcagatcattgcaactttggccactgggaactttttttctttcttttttttttttttttctttttgagacggagtctcactctgtcgcccaggctggagtgcagtggcgctatcttggctcactgcaacctcagcctcccaggttgaagcgattcttctgcctcagcctcccaagtagctggaagtacaggcacccaccaccacacctggctaatttttgtatttttagtagagacggggtttcaccatattggccaggctggtcttgaactcctgaccttgtgatccacccacctcagcctcccaaagtgctgggattacaggcatgagccaccgtgcccggcctgctctttttgttttaccaggttcctgggaaaatcattgcagttttgtcttgcgtgtgtgtggtttttttttggtttgtttttacacttcctttttttttttttctttttttgagatggaatctcactctgtcgcccaggctggagtgcagtggcgtaatcttggctcactgcagccttcacctcctgggttcaagcgattctcctgcctcagcctcctgagtagctaggattaacaggcatgcaccaccacacccggctcatttttgtatttttagtagagatggggttttgccatgttggccaggctggtctctaacccctgacctcaggtaatctgcccgcctcagcctcccaaagtgctaggattacaggtgtgagccaccacgcctggccttgtacttccttactttctgatacaagatgctcaggcctcatcgtgtatatttcctgctccagtcctagaatcgaaccacttctccaaggagccctgtttccttttcttggagaatgttattagaaaccaagctctgggcacttggtgtactcattgctactatggtgtcactacttttaggctttcagctgacacagcaagggaatatatgtggatagtaatctgtgtatagatttatccatctatctcttcattaagcataccatgaattcatactgatgtcttcaacttgaatccattaccacgtttcattctaacttcctcctgtttacctgtaaactcccactccaaaagtgtgaaacctggatttcaccgcccaccatccttttacttattcaattccaatatacatgtataatggtatcagaattgttaaccagctgccacgtgggaaccaactttatcaattagagtgcttatgtgcacttcctttggcctttgtcttatagattccactcatttccaaagctgcttggatcaacactttaccctcatgccctttagtaaggtggtttcctacatttgtaatgcaatgagatttttttgtcacaatctgcatgcccaggatggaatcatttacattttcatatcctgagattgatttttgtgtgtttgctgtaaagttctatgaatttcgacaaatacacaatgccatgtatccaccattatgatatagagaatagtttcgctgctcttaagaaaaaaaaaatcctgtgtctcaactactcatcccttccaacccttccatctctggcaaccactgatctgtttactgtctctattgccttttccagaatatcatgtaattggaatcataacagtatgtagcttttttaggtgggcttcttccacttagcaatatgcattgaagattcatctgtgtatttttggaggcatgagagcttgttcatttctgtttatcacaaaatcatattccattatttcattatatggaagtacctcagtttattcgtctactgaagggtatcttggctgcttctggtttttggcagttatcatgttttggctgtcaacatttgcatgcaggtttttgcgaaacaagtcttcaaattagttgggcacatatataggagtgctattgccagctcatacggtaagactatattttgctttgtgaggaactgtcagtcttccaaagtgatttttacattatattttacattgcattacaaatgtaggaaatcaccttactaaagggcatgagggtaaagtgttgatccaagcagctttggagatgagtggagtctataagacaaaggccaaaggaagtgcacataagcactctaattgataaagttggtttccgtggggcagctggttaacaattctgataccattatacaacggtaatgtggtatcggaaccaatgaattgaggtcctcttgcttctcatagttgccaacatttgatgtcagtgttttggatttttgtttgtttgttttgagacaaggtctcactgtcgcccagactggagtgcaatggcatgatcacccacctcaaactccctggctcaagcaatcctcccatctcagcctcccaagtagctaggactacaggcatgtgctctcgtgcctggctaatttttgtatttttttgtagagacaaggttttgccttgttgcccaggtcggtttcgaaatcctggtctcaagtaattcatgcctcccaaaatattgggattacaggagtgagccactatacctggcctcttgttttgcattttagttattctaatcggcatgtggtggtatctcattgttttgatttctagtttcctaatgacatttgatgttgaacgtctctttttttttttgagacggagtctcgctctgtcaccaggctagagtgtagtggtgcgattttggctcactgcaacctccgcctcttgggttcaagcgattctcctgcctcagactcctgagtagctgggactacaggcacgtgccaccatgcccagctaatttttgtacttttagtagagatggggtttcgccatgttggccaggatggtcttgatctcttgaccttgtgatccacctgcctcggcctcccaaagtgctgggattataggcgtgagccactgcgcccggccttgaacatctttttatgtgtttatttgccatctgtgtatcgtctttgaggcacctgttgaaatcttttgctctttttttttttgagttttgagttttaagagttctttgtatattttggatgcaggtcatctgtcacacatgttttgcaaatattttctcccaatccgtgccttgtatttttgttctcttatctgtgtctttcacaaggctgttttttatttatttttttgagaaagggtttcactctgtcagccaggctggggtgcagtggtgcgatctctgctcactgcagcctctgcctgttgagctcaagtgatcctcctgagtaggtgagactacaggtgggtaccaccacgcccagctaatttttgtattttttgtatagacacggtctcatcatgttgcccaggttgttttttttgaggcattcttgctttgtcacccaggctggagggcagtgacgtgatcttggttctcagctcactgcaacttctacctcctgtgttcaagcagttctcctgcctcagcctcctgagtagctgggattacaggcatgagccaccacgcccagctaatttttgtatttttagtagagacagggtttcatcatgttggccagtctggtcttgaactcctgacctcaggtgatttgcccacctcggcctcccagagtgttgggattgcaggcatgagccactgtacccggcctcccaggctgtatttttaataaaagtccaaatgtgtcagttttttctttcatgattgtgcttttttgcttctccttttttatgtgattaaaattacttgttttaagaagttgaagagtcttagtttgggccgtttcttattggattggcagcttgataaagcatgttgaatggtggttactttgatttttttctgtttcttggtggagatctccgggtagtgtggacattagttctctttttggcattgatgtaaatggcatttaaattcaagtaattttactttcagtatctgatgaaatcatgctactatggacaaatggctctttggtcttgtctctgcaacaatgacatgctgttttaaagacttaatcttaaatgtttgtgcttctcctaagtagaaatagatctctaatttgcttttttaaatattagctaaacaaatcagcttcttatttaattggcaattaatatttctttgagttcatcttttgggccaactttctcttacagatcaataagtaaatctatgctcattaatggtagtgactctacctcaggtactcacattttacccttggtttttttcctggtaatcttgcttatggtgggttgtagtttgttgtttcaggtcagttaatctttttcttcagtttctgatattgatatcctactttaaaagattcaccttataccaacactacaaaattacacattatactacttctctgttttctctccttacacccaaggcttcaatctagatggagttttggtgtaagcagatagctgtttgaaagaaaatgaaagatcatttctgtctagattccttagcagttagaatgaatacacatgtacctgttttccttttcagatgaattcaaataaaactaattgtagtgacatgtcagtgacctatccatatctgcaatctaacaacatgtgaggtgtggaggaagtggcagtgccagagggctatcatgaaactaatagcttcttgtctggaagtgatttgaggagtgaaatccattgccctctcaaactttaatgtgtgcaattaaagcatcagcaactcaaagttggtggtcagaagagcagctttctttgtatttgccttcagtttattgtggtctgaattttgatctccggttttgggctgaaagaatgaaaagtgtttattctgacagtgacatttggtttttactcatctgtttagtaaacctttttgatgtaaaataatgttcaatcctgtctagaaattgctgtagaaagcaaactcttctcaaactttaggcagagctaaatatattttttcaatattcaaacagttatctgtatgttaaaataaattctgggccaggcatggtagctcacgcttgtaatctcagcacttggagaggccaaggtgggaggatcacttgaggtcaggaattagcgaccagcgtaggcaacatggggagactgtctctacaaaaaaaaaaaaaaaaaaaagaaagattaaaaattagctgggcatggtggcacacacctgtagtcccagctactcggaaggaggctgaggtgggaggattgcttacggccaggagttcaaggctgcagtgaggtatgatcatgccatagcaatccaggctgggtgacagagtgagaccctgtctcttaaaaataaataagtaaatacatacatactggacttgtttgctaaatcttagcgatagggactgtaaaacttttctttttcttgcttttttttgagacggaattttactcttgttgcccaggctggagtgcaatggcatgatctcggctcactgcaacctctacctcctgggttcaaccaattctcctgcctcagcctcccgagtagctgcgattataggcatgcaccactacacttggctaatttttgtatttttagtaaagacagggtttcaccatgttggtcaggccggtctcgaactcctgacttcaggtgatccacctgtcttggcctcccaaagtgctgggattacaggtatgaaccactgcacctggccaggaaaacttttcttacaagatggtaattcggtcgggtgcagtggctcatgtctgtaatcctagcacgttgtgaggctgagatgggaggatcacttgaggccaggagtttgagaccagcctggtcaacatagtgagacccccatctctattaaaaaaaaaaaagatagtaacttaaggaaataaaattaacaaaaggactgatttcttatgtacttctatgctgacttagtgtaacccaaaatttaacatgctatttaatatgtcagtgcaactgctttttagtttctgtttattgttcaggataattttttctcctgatattcttgaagtaaatttttagctttaaacaaattcttctgtcacagaatgaccttggttttaaaaaagggaattgactatacttgcaaagttcattttttttttctaaaaaagaaaaaggcagtatttacacatctgaatccttaatttgtaccagttcttcagcactgtcttacttcctggctgcagggccatttgttgccgtatggtgttgtaactttaggttggtgcaaaagtaactgtgttttgcattgacatggcaccagcctaagagctagctctaactggctgaatgtcttttctgactttcaacatcacaccagctgtattagcagagatgactaagcattgggtaatttcacttcatgctaaccactataaattggttcagttgatgtgtgtgtgtgtgtgtgtgtgtgtgtgtgtgtgtagactcctatataatttctacaatccttgctttaaaacctgcaaaatgtattttttgttttgtcttttcctttttgagacagggtctccttctgtcacccaggctgaagtgtgatcatggctcactgcagctttgacctcctggtctcaagcaatcctcctgcctcagcctcccaagtagctgggactacaggcatgcaccatcacgctcagctaatttttaaatttttgtagagatggagtcttgctatgtttcccaggctggtcttgaacccctgggctcaagtgatcctcccacctcagtcccccaaagtgttgggattataggtgtgagccactgtgcctggccaaaacctgcaaaccatgttaaatctatgttgtgttcctttcggaagagatgtctaatattaacttgtgttatataaaatctaaaacataggctttcaatattgttttaacagtatataacagaattggcaaatgccctgtcttactgtcattcgaagagagttattcatagagacattaagccagagaacttacttcttggatcagctggagagcttaaaattgcagattttgggtggtcagtacatgctccatcttccaggtatgtaactttagaggtggaagttgtttggtttaccaaagccctgggagctaaccgtgagctaaatgtaaaatatttcagtgtagattttgtgctgtaagaggggtaggtggctaacccagaagtactttggagtaatttaggcttaataataaactagggtttgcaagaaagtgttattctgtggagatttggggctattagcagtgttctaggcctagggttgaagatgcttaatgtccttagaggctaatgaagggatgaatgagtcaacagataggacacgtatatgacagaggtgaagtgcccacatgttgagtgggaggaactcttcacctctgctgcttcctggatgaggagatggggagatggttcagaggacagcactgacaaagatctagagctcagagtgcaggccatatcagggaacttgaaacactaaattagtttggtggtgctttgagggcagtggtgagagattctcttcagtctgcctctgtcaatagtagggatagtcctttcttatcccctgtcacagctgaagcagagatgtcagtctcaaaacaattcaaatcttagctttccaagtgaactacaatatctttactgttttaaatttgagtttaaataagctttgaaacttcacatgaagtggggcattttaaaacatatatctaccgatgaagttttgtcaactttggaggaggactcaaattatagccaaatgacttaaaaatcaagctagttaaaaaaaaagtatagcctaaaatagaatatgagggagaaaacctttgcttttgttacagagcacttctaattgttccagcaatgcactgaatctgctattgcagtcttttttttttttttttttttaaactggttgtcattagtgggagctgttatctggtgagacaaaccagaataaagacttacaggcttcatggaatcgcagagttaaactgtatcttaaccggttgaattgtgatagaaaagatggcttcttgctttttgaaaagattacttacataaccgatagtcacttcactccaaatcccagatgttaatcatcatcatttcctggttattgcctcagtttgagaacccccgattcagtccgtcggtgctgatggaggggttagatgaccagagtggtagcttcttaatcctacgtcacaattcagtggtgagtgactgtttgtgtgctcagtgggtgccaggcctggctgaacacagcaccagggctgtgaccacgtaagcctccatggtgaagagcagctgataacaaagcaacacgaacccacacagactgttctggcttggtgtctgctgttcccagcttttttccaaccttcgttaaaaaaacctaaaccgataaaaatgcggaattggtagttgatggcatacctgtctatacagtgcctacgttcagcagtttttcccatttagtcagaagggctgcatctgcttttttagtgaacacttgaaaatacgttgcaaacatcatgatgcttcaaccttaagcactataatagaatgcatttcctaaataaggatattctcctatataactagaaccatgatcactcctaagaaaattaacagcattgtcagtatctaatatttagtccacattcagatttctcctattgtccatgacatcttatagctggtttgtaaaatcagaactcaaccaaagcccatgctttgtattggactgtctatgtggttggattgtctctgtggttggactgtctctgtggttggactgtctctgtggttggattgtctctgtggtctaaagccagaccagtctcccactttaaagaggacttttctgattgtgttgccacttaacttggacctttattccccgtatttgctgaaaactggaatgtaggtctcaggtcctgaagagattcaggttaagaaaatttttttttttttttgagacagagtctcgctctgtcacccaggctggagtgcagtggtgcgatcttggctcactacaagctcgcctcccgggttcacgccattcttctgcctcagcctcctgagtagctaggactacaggcgcacaccaccacacccggctaattttttgtatttttagtagatacggcgtttcaccatgttagccaggatggtctcgatctcctgacctcgtgatccgcctccctcggcctcccaaagtgctggcattacaggcatgagccactgcacccagccaggttaaatatttttggcaagagtacttcataggccaccctcaaaatttcagcatcactcgtaccaagtatctatcacaaggcagcatgtgtctacatctccaccccagtgctgttacagtgggacagtttctagtgtattgtcattgcgaccaggcttttaagattcttagcatatctgtaatatccacatgcagatgtagaatccaaatcgtatttacagagaactttgcatggcagcttttatatggtagtgatacattcagtttcttacattctagattattcagggaggttctggagttggacagatttggggttaagcctgatggctagctgtgtgaccttacacacctcgcttcatctgtttcctatgggaatttataatagtagctacttcctagggcacaggatctggcccaggggaagacctcagtgttagtggactctttaatgattgttagcagctgttgtgatcataaaacgagaagcacatcaacctgagcctccctccgttttcaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggtaagacgcaactgaaaaggacccagcacatctgctggaattctttccttatcagcctgaactgcaggccaagatccgaacatctatactatttgatctctctaacctgtgttttgtgatattttatcatttgttgtactccaggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtctgtgtggagtgctgtgtaattctttccaccatctgttcattgttggcctggaaatgagcaggggctgagaggagcaggtctcgccctcatctagtcctgcctcttctggtctctcctgttgggtgtactcctaatacttcattatatatattgtttatatatttgtcatatctttgtcatctgtccatcgactaaagatacggtgaaagtgactgtgatgaaggaaaagtagaagtgttgaacttagagctagtagagaaatctgcttgcatggccaatgctcagtgcaagaaactggacagcaggtatgtcaggatatgtcataacaaagtggccaatatagagaaacttaaaaacatgactcagtaaaactgcagctgccagcccccttgggacaaaggggcttctggttctcatagtcttgagctgaactgactttgaccttcccaaatagttcatgtgccaccctcccaagctatagttattatcacgtgactgactttcccagtgacaccagtgagacttgggacgtttccccagacaatcccacacaagcaaagaaaaagctcattgtagtagcacattaatacactggtcacagtgccacttcatcatcagcaacaaccatggcttaccagaaggaatataaaaaagttcataaactataaagatgtttcacagaatttaagctgctcactttgtcagataaattagagaaacaatggctttcatttttaaaatagatgttttattctgctagttccataaaaacaatgtaaacacaggcgttctgtacatcttgctggtgaattcacataatgcttagttccctgatcctttgacctccttgtcttctccggttattttctgtttggacccctggccacaggagtggagtggggttggggcttaggagagagcaatgtggctttttggtatgatttgttttattgcttgcccgctcagcacgctcctgttactcctaacaaagtttgagatttaagcccttaaacctgtaggtttcaccatcagtttttcttttttttctttttttttttttgcataggcattactagggacataaatgggagactggcatagaaagtggtgaggagccgaagccaaggaattgctttaaacacaagatgaaaatactctgttctgtccaaagcatcacctaatggtgtgaggcatctcacttagctgtggagaagtccttggaattagatctcagaaagacagctttaagacagtaaaaccttttggcaatgggctaattgccttaaaagaagagttctacctgaaagaccttgcaggtggagaaattgtcctacaaagattcttggatatgttagtggagataactgacatgggtagctgtgggtcaaccaggaactgtcaacaacctgatctctgcaaaaccaggatggccagttaatggtttattcagttctctgatggtcacaaatgtaattttatttagccttgtggaggttctgcaacaaatgtaattttaaaggaattaggagccagaaagataaatgcaactccttcaactacgtgacagggcagactggtgaatctgggttcccagagtgtggagcaagtgccctgcatcagagaatggcccagggggaacgtgcatgatgctgaaccccgcaggacagaattacttcaatcgcctgctcctgactactataaggacgaagcctcagtgtctcagtttggatctacgctgggatttctttcttttggagacagtgtctccctctgtcgcccaggctggagtgcagtggtgtgatcttggctcactgcaacctccacctcctgggttcaagcaatgctgcctcagcctccccagtagctgggactacaggcgtgtgccaccacacccggctaatttttgtatttgtagtagagacggggtttcatcatgttggccaggctggtctcgaactcctggcctcaagtgacacgcctgcctcaacctcccaaagtgctg

SEQ ID NO: 16333 - DNA, 26867 bp, Human; identical to SEQ ID NO: 16332

SEQ ID NO: 16334 - DNA, 15492 bp, Human
tccgaaaatgctgggattacgggcatgagccaccgcgcccggccttcactgaagtttcttatcaaatatccccgcactctggcctgggcaatggagtgagaccctgtctcaaaaaaaaaaattaagattaccattttacaattaagcaaataattccatgatgaagccaggcccagactacaggctggagcccttataaaaaaacagtgggtaagtaaaagttgataaacagcaacaaggaaatgcacacttgtgttaatcaaatatttaatttcacacatgctctaatgctttacttcccttacaattctaagtagcagtctaatgagatcacataggcctaacaacatttattcaacattcttctgagagaagctacaggcatttgctccaatttattctacctttctttctagggaaattgaataacaagcagaatggaataagattctaatccagaattctggagacaacgccaaggagactgcccttcaggtgactctaatctgcaaccagattgaagaaccagatgactttcacaggatccattcagttcaaaccagaagtcctactattttgaatagaaaagctgttaggctaatagcgcaggaggtttatacggtttattccttcctccctcagacctgtgcatgtctgcagagatgaagggaaggacgaactgagtaggttgctgaaaaacgtttaattcaagggacaaggaaggttacggaagaggaagagacattacgagagttaaggacagtggctacgtctacctcagccggatggttcttagaaatggagactctgaggcctaaccccaggtctaagaaaacagattctgcattttaacgtccccagacgatttgtatgcaccggtctgcatccctagttctcaatgaaacctaagaatcatctggagagtttgttaataactagacacctgggtcctacccctcagagattctgatttaccgggctctcggtggagctatatgtttaacaagcactgcaagttatcccggtacaactgctccaaggtctacggtctgagaagtacggaccgggaaggcctctgcaaggaggttctcattcatcaattcacccactcatccagccaggacaagggccttcttaggctattctatctaaagcggcccccgttaaaccgcactcctgcttttcctctgtaacacccaccccagctgcaagttctccgtacgcttaccgtctgtctccccacccactagaacgtgaactccaacacagcagagaccttctgtgcttttcttacccaggtgatctcggaggacaaaatccaatctgaagcccacccacccctcccgcgcatgtcaacaccactcaacaaaccccttgtacctctagctgtaataagtaacaagcagtatcctacagggcgcctcggtgcccaggagcggatgcaaaggcgctgggcgggcacaaggcagcgccaaggacactcagggacggaggaaccgacaggggacttgacgctccgccactccgaccagccgccccttgtccccgccgtcctcgtccgccactgagatatcccccacggtctacccacccgtcggctcccacctgcgacccaaggacccaagtcttccaagagctcagccgttagaattcaaaggttcttctttttaaataggagttaaaccctctagctagaaagccgattggcctgcgctcgagcgaggctgccttgtgattggttgacaacaaacccgacgccttgagtcgcgtttaagggcgcacaccgcgcgcaggcgcacttgctccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctggtactgggacacggggagagtagctggtgcggtcggctggggcatttagagaaaaccacagaaacgactggggcgagactggaagagtcgagagttagcaaggtggcatgcgcctctactttgtgtttcctaagttgcccggcttggcctgcaccccttcctcttctcgaagggcctcgcttccattcccacccagtccttagttcgcctctgcatccagatggtcgcggcgcatatagtgagggggcatctgtgttctagcctttccaactgcgatgtatccggtcctggatcgggttcttgtcctcgtgtgctcacctgcaaattggggataattaggcttctgtttacctggcgagtgaacgttctgtgggagttgagaagttaggagtgggccacttaaaatatatatatatatatacacacacacacacatatacatatatatacacacacatatgtgtgtgtgtgtgtgtgtgtatgtacacccgggatgtgctcagcagaagtgaagagaccggatagaacagtggtgtaggggaaccaaaaatggcttccctccatccttccaggtaccttattaggactaagagttaaattcacataagacgaattaacagattactgcagggtaaacaggatgtgcatgtaaagcattgagctagcatacggaaattattcgagtcatattaacccaacgttaacagtagaatctctcatcaacttttctttgccagactacccacttgtgattttcattctttattggtacttaagaatctcccatttttttcgggtaactgaacattgtccatgggagaaaaacgatatttaattacgtacaggagtcccacaaaatacgagactaaaagttgaagtcagatgattaaagcctacatggcatcctgagctactgaaaggaatgaatagagaattgggggcggggggcgggaagcagctctaacacaagttatgggacggtgaacggaggaaatgtatggtgaatcaagtttgttatgcagacagaataggtgatcttctgggtggtgtcagcctctaatctctcatgtgatccgagttaatcttccctggtttataaggattcgtgacaattgaggtatttttggagggtcagactttaggcaggtaaggaaagcacagggaaagcctcttcccgcctgctgttctccaggtgccctcagttcaaggtaatcagcccgccaaagcatcttgttttgggctggcatttcctgaactccttcagtggttaagctcagggatctggagttggcaattctggtgtgctttaaccttggacaagtaactcagccactttttacgttgagtaggtgtcctgacctccttgaacccatttcatcatctttatttgtgtcccaggattttctactcaagcatagacctactatgttcatgtactacttcatatacttgaatacattgaatgattttattcagtgaactgatgcttacaaagtacttagcatgacggtatctggcatgcaggaagtgcttaatgttattggttattattaacaccatcagtgtcatacagtgtgtaagaaatcaggctctgggccaggcgcagtggctcgcgcccgtaatcccagcactttgggaggcggaggcaggcagatcacctgaggtcaggagtttcgagaccagcctggccaatatggtgaaaccccgtctctactaaaaatacaaaaattagcctggtgtggtggcgggcgcctgtagtcttagctactcgggaggctgagacaggagaatagcttgaacccaggaggcggaggttgcagtgagccgagatcgcgccactgccctcaagcctgggcgacagagcgagactccgtctcaaaaagaaaaaagaaatcaggctctgaggtcacttttattctttattgctgtccccagacacctgtagccttttaatcttggtccaaacatacacatacataaaggcattgatttttggtaagcaaattatcatgttgaacagttggagttcttttttgaataagccagaaaccatttacagttttttgtctcttaagactgaaggaaaacttagacacttgtaagtcagtgcatgcacaatccttcccgattattactgtttttttttcatttttattgttttgaccttgattggcaatattttattgggcagctcacctttgagcctttctaacgcatttaactcggttggagtttttgtagtacagttgcttttttttgcttcatattttgatttactgtctaattagattatataattacagtaacaagctcagttgccttaaaacaggttttgagaatgagcataaaagattagtaaacatacagctcagctagtggaaccagcagtctagatcttgacaaaatagcagctatcttgcatattgcaggtaccagtcaatgtttaattaacagaagtaatggaagattctgggataacaataaagaacaaaaatcataggtagctagtttggtggagaagaaaagttggtgagagattgtaccgtaaacactggctaacatgacttgaacaatttctgtatgccaggcactgtgctcagggctttatatgcaccaccgtgtttaacttccagtaacttaacagctgaagaacctcaggcttagagaaatgaggtcactgaccaaagataatgcagctagtagagatgggatttgagtcctgcaagattaagtctgaccaaagagtcctatgttgcttctgtgatttactagagcctgtacccttcaccgtccattttccgtttttgcagctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggtagattgtgaacacaaatccatacgtcccatggcaaggttttagatattttcatatggcagaatttttcaagattattcttgttttgtttcagtacctagtatgagccgggtacttcagtaagtaagtagttcagcatgagttcaggaagtagctcagtaagtaaggggtaaagcaaagttcagattatgaagaccttaagctggttctggcctgagggtctttgtacacattatctggaacactctgtcagacatattactgacttccttcagattttacatcaaatgtcatctgagttctcttaactcctcctaaaataatccgaccctttcgtgcattttcccggttaccctgccatagcgatcccatttgttttataacagttgttttgaaatttcctttatcatttgggctgtttcccatgggatccttacctccacacttcccacctactgctgcccccttgtcaaaaaagactacaagttgagtaaggatcaggaccttgtattattcagcagtatatcctggagcctacctggctaataatagaaagcactcaataaaatattgaattaccaaacatgttaataccctttgacttggcagtgccaattgtgagcatttctcctggggaaataaaatggacaaactgcaatgccaacaacatggaattagctgtaaatttttaaatatccataaaagtgaatactataacataattatatagatgaatatttattagccaagatacacttttgttctgcttgattaagtgaacaagtgagtcacaacatgttacacagcattgctctattactgttttgaaaaataaaacagccgtgcacggggaaggatccctaagaatttataccgatacgttaacagttattatctctgggtggtaaaattcaaggtcatttttattttcttgttcatccatagtgttaatttttcctctactaatcaacatattatttgatttgtcaagttatttataaattttaaatgcatattcttgataaaccagtttttttaaaataactttatttcaaaaacatttcactagcattcatgttaacaatgtagctaacttaacgagcatcagagctgctaatatatctcaaccctaaaaatattaaaatttggaatggaaaaaaatggataatttaactacagaactgctattttttgagtttctgtagttgtagataaagtagtaaactctggaggcaagaacctggggaaatgactttgtctattggagcctaaccttccagcaacccatgtggcctcacagcgtggtgaactttgaatagcatgggcaaaatacacagttttgtaaagtgttaggtgtcacgcggctccaagaaataggaggttgacactggtgagcatctttccagtttggatctagaattttatcttggcctttttaagaaaaaacacttgttttgttacgcccttaattttgatttctttcaggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtaaaaattccagtcacatacttattgattgccttctgtttttcatttttggaaaaatgagagtatggttgaaaccagctttagtttgctacagttgtggattgtgcacttggattcagacacattctgtgccttgagcatctcttcttgttggtctaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggtaggaatctttagaaaggagctttacattttttcttaaatacaatgagctattgtacaactattctctttttaaaagtagtctcagtgatcatcctgtaagatgcgtacagaccaggatgcatgcccgatggcacatggatcagattttgttggcacatagatcacatgctatcatgtacctgctccctctggctggtcagagtttataatctgaccctttggagggtttggaatccatatcactctctaaaggttgtagatccctgttataaacaaaacacgaccagcttcactaatatataacttagaggaataaaaaaaaagttcatttgaaagtattaagtatttcctggcaaggtgacattcggtaccctattttgaatatgcattgcagaaatactaatgttttagttgtggcttctgtctgtttgataattaaactaggctggttgcagtggctcatgtctgtaatcccagcactttgagaagccaaagtgggaggatcacttgagcccagaagtttatggtcagcctgagcaatgtagtgagacctcatctctacaaaaaattcttttaatcagctgggcatggtggcacgcgccgatagtcccagctactcaggaggcggaggcaaggatgatcatttgagcccaagaggttgagcctgcagtgagctgtgaccatgccgctgcactccagcctgggcgacagagcaagaccctgtctgaaaaaaataataataaacttaatttttcactcaatatttgcagccctagagcaaattaaagaagctcttaggtacaagttgtacttcagttaaccatgcatgaatgtgtcattgtctgataatactccatccttagtttactcagtgttcatttgtaaataatgaagctcacttctgtagtttttggaataatataaccagtaaatatttagttttggaaatctattcaaaaaatactttcatatgttccagaaagcactttttttcttatgatacctgtgtaatatctaataattgttttatagattcttttcatcagccagatattttccacatttcctctggatttaattgttcaccagttggtcacttgtattaatgtctctgtcccaacaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggtatgtgagaagttgatgttacttaacatttctgtagtgtttacactttccagaactctcttttaagacctcacaatagagcaacacaatatctatgcattgagcaaggcagatgttaccctttcttagataagaggaaaccaagacttacaggttaagtcatttagccaaggctacacgacttggaaatagaacggtgctttctttgctcttctgagcacctcacaccgtggactagggctggattccatgcaagtaacatttgagaacctggtgatccatttgtagactggcctgccctcttcccacagaaatgtgaaagcaatccagagaaaagtttccaatagtagatctcagtattattaatatatgtattcatgaaagaatggctgagagggaagatcttatcccattcctaagagagcagacctagcccgcaaaggaaaccacgttaattctgaatgcagatataaagtaggctcagcagacagaaaaaaattgcatccactgaattctcatttatgtatgttggtctcattggtaacagtagtgcctgtggagtctttttataatgaaatctatttaaatttatcctatcactagtagggcccaagtctggttatttgataatgaatgttaaaacactgtcttctgttccttgtagcagcaaagactgttgtttggtagaaaacctccagaaaatttctgattgtttcttccattgtgagatatgtttgtatcatacactaaaattggcatgagcataactcaaaaaaaatcacaagaaaacagtattggaagggactggattgtgtttaagtttgcattgaagagtcagtgacatctgacccactagggggcagcataacttgccttagatttgtctcattgtaaccaaagttcccttccccagccatctttctggcttctggtaccactagcaaatcttaggaagagccatttttatcataattcttggtgacttcattgaaacacttgtataaagttgttctgaaaagtatttattataaagaactactttataatagttgtgtttgttgcaaaaagaagataaaaaagtgatcagggtaaatgtgaaagtactccccctatagaagttataactgttttaaggagtgtgctgtatctggacagatacacaccagcctactgacaatagcttatatatttgctctaggaatgttttgggtgttttataatagtatgaggttgattggcttgttttagtggggaatagcagtgtggtttttcaaaaatgtgattatgctgaatttatgcacagattccccttttccttttttctcatttcacaggtcaagcgcctgtcatgtcagcatgttaagatttctgttcccagttttaataattagttagaatttgggccaggcgcggtggctcacacctgtaatcccagcactttgggaggccgaggtgggcagatcacaaggtcaggagtttgagaccagcctggccaatatggtgaaaccccgtctctatgaaaaatacaaaaattagctgggcttggtggcgggcgcctgtagtcccagctacttgggaggctgaggcaggagaatagcttgaacctgggaggtggaggttgcagtgagccgagattgcgctgctgtactccagcctgggcgacagagtaagactccgtctcaaaaaatgataataataataattagttagaattcagagggtttttgaaatgatgaaaaaggaaaaactatcaaaactttagaaattgggatgcaaaaaattaaaaacaatataaataacatacaggactgggagaaaatggttatagcatatatacagatgttagacattgagttaacatccttaatctataaagagaactcatatgggaaaaagatgagtccaaactcgagaaaaaaggagccaaaggacagggggctgcagaagagaaaaatggtcaggaaatgtaagaaaaggtggccagccttgctgcagacccaagaaatgaatatggggacctggttttgttaatcagatttcaggagtcttaaagatttatattatctactattgatagagatttcgggaaatcatattttgttggtcagagtcagctggtaaaatatttcagcacagtttggtgtcatatcaaaattttaaatacacgctttttgacccactatatctactcttagaaattcaacctaaagaggtaattggacagacatgcacatgcccataaaaggatgtgtgtcccaacatcatttggagtggctgaaagttagaaacagcataaatgtccaataagaagcactgaggaaatctgttacgcatccatggacaacatacacctttaaaaataagtatgcatgctaacatgggctgagcactcgcactccagagcctcctttgcattctcttattcttaatcctcacagccttatggggtaggttctgtaactactccatggaacagatgagaaaattaaggctgaggaatgttaagtaatttgcccagggtcacattagtgttgaacccacatctgaccacacagactttgtgtttttatccactaagctgtattctgtctttacagatctgcactacatatgcttgaatattaatagtatatgacaaatgctctgacttaaagaagttacaaatgaagccagggactgtggctcacacctattatcccagcactttgggaggccaaggtgggcagatcatctgaggtcaggagtttgagaccagcctggccaacatggtgaaaccccatctctactaaaaatacaaaaattagttgagtgtggtggcacatgcctgtaatcccagctactcaggaggctgaggcaggagaatctcttgaacccaggaggcagaggttgcagtgagccgagatcacaccattgcactccagcctgggcaacagagtaagactctatctcaaaaaaaaaaaaaaaagagagaatttacaagtgagcacataacacttagatatttcgaaagagtattcaccaaagtattgactgttacctctgatgggtgcaattattaggcagtttttattttcctttttatactttatttggtacttttaaacataaaatatgtaatttatagtcataaaaaggcttccttttggaaagtagatattcatatactttgtctcagtaattctgtctctaggaatttactcctaaggaaataaagctttctgtacaaaggatgttcattacaacattacttataattgatataaactaaatgtcaggaagtaaaagaattgttaaacaggccgggcatggtggctcacacctgtaatcccagcactttgggaggccgaagcaggtggatcacaaggtcaggagataaagaccatcctggccaacctggtgaaaccctgtctttactaaaaatacaaaaattggctgggtgtggtggtgtccacctgtagtcccagctacttgggaggctgaggcgggagaatcactcgaacccaggaggcggaggttgcagtgagccgagatcacgccactgcactccagcctggcgacagagtgagactctgtctaaaaaaaaaaaaaaaagatcacacacaaaagaattgttaaataagtaatggggcttctaaacatgaggcactttgcatctagtaaaaaacatggaaaaatgtactcagcataaagttggttaaaactataatagaaaaatatagtggcaacaattttatatgtatttttaaaatgtgtttttttatgcctcaaagtacattaggacagtaacagtattgcttcaggtgatctggtgatctcctttttttttttcctgatgcagtcttgctcttgctctgttgcctgttgcccagactggtcttgaactcctgggctcaagcagccctccttcctcagcctcccaaagtactgggattacagacgtgagccactgtgcctggtttgattttcttttttgtacttttttagagtttctgaaagtgtacaaggtgtatcactgcaacaggtttaaaatgcttttacattgaatgctagaacgttctgagggtctaagatgtggacttagaaagctatccctcttgctctctgtggcaggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtggttttaagtcttcagttctcgtcagcatgaactaacttctcatcatggaggcacatagtaactgcattctcagaagatttatgcagttaaccaattgatacaagttttctttttcttgaatttttttttttttaattgaggcacagtcttgctctgtcacccaggttggagtgcagtggcgtgatctcagctcactgcaagctccgcctcctggtttcacaccattttcctgcctcagcctcccaagtagctgggactacaggcacccaccaccacgcccggctaattttttttttttttttttttttttttgtatttttagtagagccagggtttcaccatgttagccaggatggtctctatctcctgacctcgtgatccgcctgcctcagcctcccaaagttttgggattacaggcgtgagccaccgcgcccagccttcctgaagctttttagaacatgacagtacttctctggattcagcactagcagagtcagagaactctgaactccccttgtacaaacataaactttgctttatatttatcccaaaaaacaaataccttatgatctgcataggagtacctagaaatataatctgggatcatttgataaaaatagtaaatagattgaagtaaaagtcattgctttatattataggaagttttgttttgttttgttttgtttgttttgtttttgagacggagtttcgctcttgtcccccaggctttagtgcaatggcgcgatctcggctcaccgcagcctccgccacctgggttcaaacgattctcctgcctcaggctcccgagtaactaggattacaggcgtgcgccaccatgcccggctaattttgtattttttttagtagagacggggtttctccatgttggtcaggctggtctcgaactcccaacctcaggtaatccgcccgcctcagcctcccaaagtgctaggattacaggcgtgagccaccacgcgcggccccatcatacgaagttactgaagttattgcgtaaacattctgttttagtcatccttgaggatcgttttaactccttgatctgtaaaactgtcttaagcatcttaacatgttacatcacagggttttagctcagatttccaaagagccatattttttgatgcatatttccagttgaattccagtgtgaatttccagttgtactttgcattctgattctttgatatttgaacttggccatctgtgggtgctactctcgtaagactaaaaggcacctactaaatacgaacaaggataaccagttctaccaaaaacattaccaaccaaacctcccctgttcttttttcagactttccttttgctttcaacctcttaaactgtaaaggagagatttaatgtttccctattattctgctttgactcacatactaaaatgaccacatggcactccattgaatcttttcagttgttcacgaattaaaataatgcccatgttttacagtttttcgagtagtctcagcaatggatctgtagtttcaggacctgt

SEQ ID NO: 16335 - DNA, 87190 bp, Human
  misc_feature (1)...(87190): n = A,T,C or G
ttaattggctttgatggaactttgttccataaggaatctcacctgagatgttttttaaagcagagctcagccatgggtttgcacagttaaatacaggtatgagttgggtaaattcctctcctcttgaggtcccaagataacttgacacacctgggactgtagatagtgacagtctttatttacaacagatcaggaacctcgtacagggactgtgtagacaaggtatgtggccagttttctcaaggggcttttatcggttctataaatcaagtttgattccttaaaggaaagcacaacattccagtcaaaacttggtaaaataaccagtttctccagttgtgtcctgtgcaaaagaaaacagattcttacagaaatataagggattgatgggtaaagagtttaaaagctgtttatacatgcagtacattggatatgatataatttatggtttcttgtttgcagctgtttgtatctttttaatcccaaaccagacaaaattataaacattttatatacaatgttatcttggaaaaagttagatgtaaataattcatcttaatctatatttgagaaatctgaggggtattaggaaactcatgagtgaatgaacatatagattggatcaaaggaggagagtatgagagtagggagaccaggtaaaaaggtatcatagtcatctagaggtgaggttagtaagggttaagccattggtaataatgctggaagaaaaagaggttgtgttggacttatcgagagactatgtattggactcccacatggtgtgtcttcctaagagatttgtgttggcaattttgattatactcaatttcaattcaagtgatgactttagaacccaagccctgcttaagacatcatgattccatgcggatagactgaacagaattggaaatgggagttagtctgcatgactttcagagctcttaactgttaagaaattttgcttaaaatttgtgtttttgtgatggattaatggctataatttgaaagcgtggctacattgttgagtatgtatttgtcagagttaacccatcagatattaaaagtaccttttccctcttacagtccttgtccatttaataagtgtcttagtctgtgttgctataaaggagtacctgagactgggtaatttataaagaaaagaggtttatttgattcactgcaggctgtacaggaagcatggcacaggcatctgcttctggtgagggctttaggctgcttccattcatggcagaaggggaagcggagctggcgggtacagaggtcataaggcgagaggaagcaagagagatgggggagagaggctctttttaacaaccagctcttgagggaactaatagaacaagaactctttctcctaccctggcccctcagggatggcattactctgttcatgagggatccacttcaatgaccccaacacctgttactacaccccatctcccaacactggcacactgggggttaaatttcagcgtgagatttggagaagtcaaacatacaaactgtagcagtaagtatttagtagtatcatctgagaggatgttattcatgctgggtgagggggaggaatgggagatgagtgaagggtgctagactctaggatgcctttcccccatttccccaccaaaccagttcttttctttcttcttgtgtttataccttaagatttcttttgagaaaaaagggttagggtttatagctaaaaatgtttgaaatgattgctatgtatatttataatgtttggataaagactgatattcttttttaagaaaatacattttcctccctcatacttacctaatgcattgctattttcatgtattaatacaactttatatgagtacttttattatatgcatattgtaatatgggaatgtcaggtgatttttctgtgatttgaacattttgatttttcattatattgtgttcccacgtagtttttcagtttcacttattatatttgtttttgccttttctgtaggctttcaacagacctcacatctttcttcttatgaaattataactccttggagattaactagagaaagaagagaagcccctaggccctattcaaaacaagtaagttataattgttgagaaataatatgtggttaatttttttcttttctgttttagcacaaaggtgttatttgtagcagtgatcagttcagtgagttattacttggctgttacttagaatagcaccatatggtactgatgtcccctggatgttatgctagtaaaagcaacatattgagccttaatatccttttttttttttttaaaatggagtcttgctctgtcgcccaggctggagtgtgcagtggtgtgatctcggctcactgcaacctccaccttctgggttcaagtgattctcctgcctcagccttctgagtagctgggactacaggcatgtgccaccatgtctggctaattttttggtatttttcagtagagacagggtttcaccatgttggccaggctgatcttgaagtcctgacctcaggtcattcgcctgcctcggccttgcaaagtgctgggattacaggtgtgagccaccacgcccagccagtatcttttcttttttaaagacaatatgatcaactcgaaacataacagaatagaatagttaaacaaaattgtatcactagggtaggctgctgattatatacattttaactgacaggcaatggtcacagtgattttattataataagaattataattcttactataattatataacctcactcagtttgtgatagctagaacactttatactatatcttcactgatggtggagagtgataatgtgttaaatgcgtatattttatattagggaatatttactaaaatacaagttttattttcatattggaagaaacctactgtgctgtaaatggggtaaccagtgcacaaaaattattttttctactattcttttgtaaagtttgttcagaagtaatcttatttggactttaattttataagtccttcaactttatagaagtataattaaattttattataatttaacaatgacaggtaataatgcatagaatttagcttatgaattgtattaatatctgaattgctgatacactcagaaatgtaaggcagcgtgcctgttttttagggagtgggcattgtaaaaagaacactggagttgaggatcaggaacttttagttttggtcctccctgtgagtaccaccacctactagttgggttggtcactcaactccatttacatctctccaactgaggagtaaatgactctaagatctcctctgtagatgaatttatacattttacttgtttttggtttgaactgggcagactaccatttgattatgttttgtcttaggatagagttaatcagttaatccctgtttgggtgcgatcttggctcactgcagcctccgcctcctgggttcaagtgattctcgtgcctctgcctcctgagtagctgggactacaggcatgtgccactatacccagctaatttcgtatctttagttgagatggggttttgccatgttggccaggctggtctcgaactcttggcttcaagtgatccacctgcttcagcctcccagagtgctgggattacaggcatgagccacctgttttcctccttttctacagtcaatggtagactttcagcctagggaccatgttttctccttttttgtgtctctgatagtatcttcatttagtacttccctcattaatacttgggatcgtcatagataattgtcatttttatgctttggttaatatttggagaagtgatatagtcagtgcatattgaactggattttgctcattcaacagtgaatgtaattaactcgttaaaaagtatttattgagttactattgtatgctaggcaccatttaggtattggggatacggcagtgaacaaaacagacaaaaatttatgcccttgcatgaatgcagtcttgtattctatggagcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggatgtggaggtggatgacaggatccataggttggtctagcgcttagaagtcagaggcagatgtgccgtggtgaaggggttgatgctgtttcttgacaaaaggttaactgagtctggaaacggaagggaatattaagtagacacttctgataatgttagttgtcgagtccctccatgactttcttttttattaaagagttaaggcgaagtcacatctcttagttccagagatcacgttaagcacttgtggctaatgacatggtgaattgctggggaagttgtttcagagttgcctgaggtagagaagatgatcccatgaattggaggatgtgtatatatgttactttaattccttgactctaagatgccatcaattgtgagacacaccatattgttttatgtaccactaataaagacacggaagtggcccagcagggtggtttatgcctgtaatcccagcattttgggaagctgggtggatcacctcaggtcaggagttcaagaccagccttaccaatgtggtgaaaccccgtctctactaaaaatgcaaaaattagccgggtgtgttggtggacgcctgtaatcccagttacctgggaggctgagacaggagaatttcctgaacccgggaggcagaggttgcagtgagccgagattgtgccactgcattccagactaggtgacagagtgagactccatctcaaaaaaaaaaaaaaaaagacagaggtgctgctagttagtctagactgctttgcctttgtatgatgcatcctcatttcaaggacgttaatgtgagggaaaaaagcatgttttagaattgataaaatgaggtaagccctgtaatttgtatcataaaaggagttgaatttctttttaactttatataagtagaactaggtataatttcttgaaaccaagagtttcatttcatttagacaaaagcaggaactatctttgtactgtaggtaatacatcgatggacttgagaagataatccctgcagttatagctgaattagaaatgaatttaagaagagttagatagacatggggttattttccatgatcagttatgaaaggaaggaagggatgatcagagtatattttttattatttaagaatagacacaaagttcttctattaaatagttcagccaataccaaattattttaattcaggatggaatttcctgcatcttataaatgagatgttgttgaaaagtaatttttaagatgatgttttattcttttccccttctgtgcatttaggtatcttatgttattcaggctgaaggaaaagagcatattattcacttggaaaggaacaagtaagacatttaatttattttggcttttcagtaatgtttttccaatagtatattggttttctttctagtttgatatggtttagtggatcctgaaccctgggattaagcagatttagctcttcatattggtgctgcacagtggcagctggctgggcaggcagtgacttctaaacaggaaagaaggcagagactggaaccaagtacctccagtttattcttttcaaatgcatcactaagggagcaaaggctacacatatgtgggggagttggggagaaggggagcctgcagtgactgaatagggtccaattactggaaagactaaggttccacaggctacttctatgcctactcacatagactttaataaaggtaaaggatataatgcatcaggacaaagaaagtgcaggcagtcatcaaggcatgacccccagagtcctttctcagttgcacagatgtgctttgcctccagattatgaaccgctgagatatgtgtgaggcatcatattttctggggagcccaggcacaagtttactgaaggtatctttcctactttgctgatcatgtagctaaagtcaggctgtgtacctaactaaatcggacaaaaaccttccatttattcatctctagtcaatatagacaggctgtcaaccattgtggaagacagtatggcgattcctcaaggatctagaactagaaataccatttgacccagccatcccattactgggtatatacccaatagattataaatcatgctgctataaagacacatgcacacatatgtttattgcggcactattcacaatagcaaagacttggaaccaacccaaatgtccaacaatgacagactggattaagaaaatgtggcacatagacaccatggaatactatgcagccataaaaaaggatgagttcatgtcctttgtagggacatggatgaagctggaaaccatcattctcagcaaactattgcaaggacaaaaaaccaaacaccacatgttctcactcataggtgggaattgaacaatgagaacacttggacacaggaaggggaacatcacacaccagggcctgtcgtggggtagggggagtggggagggatagcattaggagatatacctaatgtaaatgatgagttaatgggtgcagcacaccaacttggcacatgtatacatatgtaacaaacctgcacgttgtacacatgtaccctagaacttaaaggataataataataaaaaaatatatagacaggctggtcccgggtgcctccaggggagttttgaacttgaaagggcatatttatgaatcactagttagcacattacatctctgacttgtccataaggcctggaaataagcatacagctgctccagtcctgctgcaagagaacgtgatcctcataaacatgcttgatgccactgaacctccttaacatggagtgaagatttggaaatcaggaataattgtttctttcaacaattgagacagaaatttgcctccatacttaggaggttaattcttatttatatagaactttaagaaaagagtgtaaaaaaccatttatttttctaatgtaaatatgatatactgtcaataacccagtttttacttttcctgtgagccatatctgaaaaatttagggacattatttatgttgtcttaaattttttggaactagcattttaagaccattacaaaatgtgtagcttaatattaaatattatttatgaataagtaatgtacactatttcagagttgtccgtttatgagctttttttttttctcctttttttttttttaagagacaaggtcttactctgttatccagggtggagtgcagaggcatgatcatagctcactgcagccttgaactcctgggcttaagcaatcctcccaccttagcttcctgagtagctgggactatatgtgtgtgccactatgcccagctaattttttattttttgtagtgacagggtctcaccgtgttgcttaggctggtctcaaactcctggcctcaagtgatcctcctacctcagccttccaaaatgttggggttacaagtgtgagccactgcacccagctgttatgagcttttaattttacaatagcacatttaaaaataatttatctggtgaaagttcttatttactcctgcttgtctcctctaggaataatgccttatgaatcgtgtccttagttgtagatagataacatatatataaacggtgttttatttctcttccagagaccttttgcctgaagattttgtggtttatacttacaacaaggaagggactttaatcactgaccatcccaatatacaggtaatgtatttttctcttgatcccatagcaaattttaaaacaattataatttaaaaatgagttctgtataggcactcaggactgttacattgcacagccccacagggtacctttaacattataacatatgggttatcttgggaaaagtgggtgcatttctatagactaagctgtaccttacagctctccaggtactcagtagttaaggttttttttttaaagactaggaaaataaatcttctatttaatggtaatccttactgatgagaaaatttgatatgttttgaaaataggagtttctgatttttttgttgaaagttaatatctctaaaagtgcacttattaaaacatttaatttgtcagtgatatttagtaaagaaaaacactcatttgatgttatgtgttctaatgttctaaattttttctgaaaataattgtttcctaaaagaggtgtggtcctctctgcatcagagaacagagtactcctggggacagagctggccagaatacccaaaataattggcagatgtcaaatttggctttctgtgtttattactagagcataaacatttctagttttgtttgagtgttttacagtcctttttggcagttaggtattatacctttttttcttttgcaatggttttcatgagaaatctttattcccattacatgtgtatgttttatttttcttctgaactttgtaatactttgctatgttgaattgtttctgttggtagcgcacttttgcagcattcttcaaataggaggcaaaaaaatctttagtttagattaattattagtacttacaaaaaccaaggaaatgctgacttaggcctatcttctggtccactatctgatttctttatcttagtgtgttgttggtccattgtttaatagaaaattagtagaggagtttgaatttaccttacagcataaaccagatagaaaataacgcattcatccagtcatgcatccaatgattaccaaggcagaaggccaaacaccacataatttgtgtcacttgacaaaagcagtaatgttaaaaggcatttttttcctcatagaggtttcttggcatactttcttcagacatacactgtttgggcttgagttttgactcattatttgctgatgaagctactttaatctgtttgtgccttggtatcttcgctttaaaatgtaataatagttaccactttatggatatactgggaaacttaactgagttaatacttacaagatgcttagaacagtctgacaatttttaactcaacgaatgttattatttgttgctattattgacagcgtatgttcttaaaactgccaaaaattgatttaattatatagaaacttatgtaactattatcttatataatacttaagtatcataagtatgatagagttatgcttttctgggtgtttgaaaaatgtcaactaagacagatggtgtctcacttatttcttggttatttaatattgttcagttagatgaaagtgtgattgtagatttgaaatacaaaataaaacttggatactgtgatttttttaacatggccagactgtcatgtattataatgacatatacttttgtccataaaatgaaattaagtttcactgaaaaatttacatactttcccctggggattctattgcttcagattaaagtttataaagtatcattagtgtcttccacagggtcattttacacaaacacagttttagtgagatgtcaactggcttttgttggttgttggattgactgtgatttaaaatgttaaagatgatataatgcatcttgttctgcttctaggctgaaaggtcactgaggcagagctgtttgtaccttgtatcccctggaattttgcctaaacatttgtgtactcatagggtggtaggagatagtccgcagatggtctaaagaatgccatgtgatactgtgagatgccaataatataaataaaactttgttattattaaacttgactggcctaaagtaattttgttagctctgcaatttctgtgatgattttcagcaatgtagcaatatttgaagataatacagtatttttcatttagaatcattgtcattatcggggctatgtggagggagttcataattcatccattgctcttagcgactgttttggactcaggtaagcaatttcctttatcttctttttttttgtttcccctatgtcttaccctctttcctgtttctgtctccaaattaaatcattttgggcacttagcaaaattggaatttactttgatgttactgaacatttttacagctgtgtttcagatatccttggcatgtttatttaagaaagtattatagttgatgagttttaatatgtaaagaggaaattttttttgagaccactcaatcatttttgctatttaaaatgaaatatactttaaatttctgtagcactttatatttataaaattttcacttgtattatttaagacttgtatttaagtcttattatgactgtgaataagagctcattatctctgtatttaggtgagcaaactgaagttcagataaattatattacaattcaaattaagttattatagtattaacattacattccttgaggtcatggcaacatggcactgtgctggttggttgactgcatgattgcttgaactaaaacatattagttctatataagatgaatatgattatattcacttaggcactaacacttatttggtagttactgtgtgccaggcaatatgttccgtgtgttttctgcttattaagtaattttgttttcagaacaatcctgtgcagagtgcaaaccaaggcagaggttaaatacctcgctgagagtcctgcagctagtagaagacatttggaattcagactcttgttctctggtccggatgccacattcttagccactattttgtagtgccttccatttcccgtagatcactcagggaggttaagtgacttacaggcagtgacgctgctaagtagctatttgagctttcaatttaggtccgtcccagccctatctgtctgattctaaagcctctattttcttctctatgtaatgctatgcctacttacacatttaagaattaggacttgaacttaggttttctgattccttgtgtattttctttttcttaaaatttgtatacgtgtaatgcaacattcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgagtaaggaaataacataattcttcatggctcagactaccattttagaaaaatcatgtatttattcatgaaatcaatactatgagtagtgtttttttttcttttcttaattttgccaaatatatgccagacattgtgataggtactaggggatgaaaagatgagcgatatatagttcctgctaccaagttgagtacagtttagatcctgtgggttttggaaactaggacttaaatctgcaacaatgttcactgtggccttgacctcttgagctcaagcaatcctcctgcctcagcatcccagtagctactgctacaggtctgtgccacccaccgtgcctggctaatttaaaacaactttttgtagagatgaggtctcattacattacccaggctggtcttgaacccctggtatcaagcaatcctacctgcctcagcttcccaaagtgctgggattataggcataagccactgcacccagtgcaatagagtttttatttaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacatgggtgtctcttagactgaaatggttctaagactagatcaacttcagctgcagggattgtccctttctacatatgagattctgttgctgccttgaaagaggcatatttttaattaagttatactagtttatggcattatttttattgcctctgctgctatccactcttttgacttgggctattctttttaactttaaacattggaaaacattaaaatttttgcttattctacttcgcatgaatttctgtaaaatgacaaaactagtcattttttaaaatggcaacccttattctaacttctgctctgggatattagtggatatgttttctttatctctcagcatagtaatggggtttttcattaaaatatgtgtgtgtttgcatgtgtgtgtgtgtgtagttttgattttagaaaattggtaattctgctttgtaaacttaaacccattttatctgtaactaacatttttctcatattagtgcagatagcagataacacttcaaaaacatttttttcccctcagacatagtttatcatcacttaaagtcattagcagaactggacaaagttttcatcactaagaagcagataacacttcaaaaaacatatttttcactttcttgatataggatatgttaagtaaaataattttatgatgttcttagcagacatgaaataagtgatgagagattaggatgtgatcatagccttataacttccttttgcctttatgatgtttgtgtttttgacagagaagaagagctgtcttgccacagacccggtatgtggagctgttcattgtcgtagacaaggaaagggtaagattggtgacaatttttcttcttttccatgaaaaggatatgagaagtgagcatttaatgaaggaaatctaaactacacattgtttgtattgattttacttaaataatgattttaaaactaaaatggtttttttcccttaaactttataccaccagaataccaacagaagctaaatgtagcaaatgtgactgcctttaactttatcttttattaatgatttttttttctttttcttgctgatgacttgcttatgctgaattttttgagtgaatctgtactgcctatcaggctcttgagaacttttcagattactttaatgggctgtggctctaaaaggtttggctttgttggctaataaaattgctttgctttctagaatttgagataacctatattgcactttgagagatggaaaacctccaggtcctggcatgctttagaagggaatagtattaatttccgtgtataggatcacatgagggcattttccttatttatacttaagaaactgaactaagtgctttgctttaactaagagaagtaatgtgtccctattttggcatttacaggattatcagttttagagataatggctgtataatttattttcatgttgctttttttattgatatataatacttcacatgtttagggggtacaggtgagtatttgttacaacagctgtgtaatttaaaaaagagagtatttttagtgttttgtttgacttttacttccaactttgttgtcagtgtgaaaaagttatttgtggaaacttactatgattggcagttcctttcttgtaagctgtagagacagttttgaggttttttttggttttaaaaaaattccttgttgtatgtaggttggaaaataacaagccaccccaaataactaatttggagaaaatattaagagatagacttggatttgtacattataggttcattgccctcaagtggcagaaggaaaagcatatggaatatgaacaagtgtgaactctgccccaaacagtgggcaaaaagcttctgtagaagaatgttttggacaagtcacaaaagtcaagattcaaaatgttttccttggctgggcgcagtggctcacgcctgtaatcccagcactttgggaggccgaggcgggcggatcacgagatcaggagattgataccatcctggctaacacggtgaaatcccatctctcctaaaaatacaaaaaattagccgggcgtggtggcgggcgcctgtgatcccagaacccgggaggcggagcttgcagtgagctgagatggcgccactgcactgcagcctgggtgacagagggagacttcatctcaaaaaaacaaaacaaaacaaaacacacacaaaatgttcttcttcattgctgtctccagatgtatttgttatatacagatagaaaatggttaaaaaaaaggttcaatttcaatcaagccctatcaaatatattaaattaattttttttcttgtttaggaggatcatgattagatccctaactgataaaatctgatatattctgatactaatgcttttagcatagagcaaaatcataaatccttttaaaatttttcttctgctaaattggttatataaattaatgttaaaaatagacatttcagtttagccaggtgtcaaagaaaaattagtcatatttatttggcttaagatggttaaacttttatatattttcatctacatatgattttttaactagtgattattggttaatctctcatttttaattcagcccagcatttagaaatggtttattggtgctgatctgtaaccaatctggctgtttctgtctcagttctattttctgtatgtcacttcgtttttctgtccataaatcttcttccactatgtggctgcacagagtctctctgaacctgttctggtttggaagccacacaattcttgaatcagtcattctttgctcaactaaattctgttaaattaaaaaaaaaaaagtttattgattacatcattagcttaagaggtgaaagggtcaggaagttctttagattgtcttttattcttttatctatgcattttgattgcttaaaactctacctttgtgaaatgcttgaaaatatttttgcattaaaataaaaggaacattaagaagataattcgttttaaagttctactaatttggataaaatgaagtcttcagtgctctttcattattattcactttacccttttacctgtttttcttttattcctgtcactacaatgtaacctttaaatttcttaatttgaaatgttgataaatgtctaaatgcctcaattttttgttcagaggaaatatttggattcttcatagtaacagacacatttttattttatttttattttttttgagatggagttttgctctttctcccagactggagtgaaatggcgggatcttggctcactgcaacttccacccccacgggttcaagcgattctcctgcctcagtctcctgagtagctgggattataggcacctgccaccacgcctggctaatttttgtatttttagtagagagaaggtttcgccatgttggctaggctggtctcgaactcctgacctcaggtgatctacccgcctgggcctctcaaaatgctagaattacaggcatgaggtactgcacccggccttacatttctattcttaaagtactttggtgataatgattctccttctttgcttttccagtatgacatgatgggaagaaatcagactgctgtgagagaagagatgattctcctggcaaactacttggatagtgtaagttgtattttctatcaaccaggatgattctgtcctattctttcagtcccagaacagaacttaaaaatgtctcattttgagttctgattttcatagggcctcaatgacttagtctttcagaggtctgctttctggtttgttttgtaactctttttaatgtttaaaggaaagtaccagtgtagaaagactgagaagagcaagagatttcatattagcatctactttatcttcagagttgctaggcttaggtgctttggcatttatggaaagatctttgaatttttgtcgaatgcatcttattttgaataaggctgccttctaccctgaaaacatgatatgacaatatttgtgtgtgtgtgtgtgtgtgtgtgtgtgtgtgtgagagagagagagagagagagagaaagagagtgtttggtttgagattttggagttcatccggtgggagatattaaagaattagatatatgttcttataattttatctacaaagctgatatgaacattaaacgtgatgatgacgatgatgatgatagcattcacttgagtacttacagtgtgctagacactgagctaagtgctttacatttattaacccatttactccttacagtacccctatgaaattatgagttccacagtcctttatctgaaacctctgatgtacctgtgattaaaattttagataagtttagaaaaacagtgtgattaactctgtattatataacaccttcgacaggatcttggggtagcacctcataatcagactcattgatatttctgcagtgaaatataggaatatttacattaaataggttaaatgtggactatgaatgggcttgcattatatcagggcaaattttggagccagttttaccaaaaacttaatttccagagtttgtcagattttagaatagaagataataaggatttcgaatctctgttactattattttatggttgaggaaactgagactattgagaggttaaagttttattgtatttttttttttatgagatgagtctcgctctgttgcccaggctggagtccagtggcgcaatctcggctcactgcagactctgcctcccaggttcaagcgattctcctgcctcagcctcccaagtagctgggtttacaggtgtgcaccaccacgcccagctaatttttgtattttagtagagacgggatttcaccatattggccaggttggtctccaactcctgatctccggtgatccaactgcctcggcctcccaaagtgttaagattacaggcgtgagccactgcgccccgcccaaagtctcattgtattaaaggaaagatagttttttttaggcaggggagttttaatttaagtagccgtgttacttcatgtggttaaaagatttttctcacgttctttactatattttatatacttttatttctttcttcccagatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctgtaagtattttttttttaagtactattaatgaaataatcaaaataataatttttgcttattttcttgtattagaattatattctcttgaggttttggggtattcatttaaatgaggaaaacttagcttgatgtggcattatcatgagacctcttctgttttggattcctgtgacctttctcccatatcctccttttttcttgagtttacatcctcatttgggtatagtgtgctttgtactagttttttgtgaacggatatatagaaagaaaacattttgacctcctgtgtgtctgaaaatatggtttcccagtttcggaacagaattgaaaaattatctcaatttgagttctgattactctaggcctaagtaactcagtatttcctaggcatgctttgagtttcttttgcgtttgtttttttttttttttttttttttggagacagagtctcactctgttgcccagaccagagtgcagtggcacgatcttggctcactgcagcctctgcctcccaggtcgaagcaattctcctgcctcagcctcccgactagctgggattacaggtgcctgcccccacacctggctaatttttgtagtgtagcaaagatggggtctcaccatgttggccaggctggtctcgaactcctgacctcaggtgatccacctgttttggcctcccacagtgctgggattataggcgtgacactgggtataaaattgtatccgtgaaatcctttttcttcacgactttgaaggcgttgctcttttgtcttttttgtcccagcattactattgggaagtctgaaacattctgattcctgaccttttgtatgtggcctgtttttccccgtcactggaaacttgtaggatcttctcttggttcccaggcttctgaattttcctgatgatgtgttttggtgtgggtcttaatttttagtaaaatcgtacgctcacacatcctcgtaccagtgagaatgccatctagttcacaaaataccataaggagcaggtgtcaagcatactcactatgccttgcccaaccacacccaccaaactatcttaaccccctctctttgtgtggtctccatctgtcctgttagagacatttcccagatgcttgatgatttttagttgtttgtttacagttgagaatggggtcccgaaaacctttttggaagccttgagtccatgagtgcattttggggcctatgagttccttatagggtggtttggctggaatgtccttgtcaatctccttatgtcagtacctctggtcatcttctcctggctggtcagatggcccagagaaggatttatccattcatttaaaatatatttattgggtgtataccccagacactgggacatagcagtgaacaaaactggcaaaaattcctgctctcatggagtccatgttctggtggaggagattggctatacatgtgataaataagtacatgtagtatgttaaccaatgataagtggtaaggagaaaaataaaacgggagggtagatataaaagcattggaggttgtgattaaaattttagataaaagtttagaaaaacagtgttattcactgttgaattttgaggtgacatggtctagccagggagatgccttctgagtaaagacctgaaggaggtgagggaatgagtctgggttatattaatattagggaagagaggtccaggcggagggaacaggtgctgaggtacaggtgtgtggggtgtgactggggaggcacacagggcccatcctgaattcttttttttttattttggagacagagtctcattctatcacccaggctggagtgcagcggtgcagtcttggctcactgtggcctccgcctcccaggttcaaatgattcttctgcctcagcctcccgagttgctaggattacagatgtgcgccaccatggctggctaattttcgtatttgtttttttagtagagatggggtttcatgatgttggccaggcttgtctcaaactcctgacctcaggtgatctgcccacctcggcctcccaaagtactgggattacaggcatgagccaccacgtctggcccatccttactcctcatgttcaccctgctcactgccctgcagctgcccgtgtaaacatattcatttcattcgttatctgtctctcctcactaaaatgtgtattttaatatatagttaaatataataagtgtataaataaacctaatgtattttaggagaggtttcacctagaaggtaaaaagaaacaaacttgtctcggtatccagaaagtgtcttcatttgtctgaaaaaattaataagaaggagataaggcataagtatattctgattttagaattttttttttttgccattttcctgccatgttttgtaggttctcccaatccagttgagattattcataaaataaaagcaatgtgttccttttttccccaagaacattttttaacttttacattttcatttagaaagaaaggttttggtggaactgcaggaatggcatttgtgggaacagtgtgttcaaggagccacgcaggcgggattaatgtggtacgttgttcttgatgtttaactttggatgtttgcactgggacaatatcaagcatttattgactgtatacttcctcccctggtccttaaaacaatattttgggtgttatgaggaacacagtagaagtcgcagatgggttctttccccagagactgggtcaagtttttaaatatgtgctatgtgtttattagctcttttcttttttattcattttattttactttaagttctgggacacatgtgcagaatgtccaggtttgttacataggtatacatgtgccatggtggtttgctgcacctatcaacccgtcatctaggttttaagccccgcatatgttaggtatttgtcctaatgctctccctccccttgctccccacctcccgacaggccccggtgtgtgatgttcccctccctgtgtccatgtgttctcattgttcaactcccacttatgagtgtagctctttactttttatgggtgaggaaacatgtactccattttagagaattaaattagaaccattaacttgttttcctataaactaccataagtaatctgttggtgctaaagtggttgacctcttgcttgaaggatccatgtccatcacgtgtgtgattcatgttactttcttactagactgaaatgtataaagactgttgttggatgcttgatttatcacgtaggctgtcaacagtgtagtgaataaatttccttttgtgaaaaaataatctgagcagcaaaacattttctttgcgttcagaaacctaattactaccttcctgttctgaacagtttggacaaatcactgtggagacatttgcttccattgttgctcatgaattgggtcataatcttggaatgaatcacgatgatgggagagattgttcctgtggagcaaagagctgcatcatgaattcaggagcatcgtgagtacctgggttcttcttctcctttatttggtattgtagatccatgtttcttacactgtgagggatattcatgtctacattgggaaaacaggaaatgttatttccggtttgctgaaattaattgcatgacataccaatgagaagtctttttttttttttttccagccttttagatttagggggtacatgtggagtttgttacctgatgtattgctgaagtctattttttaattaaatgattccagagagctttaagaaggcaatacttatgtaggcacaagtatgtaactacactcttctgtaaaccagttatagactgaaagtataagaacatggcaaagtttattatctgaattagaaattaagagggagtttctgctaggttcagtgtggattggattacactgaaggactgcataagaagtttcttcacaaacctctttttgagaaagtgctgcattgtcactgtaggtagaagagatcctgatatatttctattaacaaaccctgttttatagagataaaggtgggaggcaagacagagaagaggagagagaatggttaacatttgttaagctctttttatgtacaggcactattgtagccatttaaaacgtatccactcacttactactcatcagtgaaatgaggtgcacatactttatctccatttgcagatgaggaaactgaggtcacacatccaaattgctgactgggattcaaagtcaggaagtcaaagcctgtgatctgagaaccctttcctgtcccagagctaaaaaataattataatagaagatcccatggtggttgggcatcagaaatatagatttctaatgcagattcgttgtaatgccaacgaggttccttcctaatttagaaggcaggagtcctaagcagagagctgaatgtaactgtagttcgtacgtgtgtagatgttgagcctgagtgaaaattagatatgagaggtggtatctttaacaaatacaggacggacctggtggctcatgcctataatctcagcaattagggaggattgcttgagaccaggagttcaagaccaacctgggcaacacggtgagaccctgtctctaaaaaaaaataaataaataaataaaaaataaaatattaactgggtgtgttggtgcgtgcctgtagtcccagctactcaggaggttgaggcaggaggatcacttgagcccaggagttcaaggctgcagtgagctatgattgtgccactgcactccagcctgggcaacagagcaagaccctgtttcaaaacaaacacagatgaagatttcacatggggaatatccgtggccccaagtgttcatgccacttcccacctccctcaggctcctgaagcactgacagagtaataaaaacttctgtcaaccagcctttcagctgaagttctgagtggacaagacaatttcaatcacatgctagtataaagggaagcactcaagcagaatttacagtttttgaacaaatactaggctcaaaaatagatatggaagagttaaaatagtacttacaaaaagccatgcttcataaaaaaaaaattaggtatgtaaggaacgtcatatgtttgtaaaagatttcctgtaggagagggaagtaaatttaggatttgctttggccagcagtgaagttgagaaagacgtgagttcagggaaacaagaaatgtgtaatgagcaatgagataagtcatagattaaaataaaaaagaagcattcagaggtaaggagggaatgttatgaaacagtgccatagtggaatttaatatggtataggaagcaatgaagagtggacccatactttattcaccaacttgtcaaacatttattgagcactgaccacctgccagactttgttctcagcacttggaatacctcagtgagttagatcgactcacccttcaaggagtttacatctggggggaagacaatctataaacataagaaaatcaataatatagagtgttagaaggcgataagtgctatgggaaataaaatagagcagaatgtggaggattgggaggacggagggtggtgaaacaacagaacaggcttcagtatgacaaaactggatgttaataacagaaacctgagtgagttggtatttaaaaccactcccctaaagtcaaccctgtgtcaagcagacttacagtatacttaaaatattttgaggagaatggtatttttgaatattatatttaaaacagtgcatattgacgtttaaatatgaagataacatgatttcaaatttaaggtatccatcattttcccaagggaagagccaaaaaagtgttgttgttgttttttttttttttttggttgacttgaatgtgtataaacttgctagggatacagtagatagaaagggagtgaactgttcattactggatcttggagagtctctgtagccacaggggagactgaccccataggagttgaggtagagggacactgataacatgaggatactgataacatgaggtagagggacactgataacactgataacatgaggtagagggacactgataacactgataatagagagggttccaggtgaattattcagccttattctcccagtgacttcttatctcttgaatagaagtggccaaagtgagtacctatgtcttgtccagcttagtgggaaagcttttgatttttcactgtggagtatgatgttgtctgtgggcttttcatatatggcctttattatattgaagtgatttccctcttcctagtttgttgagatcttttgttgtgaaagaatgttgaattttatcaaatgcctttttggcacctgttgagatgattatgtgactttgatccttgattctgttaacgtggtgttaatacatttttgtgtgttgaaccgtccttgtgtcccaggtacaaatctcatttggtcggagggcctgatgtttctggtgtgttgttgagttctgtttgctagtatttgttttgaggatttttacatttatgttgctagggatattgacttacaattttcttttctggttgtcccttgtctgactttgatattagggtgatgctgggctcataaaatgagtttggaagtgttccttcctcttcaatattttgagaagacttttttttcttttaagcagttttaggttcacagaataatcaagaggaaagtagaaagactcctcccatatactttctgtccccacacttgcatagtctctccatttcaatatccctcaacagagtggtatggttgttaaaactgacaaacctatattgacacatcatgatttctcaaagtccatactttatggttcagtcttggtgttgtgcattctatgggtatgaacaagtgtatgatgacaagtatccctcattatggtatcatgcagagtatttccattgccttaaaaaatcctctgtgctccacctagtcatctctccccacccctccaacccttggcaaccactaatctttttactgtctccatagtttcgtgttttccagaatatcatatatttagaatcatgcagtatgttgccttttcatattggcttctttcacttagcaatatgcatttaaggctcctcatgtcttttcatgtcttgatagctcatttatttgtagtgctgaataataacccattgtttggatgtaccacagtttaaccatttacctactgaaggacatattggttgcttctaagctttggcaattatgaaaaaagctgccataagtgtccgtgtgcagggttttgtgtgatcatgttttcagctcctttgggtaaataccaagggatgcgattgctggatcatatgttaagagagtatgtttagttttgtaagaaactgccaaattgtcttccaaagtagctataccattttgtattcccaccaacagtgaatgagaattgctgttgctctacatctttgtcagaatttggtgttgtcagtgttctggattttggccattcctataggcatgtagtggtatctcattgtttcaatttacatttccctgatgacataggatgtagatgatctttttccttctttatgtcttctttgtggcatctgtgaaggtctttggcccattgtttaatcagattgtttcttttcttattttttagttttaagagttgcttgcatactttggataagagtcttttatcaaatatgtcttttgcaaatattttctactagtctgcagcttatcttctcattcttttaatattgtctttcacagagcatacatttaatattttaattctttcatggacgatgccttttgtgttgtatctaaaaaataattgccatatccaagatgatctaggttttctcccatgttatctcccaggagttttagagttttgaattttacacttagacctttgatccacatggagttaattgtggaggatgtaagatctgtgtctagatttatttatttattttttgcatatgaatatctaattgtagcagcaccatttgttgaaaagattatcttttattgtattgcctttgctcctttgtcagagatcagttagctgtatttatgtaggactctttttgggctctctatcttgttctctttatctatctgtcaccttttgctaataacacagtcttgaagcttgtgcatgcgtcacatagttctcgtgccatggttttcagctccatcaggccatttaaggtcctttctaccctgtttattctagttagccatttgtctaatcttttttcaaagtttttagcttccttgcgatgggttcgaatatcctcctttagcttggagaagtttgttattaccaaccttctaaagcctatttctgtcagcctgtcaaagtcattctctgtccagctttgttccgttgctggcgaggagctgtgatcctttggaggagaaggggcgctctgatttttagaattttcagcttttctgctctggtttctccccatctttgtggttttatctacctttggtctttgatgctgatgacctacagatggggttttggtgtggatgtcctttttgttgatgttgatgctattcctttctgtttgttggttttccttctgacagtcaggtccctcagctgcagatctgttggagtttgctggaggtccactccagaccctttttgcctgggtattaccagtggaggctgcagaacagcaaatattgcagaacagcaaatattgctgcctgatccttcctctggaagcctcatcccagaggggcacccgcctgtgtgaggtgtcattggcccctactgggaagtgtctcccagttaggctacatgggtgtcagggacccacttgaggaggcagtctgtctgttctcagagctcaaacactgtgctaggagaaccactgctctcttcagagctgtcagacagggacgtttaaatctgcagaagattctcttgccttttgtttagctatgccctgccccaagaggtgggatctacagaggcagcaggccttgcagagctgtggtgggctccgcccagttgagcttccctggctgctttgtttacctactcaagcctcagcaatggcagacgcccctccccctgccaggctgctgcctcacaggtcaatctgcctgctgccctagcagtgagcaaagctctgtgggcgtaggacccgccgagccaggcgtgggatgtaatctcctggtgtgctgtttgctaagaccattggaaaagcacagtatttgggtggggttgtcccaattttccaggtacagtctgtcacggcttcccttggctaggagagggaaatcccctgacctcttgtgcttcctgggtgaggcgatgccccgccctgctttggctcaccctctgtggactacacccactgtccaaccagtcccaatgagatgaaccaggtacctcagttggaaatgcagaaatcaccatcttctgcgtctgttacactgggagctgcagaccggagctgttcctattcggccatcttggaatggccacacggtcttgattactgcagctttagagtaagtcttgaagtcaggtagcaccagtcctccaactttgttcttcttctttactattatattggctattctgggtcttttgccaccccatgtaaactttaaaatcagttttatctatatccacaaactaatttgctgggattttgattaggatcgcattgaatgtatagatcaagttggggaactgacatcttaatattgagtctgcctgtatgtgagcatgaaatatctctccatttatttagttctttgattctttcatcagatagtgttatagtttccccatagagatcttatacgtattttgttagatttatacctaactctcatttttgggggtcctaatgtacatgatattatgtttttaatttcaaattctacttgttcattgctggcatataggaaagtaattgacttttgtatattaaccctgtatcctataaccttactgtaattgctttttagttccaggagtctttttcaattctttttgattttctacatagatgatcatattatctctgtacaaagacagtttttctttctttccagtcagtataccttttactttgttttcttttctcactgcagtagctaggactaccaatctgatattgctttaccttcctcacattttttttttagcattgacagtgtgtttttttttatttttaatagttatgcttctaaaacatatttaaattttatttttaatccaaattgaaaatatatgtcttataattatatcacttaatatatttatatttactgtaattactgatccatttaatcaaatctaaatgccattgattataagatacaccactttttccataccactgagaaagaaatatggtgtcaatgaaattaatacgtcaattgtaatctgaaatgaatctcagtttcaaagttatttaaatatggaaagaatgtgttttagaatcaattaaatacagcatttgggtttaaatctaccatcttatatctcctttatttgtcttcttttatggtttttttcttaaaagttttcggtcttaaatatttaagttgatggatgttccaattaccctgatttggtctttacacattgtatgaatggatcaagtgatcacatgtatcctgagaatatatacatctattgtgtatcagttaaaaatgggacgacaacaacaacaacaaaatcttctgtgttatttcttttgggttggtagagtgtttttatatttattttcactttgtagaaatgggttcttgttatgttgcccaggctggttttgaactcctaggcctaagcaatcctcccaccttagcctcctgatgtgctgggattacaggtgtgagccactgtgcactgccagatagagtgtttttagtagatactgtttttcttctagacatatttctagaatggaaattatgcagtcttttattttttttaaagttaccctagaaattattacacatgttcttatttatcatgtctactattaaatcttatccttccccacacagttcaaaggctatatcgtgccttaactccattcatcactttcttgactcatatagctgtgtgccaggaagatattagtgattgtttatcattattcatttagattttgaccactgcccttgctctttggtcctcttgcatctctgaccttccatttggtatccatttttcagtctgatcaaagaaccagttttgactttcctttaatgtgtttttagtagtagtgtatctcttagtttttgtttttgtttttctcctgagggtgtctttgtttctgttttttgaggatatttttgttgaatatagaatcgtagatcatcagttatttttcatcatattgggatttttccattgtcttttgctttccatgttgttgttgagatgtcaaggtgtcagaccattattccattgaaatgaatctgtctatttacctatggctgttttcacaattttgtctttaaacttttttttttgacgtttcattatcatgttcctgttgtagaaagaaaaaaatatacaacatgcatacatacgtatgttatgtatatataacacatttacacatatatgtcttcatatcctgcttagaaattttttagtgttttaaagtttgtggcttgatatttttcatcagtcggaaaattctcagtcatgtctttacatattgcctgtgtacacagggtgtctgcacatttgctgtctctcttacgcctctgtgattctagtgaactgtgtgttagacctcactatgtctcctttgtctcttagttttttaaatatgtttcctatctttttgtgtttttttcttctgtgtaatttcttctgatatctttcagctcactgattctgtcttcatatgtattttgtctgttgttaaacttatccattgaattattaattttgcttatttcatttgtcaaatttatgtctggttctttttcaaatctgatatattagttttgtagattttagtttcctgcccaaattttcatgcttgtcacttttgtctctgatcatagtaagcataaatgtcttatggctatcatttgataatcttagaactagtattaggagtctttattggactttatctgctcgtttttttctttcttgtagtgtattgtggcttcatgtggtattttatattgtgtagctgttatatttaaaattttttttaagaataatttctagaccgggtgcggtggctcacgcctgtaatcctagcactttgggaggctgaggcaggtggatcacgaggtcaggagatcgagaccatcctggctaatacgtgaaaccccgtctctgctaaaaatacaaaacattagccgggcatggtggcgggcgcctgtagtcccagctactgaggaggctgaggcaggcgaatggcatgaacccgggaggcagagcttgcagtgagctgagatcgtgccactgcattccagcctgggtgacagagcgagactctgtctcaaaacaaaacaaaacaaaacaaaacaaaaaaaagaataatttctgaactaggatgaggttatcctaggtaatacatatttttttctcttatttttcctcagattcctttttactaccaagctgatattaaactttctttttctgagggcatatttcctaccctctacttcataggctgtttaataaatgttaattttctatcattttgtttggcttttttttttagatgctagtgatgtacatgtttcattttttccccctcagataactcagtcattgggagccagttccatttaataaaatggataatctaccctcgtaataagatttttttgttattgtttatgatattttgggggcacagtggtattcttatgcattgctgttagattctggaaagtgtgagttgctcttcctgggaggtgcctttctagaaaaatggctttcttaactctgcccctcaatgtcagcaagcttccatcagcaagcttccataatcaggtgtttttttcttaatctaattcagtaccagcacttagaatcttctcttaagacttcctaatcctaggctgtgggaatcagcatagtaatggtgaaaattgtgttctgggaattttcagaggactcaaataaatatgttttgaatgatagttgaaatttttttttttgtcatttccatgtaaaacattttcattattgtcgatctccttttgaagccattttgggaaaatcacctagatgtgagaaaagagaggaggagaggctataaatcattaatattgtagagtctagaggtgatagagagtagaaatacttgagttgctcttcaagccccgtatcaggagaaagatcattctttttgttgccataggtgccagccagtgatggctagtggaagggtattttcactgtagcctctaaagcattttaaagtctcactgaaggccaacacaggggatgttgttactatctcccatctgttaaaaagcaccacaagtgtctatgattttgttatgctttttagttctatagtcaattcatgtgggtgaatttttttttttttttggtagattgctgaaggatcaagcatttgaaacattgtttataagaaaatatccttcaactaccagataatgagcttatttaaaaaataacttgtttagaggtggtagactttatgtaggttgaaattagggactaaaatataggactatacatatgcctgcgcaagttctttttttttttttttttttttttgagacggatctcgctctgtcacccaggctggagtgcagtggcgcagtctcggctcactgcaagctctgcctcccgggttcacgccattctcctgcctcagcctctctgagtagctgggactacaggcgcccgccactgcgcccggctaattttttttttttatttttagtaaaaacggggtttcaccgtggtctcgatctcctgacctcgtgatccacccgcctcggcctcccaaagtgctgggattacaagcgtaagccaccacgcccggcctgcctgcgcaagttctatggccattgtctaattaaatatatgtaatttataaatatatatttatgtagtatatatatttaaatatatatttaagtgtgtgtgtgtgtgtgtttttttttttttttttggagacagggtctctggagagcagtggcttgatcatagctcactgcagccttaaactcctcccaccccagcctcctgagtagctgggactacaggtgtgcaccaccatgcccagcttattttttgtagagacagggtctcattatgttgcccaggtggccttgaattcctgggctcaagtgatcctcttgccttagcttcccaaagcattgggattacattattaaatatattcctacagaaaacattattgcatgtataccatgtagcaggcgctgtgcttaccacataaagatcaacagtacaaaataaaaaacaattacaagcctctgtttaaactgcagtcttctttgtttatcaaataattattttatactgctttgacatttttacttgatgtctaataggctcaaactcctgtgatccctcctaaagttgtcctaaaatgtgatctacccatagtcttccccatgtgaattaatggtaactccttccttctagtatcccaggacaacaacctgggagtcattcttgatttctcttttttctcactcttcatcttaatggctgttcctttaaaacaaaagcaatccaaccacttcttacagctcccactgtttcattttggtccatcatcatctgtttggtggatttctctaagagccttctttgtagtcttcctcttaatagaacaagtatggtgatcctattaaaacattagtcaaatcacattactcctgcacttttcatggtcttccccttccaacttccccattccacttagagtagaaagccacattcctacaatggcctattcctgtctttgctgactgtatctctcatgactcatttcctcactgactcagtctgccaggaaagcttctaccccagagtttttgcatttgctattccttctttctatagtgttttcctcccagatacacagttttgattgaactgtcacatatttgaggtgcctgtcctgactgcccttttaaaatcacaagcatcccttcctctgcagagctcatcacacccacaccccgtcgccttttttccccatagcacttattaccttataatatgctatctaatttattatataagtaaatcactgaatcataatcataacctttacatgggcaggggatttttgtctgctatgttcacagtttcatcccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacctcagcgatccgcccgcctcagcctcccaaagtgctgggattacagcggtgagccaccatacctggccgttatctctttttgatggtagtcatcctaacaagggtgaggtggtatttcattgtggttttgatttgcacttccttgatgattaatgatattgagcatcttttcatgcacctgttggccatttttatgtcatctttggagaaatgtctatttaagtcttttgttcattttaaaaatcgagttatttgtttttctactatggagttgtgtgagttttaaaaaatatattttggatataagatacatggttataagatacaccttataagatatgtggtttgcagatattttctcccaatctgcagacttttcattttgttggttgttatctttgctgtgcagagctttttagtttgatagctatagtaatcaaaacagcatggtagtggtataaaaacagacacgtagaccgatggaacggaatagagagcccagaaacaaatccaaacatgtgtagtcaattaatttttgacaagggcaccaggaggatacaatggggaaaggatagttctcttcaataaatggttctggggtaactggatttctacatgcaaaagaatgaaattggacccttatcatacaccatacacaaaaatcaactcaaaatggataaaatacctaaatgtcagacttgaaactgtaaaactttctaagaagaaaacgttgaggaaaagctccttgacattggccttaacaatgatttttggatatcacaccaaaaactcagtctacaaaagcaaaaataaaatagaattttaatgtgacatggattcctcaaagatataggtgatgtataggtgtaatttccactagttttcaaaggtaaaaatagccagtgggactacctgaaagtattttatagttattgagtaaagtagtagctaaaaaaaaaatcccaggtagaacatatcaaaattgcatttatataaatctcacatagctcaagttggacatttcttaaaggccaactaactttcaaagtactaaccacggttcccaggaattatcataaaatttattatatgtaaagctcaagttgaaaacttgtcatataggagtagctgaaattctacactgtgcagtctgccttttgatggctagtgtgcatctgaactggagttgcccatttgcattatttttgcagagctcctaataagtggtaatgggcatgggtgaacataaaaatgttatccttcagagtagaaaaaagattggagacaacgtacagctaccttccaatatttgaagaacctttactgtgttagataaataaaactttattctcataggactaaataatttttaaagtctcttctgatgctgagaattatcattttgtatttcaatgtaagtgatatgttttaaagatattttattggaagtacaatatattgtaagaaaagtgaattattatatagtagctgaagtaatgttcaatatttatcacaagtagatatgaattctcatttctgtccacttttattagcttcttttctgtcatttaaaatattcacattttgtgggttaaagtcatgacttaacattttcaaagtgagtaatcactgtgacatagatctttttcttaatgtttattataggggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggtcagtttaatttttgacttttgccttgtaaaattgccatgatatttgcaagaaataaaatggcttgctttgggcaactctgacataggagctaaagtaaaatttagtggcacagtgaggattgttattttgtttgtatggctgtgttccagggattggtcatctccttcttctcagagtatgactaacggtgccatctgttttgaagtcagggaatgtgccatgtttattctctacttttttaatgctattttctatgatttatggttattagcttatttgctttaaagaatgaatttcacctggctctttatttgtaagctttcaccattctggcactgccattgcaggaatatttatttagctggactcattttaaaaatgaattggagctggcctgtcctccagcgtccttcagtattcaaagttcttgctactcaaagtagcactctaaaaaaaaaaaaattcaagtagtaagtaaaagcaaccttacacacgtttatttcccccataaatcttttacttcctttttttatgtttgatgtttttctttttagactattctgttcatttatatacagtatacagtaggtacatttataaatattgggcttgttttaggatttatttttactttaatgtggtaagaatacttagcatgaaattgatccttctaagagatttttaaatgtccagtacagtattgttaactctgggtactgtgttgtacagcacatctctagaactttttcactgtgtgtaactgaaactttgtatctgttgatcggcagctccccattttccattccacaagcccctgaccaccactattctgttcactgcttttatgaacttgactattttagatacctaatataagtggaatcaaatggtattatgtcctttgtggctgccttatttctcttagcatggtattgtatactcaagtttcatctacgttattgcaatgacaagatttccttcttttttgggaaatagtattccattgtatgtgtgtatatgtatgtatgtatgtacattttctttatccattcaactgttgacagacatttaggtggtttctacatcttggctactgtgaataatgccgcagtgaacataggaatgctaatatctcttcaagatcttgattttattttagataagtacccagaagtgggattgctagatcacatggtagttatatttttaatttttaaaagaaccttcgtactattttccatagtggctgcaccattttgcattcttcccaacagtgcacaagggttccagtttctccacattcttgccgacacttgttgtcttttgtttttttccgtgatagcaatcctaacaggtatgaaattatatttcattgtgattttgatttgcatttccatgatgatgagtgacattgagcatcttttcatatacctgttggctatttgtgtgtcttcatggagcaatgtctattaagtctcaggcctgttttaattatttttttgtttcttttaacatttttatatatttaggggatgtaaatgcagatttcttgcatgtatatattgcatattggtaaagtgagggcttttcatgtacctgtcattcaaatagtgaacattgtacccaataggtaatttttcagccctcacacccctcccatgctcccactttttggggtctccagtgtctgttattccactctgtacatccatgaatactgattgcttagctcccacttataagtgagaacatgcagtatttgactttctgcttctgagttacttcaattaggaaaattaacccattttaaatcaggttattagtttttcattttttgctattgagctgtagctcttcctgtatattttgaaagtttaccccttatggtttgcagatatttccccctattccataacttggcttttcactctgttgattgcttcctatgctgtgtagaaggtttttagtttgatatagccccacttgtctatttttggcttctgttgcctgtaattttggcatcatatccatgaaatcattgccaagaccaatgtcatgaagcttttcctctatgttttcttctaagagttttactgtttcaggccttatgtttaagtctttaatccattttaagttgatttttgtgtatggcgtaagataaggttccaatttcattcttttgcatgttgatatccagttttccacgggggaagggactaccttttcaccattctttttcttagcatccttgttgaagatcaggtgatctcatatgtgtgggtttttatttctgcattctttattctgttccattggtctatatgtctgaattttattttattttagattcagggggtacatatgtatgtttgttacatgggtatattgtatcctggtggggattgggcttctggtgtacccattacccaaacaatgaacattgtaccttataaataatttgtcagccctcactctcctcctaccctctccagccctcactctcctcctaccctctcctcttttggagttacccagtgtccatcacctccatctttatgtccatgtgcgcgcattgtttagcccatgcttataagtgagaatatgcagtgtttgattttgtgtttctgagttagttcacttaggataatggcctccagctccatccatgttgctgcagaggacatgatttcattcttttttatggctacatatagtattccgtggggtgtgtgtatgtgtgtgtgtgtatacatacatatatatgtatatatatgtgtgtgcacacatacatatgtatgtatatatgtgtgtgcacacatacctatgtatgtgtatatgtgtgtgcacacatacctatgtatgtgtatatgtgtgtgcacacatacctatgtatgtgtatgtgtgtgtgcatacatacatatgtatgtgtatgtgtgtgtgcatacatacatatgtatgtgtatgtgtgtgtgcatacatacatatgtatgtgtatgtgtgtgtgcatacatacatatgtgtgtgtgcatacatacatatgtgtgtgtgcatacatacatatgtgtgtgtgtatacatacatatatgtgtatatatgtgtatacatacatatatgtgtatatatgtgtatacatacatatatgtgtatatatgtgtatacatacatatatgtgtatatatgtgtatacatacatatatgtgtatatatgtgtatacatacatatatgtgtatatatgtgtatacatacatatgtatatgtgtgtgtacacctatacatgtgtgtgtacacctatacatgtgtgtgtacacctatacatgtgtgtacatacatataggtgtgtgtacatacacctataggtnnnnnnnnnnnnnnnnnnnnctatatgtgcgtgtgtacacacacctatatgtgcgcgtgtgtacacacacctatatgtgcgtgtgtgtacacacacctatatgtgcgtgtgtatacatatgtgtgtatacatacatatatatgtgcatatgtgtgtatatatgtgtgtgtgtatatgtgtgtgtgtgtatatatatatatatataaaagatttttctcatccagtcgactgttgatggacacttacattagtttcatgactttggtattgtgaatagtgctgcaatgagcatatgagtgcagataccttttttacataacgatttattttcctctgggtagatacccagtagtggaattgctgggtcaaatggtagttctagttttagttctttgaaaaatctttatactgttttccatagaggttgaactaatttacattctcaccaacaatgtataagcattcccttttttctgcatctgcaccaatatcagcctttttttttttgactttttaatgatagccattctgactattgtaagatgatatctcattgtggttttaatatgcattctctgattttcaatgatgttgagcattttttcctgtgtttggcagctgcttgtatttcttcttctgaggaatggattttattgaatctgcagatcactttgggtaatatggacaatttaccaattttaattattccaatccatgaacataggatgtctttccatttatttgtatcatcttttatttcttttagcaatgttttgtaagtttttagtgtgtgatctttttcctcacttgttaagcttattcacaaatgttttgttttcaatgctattgtaaatagctttgtttccttaatttcctttttgtagttcattgttagtatgtgaaaatgaccttatttttgtgtgtcagttttgtttcctgcaactttactgaatttatttattagttataacaagttttttgatggactctttgggattttctatatgtatgatcatgtcatcttaaaagagggacagttttgcttcatttccgatttagatgccttttagtttttcttgctaattgttctggctaggacttccaatactaagttgaatagaagtggcgagattgggcatccttgcttcatttctgatctcagaggaaaagctttttgtttttcacaactaggtatgattttagctatgggaatttcatatatggcctaattatgttgaagttattttcctttatttctagtttgttgagagctttttgcatgaaagggtgtagaattttatcaagtgctttttctgtatctattgagatgatcatgctatttttatccttcattttgttaatgtggtatatctcattatttaattaattaaatttttttttttttgagacagggtcttactgttgcccaggctggactgcagtgctgtgaacacagctcactgcagctttgacctaatgggcccaagtgatcctcgtgcctcagcctcttgagtagtcgggactacaggcatatgccaccatgcctcacacatttttgtatgttttgtagagaaggggttttgctacattgcctagactggtctcgaactcctggactcaagcagtctgcctgcgtaagacgcccagagtgctgggattacaggtgtgcaccactgcacctgatctcattaattgatttttgtatattgagccttaattgatttttgtatattgagccatcccaatttatacccaaggataaattctactaggtcatgttgtattttacttttaatgtgctgctgaatttggtttgctagtattttgttgaggattttgcatctgtatttgtttggcacattggcctgtagttttctatatttggcatattggccttggtgatacagtctgcatcaggataatgctggcctcataaaatgagtggaattttctcctcctcctctattttttgggtgaatttttagaatgattggcattagttctttaaatgtttggtagatttcaccagtaaagccattggtcctgtgcttttctttgctaggaggtttttgattactgattcatatccttactacttataggtctgttcagacttatttctttatgattcagtcttggtgggatgtgtgtttctaggaatttatccgtttcttttaggtgatccagtttgttgatgtgtaaatgtttatagtagtcttttataattctttttatttatggcatcagttgaaatgtctcctttctcatttctgattttgagtcttctctttctttttcttagtgtagctaagcttggttaatattgcttatcttttgaaaaatactaactcttggttttgctgatttttcaattctttttctagtctcaattttgtttatttctgatctgaagttcattatttcccttatgataattttgggtttaaattttctgttgcttttcagatttcttgggttgtaaagttaggttgtttatttgagtttttttttttaatataggttatcacagcaagctttccttgtattttttttttttgacagagtctcactgtgttgtccaggctggagtgtagtggggcaatcttggctcattgcaacctccacctcctggtttctagtgattcttgtgcctcagcctcctcagtagctaggattacaggcgcgcaccaccatgcctagctaatttttgtatttttagtagagatggggtttcgccatgttggccaggctggtctcgatctcctgatctcaggtgatctacccgccttggtctgggattacaggcgtgagccaccacatctgtcctccttttagtattatttttgttttatttcataagtttttacatattgtgttttttgtttgtccaaaagtattttttaatcttgtgtttaatttcctttttgacccaatggttgttccacagtgtgttgtttaatttccacatattggtgaattttccattttcctttctgcttttattgttgtctttttctattctaattgctagtttcatccattttggtcagaaaatatatttggtatgatttcagtcttcttaaatttctgaagacctgttttgtgacctaaaatgtgagcctggagagagttccatgtgtgcctgagaatagtatgtattctgccactgttgggtagaatgttctgtatatgtctattagtttgatttggtctgtagtgttgttcaagtcctgtgtttccgtattgatcttctatctagatgttttatccataattaaaatgcagtcttgaagtttcttactattattgtgttgctgtctctttctttcttcagttttgtcagtgcttgcattacatatttaggtgctctaatgctgggtgcatatatatttattattgttatatcttcctagtgaattgttacttttatcattataaaatgtttttctttgtgttttgtgacaattctgacatagagtctcttttctttgatacaaatataggtacccctgctctctgtggttaccatttgcatggaatatctttatccattcttcactttcagcctatatatgtccttagaactatagtgagtctcttgtagatagcatatagtttttttttttttttttttatccattcagtatgctatgtgtttttgttggggagtttaacatatttacatttaaagtaattcttgatagggaaggatttactgtgattgttttaaatgttttttgtttgtcttgtagctcttttgcctgccctttcttgctgttttcctttgtaattttttgattttgtgtgtgtgttgataattcttttatccctattcctttttcttttgtgtaacttccttctataggtatttgtttatggttaccttagagcgtgcataaaatatcttgtagtaataacagtatttttaagctgataacaacttaacctcaattacatacaaaaactcttcactttaagttctcccattacacagtttatgttgttgttacagtttacaatctattaatattgtgtatcttccaacatattttttatagtttttttttttttttttgagatggagttttgttcttgttgtccaggctggagtgcagtggtgcgatggctcactgtatcctccgcctcctgggttcaagtgattctcctgcctcagcctcccaagtagctgggactacaggtgcctgccaccacgcttggctaatttttgtatttttagtggagatggggttttaccatgttgtccaggctggtctcgaactcctgacctcaagtgatctgcctgcctcggcctcccaaagtgctgggattacaggcgtgagccactgcgcccggcctatagttacattttatactttttcttctaaatttacactagaagtgaaagtgatttacccagtaccattaacagcaacacagtattttgcatttgtctatatatttattcttactaattaattttatactttcttatgctcctgtgttgctgtctagcagtctttcatttcaaggtgcagaactccatttcacatttcttagaagaaaggtctaatcatgatgaacttccctgcttttgtttttctagaaaagtcttaatgtcttcttcatttttaaaggatagttttgccagatataggattctttcttggcagtttttttctttcattactttaatatgtcacctcattaaccttctggcctgcaagatttctgctgaaaaatccactaatggcctgatgggggttcccttgtatgtgatgaattgctttctttcttactgctttcaaaattctctttgtcttttgataatttgattgtaatgtttcttggtgttgatttctttagattcttcttacttaaggttctttgggcttcctgcatctggacgtccatttccttccccagatttgggaaaatttcaaccactacctctttgaaataagctttttggtactttttcttagtctgctccttgtgggattgccacagtgtgtatattagtctcttgatggtgtctcataagtcccttaagctttcttcacttatatttctttttttttttttgctcctctgacttgataaggtaacccgactttgagtttgttgaatctttattctgtttgctctgatctgctgttgaactcctctgttgcatttttccattaagttggtgtattcttcagccccgaaattagtgagaagaccttcactagttaacctggccagagcttttttgggcctctcaaactttcatgtttgttatactgccttttctattgttgttagcgctcagtgtctacaatatgctggagcctatcagtgttctgagaggggagaaagaagtgaatttgttgggcaatccctagaaaagttggaacatgtgacatgtggtccaacagtttctctttccagggaaaagcttggaagtgttttttttttttttttttttttttaatcactatgttaaactgggtagaggaactgtggcgagtgtctgagtgatagtttgaacaaccaccttcattctttgtagccttcaggggtctagcacataccagctccatctgtgctctgagagaggagagggaaaagccaatttcttgggtagctcctagaaaaattgtagcgttggatgtgtggtcctcctttgggagaagctaggagctgtggcaagtgcccacatgctagtttaacctactacctttgttctctgaaaaccccagggatctaatatattccaggtcctatatgttgtcagaggcagatgagatagaaggtagtccctcaggaagcactctaaaaaactgtaatattggatgtgtggcccaactctttctctcctcagggagatgctgagagctgtttcctcctgatcttatatgacgcgtcatgagttgggattgcggcgagaaaggatctccagttttcctactggtttcagtgtggctggttttacaattgcctgggatgtagtagcctctcaactagtttctggatttctcacaaagggaattgattagtgtgttactgttgaattgctgactttttataggagatttgttagcctccaataaaagttaaaatgtacatgcttttagatctagtaattctacctttatgtaactatcttagagaaatatttgtgtatatacacatggggagtgtacagggatgtttattgcagcactgcctgttggaggaaggagaatccagagctttctattctcccattttggtgatgccactctggcttttatttttgtgcataaataaaatcagacttaatattgtttaaaattgacttaaaatctcttgtgtgcagatttttttctattacgatatcctggacatttttctgtatcattttattatgtagacatagccctttaatttgctgaatagtattccaatacaaggatttactatgatttatttaaccatactctcattaattactgtaattagtgttttctattgtaaacagtgctgccgtatacatccttgtacacacctcatgtgtatatatacaaacatacacacctcatgtgtatatatacagatatacacacgtcgtgtatatatacaaatatttttctatgatagttattgtacataaaggtagaattattgtatctaaaagcatgtacattttaacttatatcagaagctaatgaatttcctataaatagtgtgggtcagtttgcatttctgacaacagtatattatgccattgtgtacccatagtcttaccagcacaggataatatgttttcttaattttggcaagctgatgggtaaaaaataagaagatactgttttagtttacagtttttcatgtgattgtagattataggcatcattttcttctatgaattattattttatgtattccttatcagttctgttggttcattaaatcttcttttaaattgatttttaggcctctttctataagatggacataactcctttgttatatatgttctaatattctttatttatagcttatttaacttttcataggttacattttatgttgaaatttaaaatttaaatgaaggcaaacttactaatttttttcctgtaatggtttcagaaatttgtatcttgacctggtttttagtattcctatatatagatcatcatcatagcccctctacaaattattttagttttttttaaatttaaaatttttatgttaactcttttaattgaggagggggcatgtggagtaagcttggaaattaaacttatccactaatgatcagttgttgtggaaccatttaaaatggttcttttacgataacctaagttcctatatacattatctatttcctgattccctattctttcatgaagccaactgtcctgcagtgtttttgaactggccagcattcaccttcaaatctttatgtgaacttatgtttttaatactgttgggtaaatgtcccggagtagaatgacttggttagatggtagaggtatttaacttttcaagaaactctcaaactgttttctaaagtgattgttccatttttcatttccatccttagtgtatgggagttctaattgtttcatatcctgaccaatacttcgtgtggtcagtgtttttaattttagccattctattgagtgtgaggtggtgcctcattgaggttttaatttgcatttccttagtaactaatgatgcattgagcatgttttcatgtgcttttttgccatcaggctatcttatggtgatatgactgttcaactcttttccctcatttaaaaattttgattacttattgttgagttttgagaatactttgtgtattctgtatacaagttctctatcagattgtcaatattttttccaagttgtagcttgcctttaattaacttagcagtatattttgaagagcagaactttttcatgttgatgaagtttattttataaacttgtaattttatcggttgttcttttggtgtcctatctaaggacttcttgcctgctccacagttgcaaaggttttctcctagaagttttatagttttaggttttacatttagttccatgatgcattttgactttttttgggtatatttcaagatgtacattaaagttcatttattttaaaatgtttattatgaaataattataatctgaaaagaagttgcaaaataatatagagtcctgtgtacttttcacccagttttccttagtggtgacatcttataaagctgtaccacagaatacaaaacagaacattgacattgctattttaacagagaagatgtctctgtgggtgggagtttgggggtaagaaggagccatggtggcccagagtatagtgagagaagccaagcaaggtaaaaaagagtgttcagctagggtgaagagccatccaacagagaagttagaccctgagcatgaagataaatgcctttatggacactgacctctctgtgatcatcaaacatactgttatgaactgaatgtttgtgcttccccaaaactcatgtgttggagccagccaccagcatggctacatttggagatggggcctttaaggaagtaattaaggttaaacgaggtcataaggatggggccctgatccactaggatcagtgtccttgtaagaagagacaccaaacatctcacttgccgtctctctgcacacatgcactgaggaagggctatgtcagcacacagcaagaaggcagccctctgcaagccaggaagagaatcctcactagaaactgaactagtaggaaccttgatcttggatttctagcctcaagaactgtgagaaaataaatttctgcagtttaaacctgtggtattttgttatggcattctgagcagactaagtaaggcacatactatatgatttctgtcctttgaaatatgttgagacttatacttgcagctgaagagacattgttaaatccagaaacagtaagcaactgtttctggagggtaactgctacaatcatgttagaatgaagtagattttaggtgtaagatgagaattttattaatgagtattaatgtcaattactaatttctttattgacagtcattttatgttcacaggaatgtgaattggacccttgctgcgaaggaagtacctgtaagcttaaatcatttgctgagtgtgcatatggtgactgttgtaaagactgtcgggtaaggaattcctcccttttggaaacaggaaaaaaaaaaaaaaaaaaaagaaaacctgtgtatatcaaaatttgttttttgagatttctgagtcagcactatttttattttatggtcatgggaaaaattttatgccacttgtgtataattttaaagcacactcttttacgttaagtggtctgttgatattgttttctaagtagaaacattttttttctgatttttagagtaacatatgcctgttagaaataattaaataacatgaaaccatagaaagtagagaatgaaagatcctctattattttatactcttcaggtaaccactgttgataatttgttaatataatcacgttttttctatacaaatgtgagtgtatgtgtgtatgtgtgtttttaagtgggtaagcacagatacatatatttttactacctgcttttttcaatatgacaccatggacttttttcccattcatgtagttctataatacatggttatttaagtaatattacttgtatagttgtaccataatttctttagtcaactaatgatggacattttgattacttccagttattgcttataagagaaatcactggtgcagaatattcatactaagtttttgatatacattttatatatctttcacacatatgccaatctatacttctaccaacagtattatcaaatacttgtttccttatgccaatattggttactagcaggcactatactcctagttaattcaataggtgtaaagggttcttgtatttttatttagtttgcatttctttttggttacaaatgaggtcatgtttctttactttccatagttaggnnnnnnnnnnnnnnnnnnnntgttgttagccttgttcatttttctgttgggttatttaatcttttgctattgttagaatgctttatagatgtaaatgctgtggtttcacatttgattaatttgtggacattatcctgatatttctgtttaatttgaattctatttcactagttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaagtaagatatcatcatttataattgattgcttcgatattatttatttttgatttagatattttaaaaaaggtaatgaaacattattgataaagttgaggctctcttgtttctcatcgtatttcctttcttctttggaggcagtcatgatcatgaatttaatatgcacagattcagttgatgttttcttatttttactgtctatatctttttatattttgtgtatcacgcacacacacagatacatatatagtatctagttttaataatgttgaattgtgcacaaggatctgctatttgcattgttcactcagaattttcttgaaattcatctatattgatatatttatattatagtacattaaagtattccattagatgaatggatcatgatttagttattctcttactgatagatatttgggatttttaaaaaatttatgtattttttcttttaaaagttcttatttttatcaagggcatacatataaagagccaaattattgtgtaatgcatagtatgaacaaataaggactgttcccacccactattcccatcacttgaggcagttttaccttttttggctaagatttttgttaacttgtgctaggtttttagataatctcttggcaatgcgacgttttgatttttttgttctaggcattagttattaatttctcactatagaagatgagttagttttctttccttctcttccttcaacccttaacaactcccatcatacctatgctgattttccattcttcatcctcccaatagttagggcagtgatgactgtgtattgtataatggccacattaatgctcttcacaactaaactgtatagtaagttataattacttgcctgatttctctagagttactaattctgtctttctgtttctctctctctcttttggtttggttaatttcctatgtactttccattaattgacctgtatattgttaaccattggcctgattgtgccttgagttgattagtggcatcaagtattctatttatttcaatttgttcaaataagtctgaacagaaggcctctgttcctcttcagtcttgactggtttccctctgtatagttagttagggttctctagagaaatggaaccattgtgttgtgcgtttatgtatacagtcatataccgcataacaacattttggtcagtgagagattgcatatacaacagtggtctcataaaattataatgctgtatttttactgtaacttttctatgtttagatatgtttagataccttttctatgtttagatacgtttagatgccattgtgttaccattgcctacagtatttagtacagtgacatggtgtacagatttgtagcttaggagcaataggctgtaccacatagcctagatgtgtagtaggctataccacctaggtttgtttaagtgcactctgtgatgtttgcacaatgacaaaatcacctaacaactcatttctcagatcatatccctgttgttaagtgacacattactgtagatattactgtatatataatctggaggaattattacgtgaatctaatatttatatataatatataatttacatataatatattaaatatataatatcttatatatgtattacatgaaaatcaaatatattctcctggaggaatctgatatattagattcatgtaataaatcctgcgtaatagcatgagcccatatatgaattggcttgtgtgattgtggaagctgctaagtgtcagatctgcagggagagtcagcaatctggagaccctgtagagctgatggtatagttccagttagaagtctggcaggctcatgaccatggaagagctagtgtttcagttcaattccaaaggcaggaaaaaagctgatgtctcattccaaaggccttcaggaagacttttctcttacttgagggaggactggccttttcgttcaagtttaaaattgattggatggggcccacctccaatagggagggcagtctgctttactcatcctactgatttcaatgttaatctcatccaaaatcacccttacagagacatccgtaattatgtttgattaaatatctggggattctgtggctcagtcaaattaactctactaaaaagggtaaaattaaccctcatcaaaaatccactccttgtcagcttgaaacccatagacaccttaaaccataccaaatctccaaatgtggaccttgttaagggcataattccacctagcatgatataataacactatcctgcatgcaactaaaacctcactaacctcttttccagaaaaggaggtaaagtgatgtttattcttcttcttgatatcccataacttaaatactgggatataaaattaacaatacttaaatgctataatatcaagtcaatatgtcttatgctgcatgataaaggtataaggaatgagaacatatttgctcagtacgtgtgtgtgaatgcacacacacatacacacatgcagctattcttaatgaaacagtcttcgtttctgcaactggtcatgtggttgtagctggtatttataactaacttccacccattctgtattccctttgccttcagcaagcacgttagctgtttgtggttctttacctgttagggtgacccaaactgtcgttcttgaagggtctgggccatttgtagtccttcctagattgggttgttaaagttttccattgaacttaaacttaatcatgaagcatggtaatactaagagatgccctaagggatctccggcattctagacatactcttccttgcctccattttggagtagtaggccagtttccctttggtggttcggatcagtaattctacctggcatagaaactgccttctttgcctgttgacttggaggtatgaggagccaatgtggctgggcctctggcttaatttctagttcagtagaatcattattgtggctcctggtggcagcattcctccttttggaactaaggcctctagtccagtagagcataaggtcgtgggaacaggaaacaaaattttgctagtgggtcactatggataatggtgagtggtgtttctcccatttccaccccttgatacctggacacgtgaatcctggttatgggaaaatcagcattggatgttggctgctgattgagagcatatacagccttttggagaaccttgccccagcactgtaaggtattgctacctagtggcactgtaactgagtctccaaaaggcatttccaccatgctgtcagccagctgcttcaggatggtggggaaggaacatggtaaggccagtgaattccatgtgcatgggcccattgcctcatttcatttgctatcaagtgaattctttggtttgaagcagtgctgtgtagaatattatgatggtgggggaggaattctgtatgtccacagaaggtagttttggtagttcacagaagtgttgctacagagatggcaaatctatatcaagagtacgtgtgtctgtcccagtaagaacaaagcactgcttctttcatcatggaaagggaaaaatgtaatcaacctgccaccaggcagctgactgactaacctagggaatggtgtcatactggggactcaggattggactttgctactggagaatttgggcacttagcagcaacaatagccaggtcagttgttgagaggaagtccatgatgctgagcccacgcatcgcctccaaccctgccactgtgagtacgtggttcctgagcccatggatgagaatagttggctggggaaagaatgagtcatcctatctacttgattattaaaattctcctctactgaggccaccctttggtgaacattcacatgggacacaaatatctttgccctacaacccagtcatgggccatagcccataaattggtgtataatcacgtctggctgtttcttctcccaaggaaagtgaacaaccaggtgcacttcagggatgtcccagaaaggggctgcagtgctacagtcatccacttttggttcttcatatcatatcatgtgtagaaccatctgcaaaccaggtctccgtcttcttttctactgtcacctgatgggtaggaagttccccgtgaggtcatagttgctggctaggagagaaaatgtagtgtagcaggagtggggagcaggggcatgtggggcacttctttatgtaacttgtgccttccaggccttggtttggctcaattacatacgtagcacttccatttcatgatggggtgctgctgcatatgcccagctttatagcttggtgagtcagatgacatccagtttatcatgggcaactcaggttgaatggtaacttggtgggtggcccatggttaaatgttcaatttctactttaaggcccagtagcaggccaatagttttttctcaaaaggagagtagttattcgcagaggatcacaaggctttgctccaaaatcctaaatgcctgcactgcacctgacctatagggaactgtcggaggcgctaaacagcatttctgtctgtaactgctgcttcaagcactgtttgatctgcttgatcaagtgggctaagcagcagagcatcttgcctgacagcctggacctattgcagagtttctctttgttctgggcccagctcaaaactagcagctctttgggtcagtgggtaaatgggccagagttatgcaaccaaatgaggaatattttgccttcagaaatccaaatggacctctaaacattgtgccattctgttggttgtgggagtggccagatgcaacttcttcttccccttagaaaggatatcttgacatgtcccacaccactggacatgtagaaatttcactgaggtagaaggcacctgaatttttgtcagatttattttctactttttgtcgtgcaaatatcttgccagtgacaagaatagttgctgtttcttgctcactaggtctaatgagcataatgttttcaatgactagtgtgatattttgtggaaggaaaaggtaatcaagatccccaaaactaaattatgacatggggctccagagttgatattcttcctaagtaggacagtgaaggtgtattgctggccttgccagctgaaagcagctgcttctggtaggctgtgtggatgggtataggtaaaggttttttcagatcacagctgcataccatgtattaggggatgtgttaatttgctcaaacaatgaaatacatttggtatagcagcttcagttggagtcaccacttagctaagcttataataatccactatcattctccaagatctgtctgtcttctgcacagggcaaataggtgaattgaatggagatgtgatgagagtccctgcccctgcatctttcaagtccttgatgttgacacgaatctctgcaatccctccagagatgtggtattgcttttggcttactattttcctaggtagaggcagttctagtgggttccacctggcctttcttaccataataaccatcactccacaggtcagggaaccagtgtggcaattctgccagctgttgagtgtgtctgtttcaattatgcattctggaattgtgggaaaaaacccacaaggtgggttcagggacccactaggcctgctgtgagatggacctgaggtaaaacttcatctatcacctgaccttcataagcccctactctgacttcttgaccacagtgacattttgggtttgctcaattatttcagatatagggttctgtgttcctgaaaggtcgaatttttttctcagtgcacagtgtcttagtctgatcaattctgtctcagtctattttgtgctattataacaaaatgccacagaccgggtaattaatagtgaacagaaatttattggcttctggaggctgggaagtccaagataaaggtgctgccatctgatgagggtcgttttgctgagccatcacatgacggaaggtggatgggcaagagacgaagtggggccaaacgcacccttttataacaatattaatcttatcccagagggcagagccatcatggactaatcacctcttaaaggtcccacctcttaatgctgtcacaatggtaattaaatttcaacatgaattttagaggggacagacatttaaaccatatctggctgctctaacaagatatactgtagactgtgtggcttaaatggcagacacttatttctcagagttctggaggctgggagtctaagatcaaagtgccagtcaatttggttcttggtgagggatctctcttttcttcttataagatcgccaatcccatcataagggtcccatcctcatgatcccacctaactctgattacctcccaaatggcccatctccaaataccatcactttggggttagggcttcaacagatgaattatgggatacacaaacattgaaggggtacacaaacgttcagtatataaccattgccctggtaaaagccataggtcccttggaaatgtctgggataatgattaatagtataaatttttggcattgtatgggagggttcttccttaaagaaacttaccctgcctttagttgagagtttctgtttctgtaaactggctcaactcaaggaattgattaagaggctgtgactttctgtttttatgattcaaattagacttttgtttacttggcctagagttttcttatttggtacaggtcaagtaagactatgggaagctgcctatcttgcttctacttagacagaaacagtgtgatcaactagccaatgccgtaagtttttacatgggtcaggttattctgattgctgctttgactctgctctccattatggtaaccttggctctccattatgccaaccttggctctccattatgcccaccttgcctttggtggttgaatgttgacactttcctatcacctagaatctgatactttcattgcatttaagtttcccaactcagtggccatagctcctactataaggtctgccctttagataagagtgatcacagagcttttcaaggatgctaggcctccccttacaaatttatttcttacagtcttggtgaaaggtgtgttttctggattcttccagggtgggtaaatacatcttaagtgacaaatcgactcaaacattttagtctccctcagactttgaatccctttctctgcattaaactgagataggccctgcattcctgacttgctcactgtgagctgccttttgattcacatttcagccaaccaaccgaacaaactgttagagacctttctaactccctgaatggcaacattcaatgcagactgtctgcttcgtgagtcctcaccaatgaattcatcccaatccaactttatgttcctcccaccattatctcacgcccttaatatccattcccacacatgttccctggatttctgtctgtgtaaattagaaaactcaagtagtcttggagtgtggtgaacctcctcatgggttgtatttagtatttcacctttaggggcattttctatgacttgagtctagttataggtttagaaccaatgagatattttggaggtggatcctgagggaaattggcattatcttgcatggcagctgcctccagggaggctattacagtttcctcaggcaatgcagggttagtcccctcagatgttggagacgctgtttccactggcaaagacgactcatcagaatttagaggctcagccaggcgcctgtaatcccagcactttgggaggtgaggcaggcagatcacttgaggtcaggagtttgagaccagcctggccaacatggcgaaaccctgtctccattaaaaacacaaaaattagccaggcatagtggtgcactcctgtagtcccagctacttgggaggctgaggcaggagaatcgcttgaacttgggaggtggaggttgcagttagctgagattgtgccactgcactccagcctgggcaacagagcaagactctgtctcaaaacaaacaaacaagaaaagaaagagtttagagctcagtgtacccagctttatcgaagtctccccacatgtgctcatttcaactttcaagatccagttccttattgatcaataacctcaatttaacagtagataccctacaaggctaggagttcaatttgctttcagccagtcacaggataagattctaggtttgattttcaacaatctcagctctgcaactaccggcgatatggctgtcctttagggcacacacagaaaatttcaggtcacttatatggtgcttgaactaggaatccctgcgcttatcatcttctttccctactttgtccagtaaaataaggagcaaccaggcaatctcatactgttagtatgagaaaaatgtttgaaggcatcatatacatagttacccagatccttgcttcttgtaaatgtctgattaggagtctctagtgttgatatgtttttggactgcaattaccatatcatgccgtgaactatcagtgctacgttaacttttggaaatagagtcataagtgtctttaaaaatctaatcagattagatagcccattctagaaaccttggaatcaattcagaaaactcattctcaaagttctgttcctctggaaccactgttggtccaaaatctgaattagttagactgcagagaaacaatatcaattggatatatacatattatatatatgtttattcatttattataagcaattggctcatgcgattatggtaagcaactgaaaatcccagatttgtaggatgatttggcaagatggagacacaggagagatgatggtttagttccagtccagatttgaaggcctgagaaccaggattgccaatagtgtaatcagtatttatcctgagatctttcaccataatctgaaggcgaatcattggctctctcccttttgaatctcctgtttgcatttcccatattaccttctttctttgtttatttcctcctttcatggagctttcctttcggtagtttccttagataaggtgaattagaggtaaattttttgagatcctgcaagtgtgaaaatggttttatttggactaaatacttgattgatggggatggaaatcattttctgtcacagttttgaaggcattgctttattgtcttccagtttacagagttgctgttggaaagtctgaagccattctgatttttatacctagcttttccctcaccccctctgaaaaagcttggagaatgacctcttcaaggtgatatgccttgatgtgggtttgtttttattcaccgtgctatgtaattggtgggtacattcaatctgggaactcattttttttagttctggaaatttcttccctttcatttttttggtgtgatttcttttcctggatcacatattatttggatattggatttactagatttccttggattttggatttcctggattttcttatctttcctgtctttttatctgtgtttttttttgttttttttttttgacctactttctgagcaacttcttcaactttatcttctaactcttttattgcggttttcatttcaggcactatgattttagttttcagaaactcttttatattctctgagtttttttcccacttatttttaagaaataatctattcttggccaggcgcggtggctcacgcctgtaatcccagctctttgggaggctgaggtgggcggatcacaaggtcaggagattgagaccatcctggctaacgtggtaaaaccctgtctctactaaaaataccaaataaaaaaattagcctggtgtggtggcaggcgcctgtattcccagctactcgggaggctgaggcaggagaatggcgtgaacccgggaggcggagcttgcagtgagccgagatcgcaccattgcactcgagtctgggcgacagtgcgaggctacatctcaaaaaaaaaaaaaaaaaaaaaaggacataatctgttcttatttcatgcacgaaacatctctcatgtttgtcagtatgttaatgataatttttttcttttttttaaatatattttaagttctagggtacatgtgcacaacgtgcaggtttgtcacatatgtatacatgtgccatgttgatatgctgcagccattaactcgtcatttacattaggtgtatatcctaatgctatcccttcccactccccccaccccatgacaggccccggtgtgtgatgttccctttcctgtgtccaagtgttctcattcttcaattccaacctatgagtgagaacatgcggtgtttggttttttgtccttgggatagtttgctgagaatgatggtttccagcttcatccatgtccctacgaaggacatgaactcatcctttttcatggctgcataatattccatggtgtctatgtgccacgttttcttaatccagtctatcattgatggacatttgggttggttccaagtctttgctgttgtgaatagtgctgcaataaacatacgtgtgcatatgtctttatagcagcatgatttataatcctttgggtatatacccagtaatgggatggctgggtcaaatggtatttctagttctagatccttgaggaatcgccacactgtcttccacaatggttgaactagtttacagtccaaccaacagtgtaaaagtgttcctatttctccacatcctctccagcacctgttgtttcctgactttttaatgatcgccattctaaatggcgtgagatggtatctcattgtggttttgatttgcgtttgtctgatggccagtgatgatgagcattttttcatgtgtctgttggcttcataaatgtcttcttttgagaaatgtctgttcatctcctttgcccactttttgatggggttgttgatttttgttgtaaannnnnnnnnnnnnnnnnnnnnnnattttctctcattttgtaggttgcctgttcactctgaaggtagtttcttttgctgtgcagaagctctttagtttaattagatcctatttgtcaattttgtcttttgttgccattgcttttggtgttttagacatgaagtccttgcccatgcctatgtcctgaatggtattgcctaggttttcttctagggtttgtatgattttgggtctaacatttcagtctttaatccatcttgaattaatttttgtataaggtgtaaggaagggatccagtttcagttttctacatatggctagccagttttcccagcactatttattaaatagggaatcctttccccatttcttgtttttgtcaggtttttcaaagatcagatggttgtagatgtgtggtattatttctgagggctctgttctgttccattggtctatatctctgttttggtaccagtaccatgctattttggttactgtggccttgtagtatagtttgaagtcaggtagtgtgatgcctccagctttgttcttttggcttaggattgacttggcaatgtgggctcttttttggttccatatgaactttaaagtatttttttccaattctgtgaagaaagtcattggtagcttgatggggatggcattgaatgtataaattaccttgggcagtatggccattttcacgatattgattattcctatccatgagcatggaatgttcttccatttgtttgtgtcctcttttatttcattgagcagtggtttgtagttctccttgaagaggtccttcacatcccttgtaagttggattcctaggtattttattctctttttagcaattgtgaatgggagttcacttatgatttggctctctgttattggtgtataagaatgcttgtgatttttgcacattgattttgtatcctcagactttgctgaagttgcttatcagcttaaggagattttgggctgagacggtggggttttctagatgtacaatcatgtcatctgcaaacagggacaatttgacttcctcttttcctaattgaataccctttatttctttctcctgcctgattgccctggccagaacttccaacagtatgttgaataggagtggtgagagagggcatccctgtcttgtgccagttttcagaggggatgcttccagtttttgcccattcagtatgatattggctgtgggtttgtcataaatggctcttattattttgagatatgtcccatcaatacctaatgtattgagagtttttagcatgaagggctgttgaattttgtcaaaggccttttctgcatctgttgagataaccatgtggtttttgtctttggttccgtttatatgctggattatgtttattgatttgcatatgttgtttaaaaagttttctttcttctgcgtaacctctgtttcatattaccttttttctttgtttgagtttccatctttcacattagccatgttcctcagctctcccatagtccctggtccaaaggaggggaataagaagcagagaggtcactctaggctcatgggggaggcttgttaactgaaagctttcctataggatgatacagctgaactttttaattagggaaatggaaaatccacatctttaggtttttttcctcttgggcttgttaagattcccttgtgaagaccttatctatctgcatcctggagggccaagtcctagctgtcagtcgggcacggtggctcacacctctaatcctagcactttgggaggccgaggcatgtggattgcctgaggtcaggagttcgagaccagcctggccaacatggtgaagccctgtctctactaaaaatacaaaaattagcttggcatgatggcgggcacctgtaatcccagctactcaggaggctgaggcaggagaatcgcttgaaccagggaggtggaggttgcattgagccgagatcatgccattgcactccagcccgagtgacaagagtgaaacttctcctcaaaaaaaaaaaaaaaaaaaaaaaaagacctgactgtcagcattctgggagggaaacaggaggtgagggaaaataaggctgggacctcagtatgaggtaggtaaatgctcagttcatccccttgtttttagaagagtttctgtgcctgttactgtgcctggtatctcttgagtcctggaaccttgtgttctactctctccagaaaataaacctccagtgttttgccagggtagagaagagacagtcacttggcttcacaaagatggtaggtgacttgtgggccaaactgcttcttaagcagatttaaaatttttcctctttattcctgccacctgcccctccttattctctatagccagaggtacctattactaccagtttcttatctccgaggaattctacggtgtaaaaagggttgatctcagttttttctgttgccactttaagattcagttttctgagatacattgagtcatttattacttcaccaatttcttttcggcttctaagttttgtgcagtctcctttcccagttccattgtctgtgggtttatgaattaaaaaaaaaaaactactttctgtgggattttaggagggagggaaaatacgtgcatgtattcagacttcttacctgaagtttgttgatggcttctgattttaaagataagtcaattctggtgttataggtctagttttcattcctttgaacatttgaacatgtggagaataaggatttaaaagtccttcactagctcatgcattctcaaattccttatatttttagtaaacaccaaataaatatttatcaaataagtgaagaacttgagagctaacataagagaaggtattgacgcttactatcaaatttggcccttaaaaaaccttatgaggaaggcagggctcagagagctaaatggtttgcctgaggtcacacaacagaaagcagcaaaaccatgatctcatccaccgtgagcatggtgagctgatgaagacttactgctagaatttatcaaagacattgttaaaggaaaataacttacattggtttacttcttaaatggaaataggacatattgaaatattgaatatacaaataagcaaaaggtagaaaataaatatttcctctactgtcaatattctggataagtaactgttgaaaatttcatgaatatctttcacttattttttgtgcatatgagtgtataatatacaaaaatggtatcatattgacatactgctttaaaacctgctgcctttcagcctgggctgcatagcaagaccttgtctcactaaaaaaaaaaaaaaaaaaaaaattagtcaagtgtggtggtgcatgcctgcatttccatctacttaggaggctaaggcaggaggatcactttagcctgtgaggtaaaggctgcagtgagctatgaccttgccactgcattctagcctgggcaacagaatgagactctgtctcaaaaaaaaaaaaaaaaaaaaagctaaaatgtaactgcccgttttcaatactaacaataaattgtgaatacttttccatgttaaccatttttctacaacattgtgttaatgatatactataatttatttaaacagtcaacagtgttagcagtaaacatctgtatggtttagttgtggcctccatttatccttctggataaatttccagaagcaggattcctgtattaaaggcttctaagacatttccacataatctccagaaatatataccactttttaccttcatttgctatacgtgactgttcattccttcatatgtttccaacatcaagtatttccatttttaaaactttgccaattgaatagccacaaaacatatttttattatttaaaaatatgcattttgcaacataggcaacatagcaagaccccatctctacaaaaataaaaacaaaaattagccaagcatggtggcgtgtacctgtagttctagctgtttgggaggctgaggtgggaggattgcttgagaccaagagttcaaggttacagtaagctatgaacgtgccactgcactccagcctgggtgacagagtgagatcctgtctcttaaaaaaaaaaaaaaaagggaaagcaagaatagattgttactttgtcatctgtcgtcagtgtttgtcaatgtatttaattagtagggacatctaaaccaagcatccatatatgataaatgaaaaaaacaaaagtattagctggcagtgttttctccaacccttcctagctgatctaaccagtggtgcagttggtttatatgtgagagcaatgagaatgaatatgctgcaaatggtactatactgtgcatggtttttaatttacttataatctattatttaatagtgtttcttttagggcttgagtttgaattcaggctaacttttaagtacaacttaagatttatttttacattttgtcattacatatgaaatgtggaacaaaaatgtatcatgtgtgaggcaggaaaggttttccacggtgttgaggggtattgaggctgttcatccaggtgtttagactgttgtagggaatacttttatttcaaaagctaaattgccataactttttttttctttttttaaatgtttaatgttacagaagccaaggctgcccccaaagattgtttcattgaagtgaattctaaaggtgacagatttggcaattgtggtttctctggcaatgaatacaagaagtgtgccactgggtaagtggaggtgcggtcataatggaatatgaaagattataagatccgtcatctctagtatcttttttttttttttttttttgagacggagtcttgctctgttgccaggctggagtgcagtggcgcgatctcggctcgctgcaccctccgcctcccaggttcaagtgattcccctgcctcagcctcctgagtagctgggactacaggcatgtgccaccacgcccagctaattttttgtattttagtagagatggggtttcaccatgttggccaggatggtcttgatctcctgacttcgtgatccgctcgcctcagcctcccaaagtgctgggattagaggcgtgagccactgtgcccggccgtctctagtatcttttacaactgctctctgtgaccgctgattttctcccccttaaatacctaacttttcaaacattttacaatgcaaagcttcagagagactctggtgttaggaaaagaactggtaacataatttgtccctttagacatcaactacaatctagtggtttttagactcttattttgtttatccttgatttataataagaaccccaactaaacaccattttcattttcctttccataaaagattatgttactaagtccctagataaaggtacctgcagaagaaactctgaacttcattattttcttctagctttgtataatttcaagatgatgaatttaaaatattttatatttctacaattaacatttgctttttgtaaaacattaataatgaaacattacaaaggaggaaaaagtcatgtataatctcaatccatatatgttcactaatatcagtgaaattattttcttcttcacactaacattttacatagttggaattattctgtaatattatcattgcttctacccattctacctcctatgctatcagttaagctaagcaactacagtaaaacagtgcttgctaagaagaaatagcaacaaagacccccatgtcactcaatctgacagtcgtttttaggtcttcatacaatagtacttgacctgtcagtagcattcaattatgctggccattttctccttcttgaagaaacctctttttttttggtgattgtgtagggtgttcttcttctcccctgaccccatgtgatttcgtttacttccgtggcttcatttgcctcctctctgagaagctccagccctgctggcctgcatgtggcctgcggccacagggctctgcacctgctgttccctctgttcagcatgctgtctttccccctctcagcctgctcagttcttcgtcctccagatctcaggtgaagtgtggtttccttacagaagacttcttccacttcctcaacaggaccagctctccctctgacaggtgttcttgatgctgtttgcttctttttcatagaatttgatatgttttcattattttttagttcatagtattttctaatttacactgatttttttcctttgactcgtgttattgaaagcctattgcttaattcccgagtagttgggaatatactggttatctgtttggttttgatgtctagttcaattccattgagaacacattctatatgatttcacttttttggaatttgagatgtgcattattcagttacacttggaacattcatccatacagactaatatgtgggccagcctcttaataccagaccaatatatggtctgtatgggtaaatgttccatgtataattgaaagaaaaagtatattctgcagttgttagagatgttattctataaatgtcaagttaatagtcttattcaaatatttcatatctatggtgtacgtgtgttatatctgttccttcaatttctgagagaggtgtgttgaagtctccagttatgattgtggatttgtctatttatctttttaggtatgtaaatttttgctgtgtatgttttaaatttgttactaggtgcatacacaattaggattgttatgccctcctgatgacttggagggcattagcaaatttatcattagcaaattcttttcatttctggaatattcttttgaagtatttgtcagtttcattaattatgtagctcttttgttatcgctgttcctcactaaactgtaaggttcagtgacacattttatcttgcatttagcataatgcttggaggaaacataataaatgactattaaacattgaatgaatgaaggtacagatgatatggatgaagaatgaatgggtggagaattaatataaccgattgaatgaactgatttaaaatctagggataagtggattaatgcagacttggaaagaatttgctggacatataccatattcttgtctttagccttgtcttgtttcatatttttatgaatatcttattgaaaatagcaactatacttatcaaactttaaaattactgagtcatttaggaagcattttatgtaatagtagtatacaaacaatatagtcattaagaatatacatttgaagttagactctttggatttgaatccttgttcaatcacttaacatctctgagtctttggacaaattacttcacatacatacctcatttttctgttctgtaaaatggggataataatggcacctgtttccaagtgttgttttgaactgaatgagttaatgggtgttagtactaagaggaatatctggttcattgtcacattcatcatcatcatcactatttttgttgtcatcctccttggagaatgtgtaaaatctggaaaagtcttttctacccattgaaactaccaaaaacatctagaaacatttaaagaaaggattcacatatggtcctaccatccagagatatttccttaagtttttgttgtatttcttttttatgtgtatatacatttataaacataagccaaatgtttcctttcactaaaagggttatcttttagtacatagacaatgtcattttttcaagcattataaaaaagaaattccaaatatacagaggagtagaaagaatagtgtgatgaacaccaatatatcccagaccaagacattattaatgccttatcattatttgcttcatcaagattttgctgaaccattttaagtaaattatagacatgatactttactcctaaattcctcagcatccgtcttcaacaaataaggccattcacatgatcacatcacacctaacaaaatgaatgatttcctaatatcatctagtatctgatcaatattagtatttccataagtgtcctcaaactgtcttttatagccggcattttccaacatcaggactcaatcaaggatcacacattgcatttagttgttatgtcacttaagtcacttttaatccagaataccttttagactgattttttttcttttcagtgacattgatttatggaaatggctgggccagtgggctcatgttctggatttgttttagtttccttttggtgttgcttaacttatgtctctatcatccgaattttatttaaatcagaagttaagcccaaaatcttttttttttttttttttttttgagtagagcctcactctctcgctcaggctggagtgcagtggcatgatctcagctcactgcaacctccacctcccagattcaagtgattcttgtgcctcagcctctggagtagctaggactacaggtgtgcaccatcatgcctggctaagtttcgtatttttagtagagatggggtttccctatgttggccaggctggtctcaaattcctgacctcaaatgatccgcttaccttagcctcccaaagtgctgggattacaggcgtgagccaccgcgcctggccctaagcccaaaatcttaattgaattcaggttaaatatttttggcgagaatgttcataagcaatgcattatatcaaggagtcacttagtgctgggtagtcttattaatattagtgatactaagtggcaatgaccagatcttgctattgtggagttatgctttttaaaattgcagctgtcaggtaatatgtggagtgatgagtttgtgccatatgaatatccagttcctgaccagtgtttcactttatggatgatccttgcctgaagcaattattttactgagggttgtaactgaattttgtttctgttagtattattcaacagtgaatgagcatctcagttttgttggctgtttacatttcttattttatgagctgcctgtttacatctttgctaatttttctgttgaagtgattttctttgtcttaatgatttgtaacagctttttatattctaagagtattttcctttactttttaatgtatcaccaagcctatgtatgaaatactgagtatatcatagcaatgtgaattttggtaggccccaacagatcttaactgaggtctactttatgctacactttgtttttgaggttttcatatctaatttcagctaattatgtgagataggcatcatttatctcatttttttcagctgaagaaactgaagctcagaaaatgtaagcacttctctcaggtcagctagcaaataaatggtgacataagaataaatgtaaagttgggacaaaattattaactcttaaatgcaggatgaagggaagatgaagacttaatagcagcacaacaaaaattaggagttttagtgatatattcaaggacatcaataatataatgtagttataaaagctattgtaatcttgaacttaatagaagtacagtatctagaataaacaagagctccatttttttctttgctcaccaggctgtcactgaaatttcatgctccattctgagcactatgcttcaagaggcagtgaggcaaactggaacatatttaggagggagcgtccttgttgcatgaaaagtgattgtaggatagtgacctggtgaagtaagtatttaggagctgcataataattgtcctaaaatagctgctgtgtgaaagaaggaaaagatatctgtgtagtctcatggggaagatctgggaccaatgaggataaatgctttacagatgtagatttttacctaataagcagaaagaagaacgtgatgggagctagaatgggcagtttcaggagggtgtaaattagagatattgggaaaatatatcctatgatgactgggcagtgatatcatagagaagattcagatatagagtaggtgcttggatcagatgacaatcagttaaacaggaaatctcagtacagcatcataagagttattgttggaaatacctagagtgttatgaaaggatataggaagggcatttaattcacacagccttggcaataagaattatggtcagggaagccttcatagagttctgatatttaattaatgaattaacgagttaatgaattgattctttaaataagtaaccaagagttagccaggaaaagaggggtggaatcctttcttagttattttgcattatagaatctaatttcttctttatcataactctgtaagaagacataattgaattttgatattgctatattattttctgtataatagaatttataaaattatacttagaaacaactttattagttaggctgttgagctctagacagacagtgaagaagattaagtgtggtaaaagaagaagcatcagcaccagctggtgccctaatttgcatcttagcatccacttaactcttttttcgccttttctgccatatttaaagagagctactttgacctctcttgctctcatacactttctctgttgagattccctccatagcagcaaactctgtccatatgcaaatatataaattttttcttttgttatgtatactggatgcattttatgttgcattatttctctctctttataggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaaggtaatcaaaatattttttatttacaaagtaaaatgaaaaaaattaaaaaaattattatacatagtaagtggttgctcttttctgattgtaaaagtaatctaaattcattatagaaattttagaaaatacaaagccaccaaaagaaaattaagaactataattctgttatccacatttccttactggggtcagataaccagtgttttccactttgcaatatactgtgcatggttccctcccctactgatatgctacaatttattagccagtttgctattactgggacactttggcgatgtcctgaatttcagggtgtgtgtctgtgtactagaaatgtcatggagcttgtcctgcccatgttcctgaccacctgagctctgctgtttggattagatagaaggccagagtcagtcagcccatgacttattactagtggtttcatatgagaagatgccctgggccaaattcctttttttggagaatataaaattaaggagggtaattaagagtgcgggcagaaactgtaagaattcgttgggagatgctgtgaagtaggagctggggtagaagggatgtggcagccttaagccatatacaagagatatgagggagcaggattgttgagtaagttgaagaaaccaactcagaggagagagagaaggagaatatatgattgactgattagcccatgaaaaagacaggtgggtgggccttcaagttacttcactttctcccaagttttcagttccaattctgtttctcacttctctttacaagaagatccatatatttttggtcctgtccttgcaactaaataaacttgatcgttgcagctgttataaacaatgataagagatatatacatttaagtttttgatagtgcaatttccctttcaataaggtggtaacaatctatatcccagcctaggcagcagaggaagactctgtctcaaaaaaaaaaaaaaaaattgtgctgaaaggctcatgacaaaaacaactctctgacatgctcttatctaatctgccagtctagacgcctagaagcaactgtggttacttctgttaattacctccctattttaaattagggctgggcacggtggctcatgcctgtaatcccagcactttgggaggctgaggtgggcggatcacttgaagtcaggagttcgagactagcctgaccaacatggtgaaacctcgtctctacagaaaatacaaaaactagccagtgtggtggtgcatgcctgtagtcctaactactcaggaggctgagacaggagaatcgcttgaacctgggaggcacaggttgcagtgagccgagattatgccactgtactccagcctgggcaacaaagtgagactcccatctaaaaataaagtaaaataaaataaaataaaatagtatgctatttctagatttatctattttagacattatccactagttttatttttgatagataagaattcaattttcttatgcaaatcccagtttccctgctgtaccttttcaaaataagtgcttaatatttacataattaatattggggtgttattgaatgagtccacaacatctcactgttcactgggcatattccagacgaggtgagagaaaacaggggaggctaaacaattggagatcaaaggatcatttttattaggaagaaagcatgtaacatgacttaagtagatagcaaaaatgggcttcctaatgctgccctacacagttaaacttacctgtccagccttacctgcgaagtttaactgcatggttgaaagggcagaccagaatgcaccctttctgccacctcagcttactactagctggcaccacaggtgtaaccagcatgcctggctaattttttttaatttttctgtagagacaggatcttgctatgttgcctaggctggtcttcagctcctgggctcaagcgattctccctcctcagcctcccaaagtgctgggattacaggtgtgagccactgcacctagctgggcatctttccatgtctttattagatccatgtatttttttctgagaagttcatattgatatctctttttctattagcttgccattttttgaggcttctcatatgagaagaatattaactgtcagtcagttatatctatgtaaatatgatcaacaatttgacataagcctattttaaaatatcatgaattttttttttttttttttggagcctcactctgtcacccaggctggagtgcagtggtgcaatctcagtgcaacctccgcctcccaggctcaagtgattcttgtgcctcagcctccccagtagctgggattacaggcatctgccaccatgtctggctaatttgtgtgtttttagtagagacggggtttcgccatattggccagactggtctcgaattcctaacctcaagtgatctgcctgccttggcctccaaaagtgttgggattacaggcgtgagccatggcatccggccttaaaatatcatgaaattatatcagtcttatctgttttgtcttggtttcatgtcatgtttagaaaagctttttgtatctcagtataatatgaatatctggcttttattggcacaatttattaacatttcatcctatttctctgatcttattgctgctgttaaatattttcttgatattttctactttatcttcctcttgcagtattacacaaattatttatttgtgtgtggggtgtgtgtgtgtgtgcacatacactttggtagttgtatgtctttctattctgcttgtttacttaataacaaaaaaatgaatatatttttctcaaagttgtcgtgattaaaaatagtatctactgattgttgcagtgtaagctataccactattacttccaaacccccatgtcccagtttttacttggtaggaaaaatattggctttagattccaggttgttattaacatatatcaatgtatttttaagaccttttgtctttctggattttattgctaactgcatagttttctagctatgacaataatatttatgtacaagaaaggatagcaagtggttggtgtgtgtacctggactgatacaccttgacccaaactgacatgccgttgagaccatataccacacgttctgtacagctgtaactttgtaactgttggtttaatctgtgagtctaacacccaagttttcacacggcagataggatcctgtcccttctggtatgtaccaaagcctagactggacagtttgagcagactgacaacttggtacttcttcagatctgtattctttatatatttattcaacatttatttccaggacaagctaaacgtggggtagggggaaaagtggaaaataagaactcctcaccttcatttttattgtcccaggtagttcaattttgctccccacttgcatcctgaaatcagtaaaccagaagtcctatagtcaactttgctctacttgctgcgtggtggttgttggtggtggccatgggtggtagggggagtggtagtagtatgtgagaggatggtcttaccttcccactgtgagagttttttttttttttttttttgaggcagggtctcgctctttgacccaggctggagtgcagtggagtgcagatcttggctcactgcagcctctgcctcctgggttcaaacgattctgctgcctcccaggtagctggaattacaggcttgcaccaccatgcccggctaatttttgtgattttagtggagatgggggtttcaccatgttggccaggctggtcttgaactcctggcctcaagtgattcacccacctcggcctcccaaagtgctgggattacaggcgtgagccactgcacccggtccccactgtgagagtttttgggtgtattcctttcagtttgatttttcccattccacaaggtaaacactgccaatcagaacaccctttctctggaggacttggaattttcctgccccttaaagtaaatctgccagttattaacacatttcatcttatttaacacttcgggtgtccgctatgaatcaattattgacaggaaaatcttcttttaactggtagggaaactcttggtaaatatctcctctaaagacttgcggatgtaagaaaaaagtattttgaaatctttattcaggagtagtgcatggctagaggacacatgaggagtgacttactgtagaatcttctgtaattttggaattttaaatcatatatgtcctatttaaaaattaatggaaaattggaggaaacagtgtttggagatcttttgactttaaaagtacaattctgtttaaacctgtgtattttttagagtggtaaggctatcgatatttcgttgtaggtttgttctctaattgttctttatttcatttgagcatttaaatattctgatcttgtacacaagatcagttggttagttacctaataaaattttaaaatagcactcaacagtcttttaaaacgttagtcttctttttttcctctaacatcacaacagagcagttttcacaaagatgtcaactaaaaaatttctaaaatgtgttgagctgatttctttagatcttaggtttaatatttttttctgaggtaatggtttttatctctcagtagctagaattcatttctgtttcatatctcatcatatgaactagaatttcttgaaccatgtaagattataacttattttcaacagtgcttttaatagaaatatctaatcatggtactagaaaacagattttatcttgtcaacaaagtacccttttatttttgaaagaattttaaaaattaaaatgagttttaaatattatccttttgatatctgtcatagtaacaacactttatgagaggtgtaatagaaatagaccttctatccttgaaactttcttgtagtcctggggttaactctatctagttacttttgatttgaaaaagtctatttgtgaatattttatttaggatctttcacatcaatattcacatggaaggatagataatagttttatctttgtttttggtctttatgtcatctttgtgttttttgataattaattttgtatcaattaattaatgccacttatttttctgcatttttaaaaatataatatgggaattaatggttccttgaaagtttgaaagaattctgcaatgaaataatctgtacccaggtcttttttctgggtactttttaatgactgtgctcaatctttctttacttagttcatttttttttttttcagatctgtagaaacttccagtgtgtagatgcttctgttctgaattatgactgtgatgttcagaaaaagtgtcatggacatggggtaggtaatgttttcttttggcttgttcctgaaagtagtgctaaataatgagtgagagttcccaggattttcagatgttggggaatttagattcctgataaaattttcattcttaaacagtgtcagtaagcttgtatgaatttagtcctttctcttggtttccattcttgagttgatgatatagagcaacattcacaattaacaaaagtggtattttgattgttttgaaggtatgtaatagcaataagaattgtcactgtgaaaatggctgggctcccccaaattgtgagactaaaggatacggaggaagtgtggacagtggacctacatacaatggcaagtaatatagaagaaaattagtgtgatctcccagtggcccaaggcataaattgggcatcctcgtacctctccctcacttcccacatcagttatacatttaattatgttgattcagcctcctaaattccttgtgactgtttccatttttctcatccccatttattactttcaatttcttgcctggacatacatcatagcctcttatgtaggctccctatttttcatcttgcttcctataatccatgtttcactctacattacagtttcagtgttttcctacaagaattcagttttgattttgtcagcgtcttgctttaattcagtgcatctgcattgctattagaatgaagtccacaactccttaacatgggttaaatgccctgcatgacttgcccctagcttgcctttcaagcctcatttcactatgttgaagacatattgtaacttctttgatttcctgtactaggctactatcttttacctgtgggctttcataccgtattattttcacattgttggcccttggctaattgctatttaggtttcagattatacctcattttctaaagaaagtttcccctggctgcttaaatctaaattatcatttccttctattgcttttctagtactgttagcactatctgttagcactaattgctatactaattactgatttgctttttaaaattccctgatagaccatgagctcccagtttatcggtatctttctagtgacatcatatgctttttttctcttgggtaactaccagctagaatgactagtcatatagtaggtgtatgttaagcttttaaagaaactgccaaactgtttcccaacgtggctataccagtttacatccttactagctgtatatgagagaattcccccaatttccccacatcctctctaacagttgctattgtcagtctttttaatttttagccattccagtaggtatgtagtggtatttcagtgtggttttaatttgcatttctctaattactaatgatgttgagcatcttttcttgtacttatttgccatctacatatcttctttggttatgtgtctgtttaaatcttttttccagtttttaatggattgtcttaatgagttttgaaagttctttgcatgtcactgattcaagtattcaagttctttatgaaatatgtgccttgtatatattttctcttagtctgcttactttgggtttcatttgttctttttctagtttcttaaggtggaggatgaggtcatctttttttttttttctgatacagacattttattgctatcagttttcctttaattcagaaattttgacatgttatacctccatgttcattcagttctgaataccttctaatatgctttttttttctttgacttacaggttatttagatatgtgctatttcttttgaaatacctgtggattttttagttatcttaatgttactaatttaaattttactgtagcaagagaacatattgtgtatgacttgaatccttttttttttttaaacttgtcttgtagcccagaatgtggtttatcttagtaaaagttctgtgtacacttgaaaagaatgcgtattctactattcttaggtggaatattctgtaagttattagttcatgtcagttaataggtagtcggatctttcatatccttactgattttctggtctacttactctgtcagttattgagaggaatattgagttctttggctataactgccaatttgcctatttctcttaatagttctatcaatttttgctttatttattatgatgttctgttattaggtacataaacacttagaattattctatcctctttgtaaattgactctttatccttatgaaatagccttctttttccctagtaatattctctgccctgcaatgagatattgttaatatagctactccagattcctattaattagtcagcatggaaaatcttttcccatccttttacttttaatttctttatatcatgctatagtaattagtacatatagttggatcttgctttttatctaatctgccattctctgtctttcaattaagttgtttcgataatttatatttaacttgactattgatgtgtttatgtttaaatttactgtcttgatattttccatcagtctccttgtagtgatattgtaacacttcagtatatttccatttctctcattttgtgccattgttgtcacatgttttacttctactaatgttataaatcccacaattcattgttactcattttgctttgaacagttgattatctttcagagacttaatggtagaaaaagtctttatatttacccatataattaccatttctggtgtttttcatttatgtaaatttgcatttcaatctgatttaatttctgcttgaaggatttccttttacatttcttataataccagtgtgctagtgacaaatatttttagcttttgtatgtctgaaaaagtctttaatttgccttgctgcttgaataataatttaactgggcaaggattttgggtgatagttttcctcccgttttacttctaaggatattccttgtcttctgacttgcattgtttttcctgaaaaatctgctatcatccttttctttgtatataatgtcttccgtatatgtctttttctaatctctggtcacttgtaatgttttgctctttatctccggtttttatattgtgccttggtgtagttgggattttttgagctttttggatctgtgcttttatagttttcttcaaatttggaaaatttttggccatcgtttcttcgaatatttttttctgtcttcctctttctcctcatccaggtcctccaattttatgtatatttggctgcttggtgttatttcacatgtcactgattggctgttgattttttatttttgtttttttttcttaaattttaatttaactttactttttttgagacagagtcttgctctatcacccaggctggagtgcagtggtatgatcttggctcatggcaatctctgcctccggggttcaagcaattcttatgcctcagcctcctgagtagctgggactacaggcgtgtgccaccacgcctggctaacttttgtatttttagtagagacagggttttaccctgttggccaggctggtctcaaagtcctggcctcaaatgattcacccacctcagcctcccaaagttctgggattataagtgtgagccagcatgcctggctggctgttgatttttaaaaattattccttattctccatgtttaattttgagtaacttctgttactcttcaagtttacatttcttgtgtgaagtctaatttgccattaacttgatctagtgtgtttttcattttagacattgtagtttttatttctggaagttccatttgtttcttttatatatctttcatgactctacataagatgctcaatctttacttttttgaacaaatagaatacagttgtaataactgctaatgtccttgtctactaattctgtcatatgggtaatttctcagttttgatatttttccctcttttattttctgtatttttgtaggccttatacatttttattagatgccagaagttttaaatcctactttgtgggttattggatatttttggatttctattgatgaggtttgtactagtatgtttgagttacgtcgacatagtttgatccttctgggtcttgcttttaagcttttaaggcaggacctgaaatagcatttagtctagggctgattctgcttcattactgaggcaaaaccacttctgtttatcctgcttagtaccacgttaattatgagatttcccactgaattataggagcaagtgctcttcctagtcctgtgtgagctgtggggcttatttccaccaatcttttcacatggttctttctccagcttcatgtggtctccttacatgcatatatccatcagcaccgatgcagatctttcagctttttctctgtagctctcttccctttggtactttgcctaggaactgtagctgccttgccctcttcagaataccagctccatctctttaactgagggagaccactgggttttgctttggtgcccacacccgagtgtctgttaactttctttaggcactaaccttggacaattctaaggctcacattttttttttctgcctctcagggatcattgctctttgttgcctgatgtccagtgtcttgaaaactgttgtttcatatattatgtctggttttctggttattttagctggcagagtaaatctggtccctgttattccaccttggctataactggaagtcagaactatggattttaatggctgtgtatcatttcatccagtggatgtgctataacttcacttagctgttttctaattatttgacatttagattgtttctaaggttttgataactcactgttaacattgtagtgtacatgttaatgtgtatgcatttttccaattgaagaatcaattgccagtaatgagattagtttgaagagaataatcctttttatggttcttttaggagtaaaaattcctaataaatgatacatttgtgtaatgccactaacagtgcgaaggtatcagtttcaaaataatcttgccagtgttgaatgctttaatttaaattttgtgtactcattagtaagtataaaatgatatatgaagcttgctttaattttttatacagttgaccgttgaacaatgcaaaggttaggggctccaactccctgcatagttgaaaacccatgtgtaacttttggcttccccaaaacttaactacgaatagtctgctgttgactggaagacttaccaataacataaacagttgattaccatagattttgtctgttatatgtattatatactgtattattataataaagcaagctagagaaaagcaaatttattaagaaaatcataagagaaaatatatatactattcattaagtggaagtagattatcataaagaccttcatcctcatcatcttcctgtagagtaggctgaggaggaggaggaagaggagaggttggtctcaggggtggcagaaacacaagatagcctgcatataagtggacctgcacagttcaaacccacattgttccagggccaactgtattttgattttcagttgggatattgtttcatatagttttatacaactttttttttttttgagatggagtctcgctctgttgcccacgctggagtgcagtggtgcaatctcggctccgcctcccgggttcatgccattctcctgcctcagcctcccgagtggctgggactacaggcgcctgccaccacgcccagctaatttttttttgtatttttagtagagacggggcttcaccatgttagccaggatggtctcgatctcctgaccttgtgatccgcctgcctcggcctcccaaagcgctgggattacaggtgtgagccactgcgcccggccagttttatacaactttttacagaaatttctggttcttttacaaacttaaaattatgaatcagtttaccactcccgtttatatctactatattgtttctcaaaagaacacagaacagataaaatacttaaagaatttgtaaaagttctaatgaaacttaaaatctagaaggcgtaaaaataagattgataaattcaactatacaaaaataataaacttttccgtggagaaaagcatagtgccataggttaaaatggggaaaatatttccaacttgtatcatggacaaagctaatctctctaatatataaagaacttttagaaattaagaagaaaaaagcaagagtccagtagaaaaacagtcaaaggactgagcagaaaaaaataaataatgtttccttaagaaaaaagtgaggccaggcacggtggctcacgcctgtaatcccagcacttagggaggccgaggcgggcagatcatgaggtcaggagttggagaccatcctggccaacatggtgaaacctgtctctactaataatacaaaaaaattagctgggcgtggtggcgcatacctgtaatcccagctactcgggaggtggaggcagcagaatcgcttgaacccaggaggcagaggttgcagtgagtggagatcgtgccattgcactagcctgggcaacagggtgagactccatctcgggaaaagaaaagaaaaaaaaattatcaactcatagtataaaaaaatgtaaattaaaattctgtaagagaaaatttttcacctgcctggttggcaaaaatccggaaatttggctctgtgggtgaggctatggggaattcttatatattgcttgtaatattcttataaattgtaaccattactattgaaagacaatttgacaatacctaaaagaaatgatgaatgcacttatttattgatacagcatttctgctttagggaaattattctgtagttattatacctgcactaatatgatacaacatatgtgcaaggttattcattatagcagtttttttggtagtagcaaaagattggaaaaatataagtgtttatcagtagggtacaagttaaataaactctagaacatcttcacaatggagtttcatatagctgtatggaaaacgaggaggtccactatgtacagataagtggaaaaaaactgatgcaccaaatggtatataaatagtatgctaccttttgtgtaagaaagtgttgacagtagaaacgtattttgttcttgattgtttgctcgaagaaatactgtaaggttacagaagaaactaataaaagtggttatttttgtgaaggcagaagtaaagcggacaggaatgaactttgtggaagacttctcaatatattcaattaatatcagtttgatttttgagtaatgtgaaaattaatgtaaagtgtttataatcatctagtattttctgcctagtatgagtttggtgactgttgatgtaaaattcttctctctagaaatgaatactgcattgagggacggacttctggtcttcttcttcctaattgttccccttattgtctgtgctatttttatcttcatcaagagggatcaactgtggagaagctacttcagaaagaagagatcacaaacatatgagtacttagatttttttcttttaattcctatattaaatatatacatacattttctgagacagaatctcgacttccctgggctcaggtgattccccctgcctcagccttccaagtagttgggattacaggcacaccaccacacccagttaatttttatatttttttgtagagatggggtttcgccatgttgcccgggctggtcttgaactttttgaagccatccatctgcctcagcctgccaaagtgcagggattactggagtgagcctccacgctcagcctatattaaataatttataaagtattaatgctgatagtcatatcaccagagattggtaatcctctaaaatagggttctaagttatttctctgaccttttgacatgattagcatgggttgaaaggtggtggtgaccaagccacctcttttaatggggaggagaaaggcttatgttggtcagcctttaggctgctgaaagtgaccctcagggttcattttgcttaacaccaatttctgatagaggactaagtagatacttcgtatcatacttccaactgaccagtctatgcaaataactcccccatctgcatttttgaagtttgagttccataactacagctatctttcatacatctccactgcactgatttgctgtcacttcagcatgtctaaaacttacctattacctttccagccaatccattcactacccttggatttcctaatttttaaaatgactacttggcaacctgagaatatgcttttactcttctctgattttaggaagacttgagaaaagttagggaacattggcctaattgaccaaatttcacaatttcttaaaatttcagtttaattataaaatgtggttagtaatgctttctaataccataaggattaaaaatacgtgaaagctgttaaaatgccctaaaaatttaaaccgtatcatgattatcatccccaccactaccaacatcattattctgtatttgggaaaatgcaaaatgtgtgtaatatttcatgtagaaatgtttttatcttaatttagatcaaaagtaattgtatctttcaggtcagatggcaaaaatcaagcaaacccttctagacagccggggagtgttcctcgacatgtttctccagtgacacctcccagagaagttgtaagtataaaatgaaaaattatttttctttactgtattaaaggatcaaatgcttaaggattaaaaacacagttatatagctatagctagaaacatagataccttcttaagaattcaagagtattgtaggtggtccctgagttttttgtttttgttttcgagacagagccttgctctgttgcccggggtggagtactgtggcacaattgcgtctcattgcaacctctgcctnnnnnnnnnnnnnnnnnnnncgtgcctcagcctcccgagtagctgggattacaggtgtgtaccaccacgcctggctaatttttgtatttttcatagagacggggtctcaccgcattggccaggctggtcttgaactcctgacctcaagtgatccacccgccttggcctcccaaagtgctgggattacaggtatgagccactgtgccctgccccctgagttctttaaaggaaaaccagcggagtccttggctcagaggacacagaaaaagacagctggacattaggaatgccttgcctagcaaccaggattgggaaatgacatgggacgtatgctatcactgcttttttctgtgtctgctcttttcctattttcaatacctgtctccatctccctatgggatgttaccaaagacctggtgctgagctcttggatcggcctaattgtctaagctgtaggactgatagtcactgttctgcaagtgtattagggagtgtttagatcatgatatacttttattgagtgtttagatcatgatatacttttattgatctgcatgtatccctaagcaatatgtaattttttaatgttttaaaacttttaagaacgttttatttgataatttgcacatatatctgcaacctgtttttccccttaatgtcactttgtgatttatctctatcgatagatatagctgtgattcattcattttcactgttgaaaatgattagaaatccttcattttttaatatatttatacacacacacacacacacacacacaatctccctattccaccccctttatctttataaaaaggagacaaaaatcgttaggccctttctcctcttaaccatgtatcttggagatttttccatgttgttatgtatacaggatggccacaaaggccatatgcatgctagttcaaaattatctgtatactcttcttcatcattgccatatatgtatatatttcttatttggttttggcaaaatatatataaaatttgccattttaaccattgttttcaagatttttttgtaaatttaacagtagtggtaaaaaaaaaacccactaatatttaccatcttaacaatttttacatgtacagtgcagtactcctaagaatatttacctatgttttcttttagtagttttatagtttcaggtcttatgtttaaatctttaatccagtttgagttgatttttgtatatggtatgaaataccagttcattttcatttttcttcatgtggatatgaagttgtcccaacactattaattgaagtgactgtcccttcttcattgtgtattcttggcaccttcgttgaagattagctgaccataaagttgtggatttggggttctctattctgttccatttgtctttatgtctgttttatgccagtagtatgccattttaattagtatagctttgcagtatattttgaaatttggtaatgtgatgcttctagctttgttctttttgctcaagattggtttagtgattctgggtcttttgtggttccatatgaattttagtattttttctattgttacaaaaattgtcattggaatattaatagatattgcattgaatctgtagtttgctgtggttattttaatattaactcttccagtcagtgagcatgggatatctttccatttatttatgtcttcaattcctttcatcaatgtttcatagatttccttgtacagatacttattttttgtggttaaatttattcctatattatttatgtatgtatttt
